(12) United States Patent
Donohue et al.

(10) Patent No.: US 11,242,544 B2
(45) Date of Patent: Feb. 8, 2022

(54) MICROBIOMES AND METHODS FOR PRODUCING MEDIUM-CHAIN FATTY ACIDS FROM ORGANIC SUBSTRATES

(71) Applicant: WISCONSIN ALUMNI RESEARCH FOUNDATION, Madison, WI (US)

(72) Inventors: Timothy James Donohue, Middleton, WI (US); Matthew Scarborough, Madison, WI (US); Daniel Noguera, Madison, WI (US)

(73) Assignee: Wisconsin Alumni Research Foundation, Madison, WI (US)

( * ) Notice: Subject to any disclaimer, the term of this patent is extended or adjusted under 35 U.S.C. 154(b) by 234 days.

(21) Appl. No.: 16/433,639

(22) Filed: Jun. 6, 2019

(65) Prior Publication Data

US 2020/0017891 A1 Jan. 16, 2020

Related U.S. Application Data

(60) Provisional application No. 62/846,378, filed on May 10, 2019, provisional application No. 62/697,249, filed on Jul. 12, 2018, provisional application No. 62/696,677, filed on Jul. 11, 2018.

(51) Int. Cl.
*C12P 7/64* (2006.01)
*C12N 1/20* (2006.01)
*C12R 1/225* (2006.01)

(52) U.S. Cl.
CPC ............ *C12P 7/6409* (2013.01); *C12N 1/205* (2021.05); *C12P 2203/00* (2013.01); *C12R 2001/225* (2021.05)

(58) Field of Classification Search
CPC .... C12N 1/205; C12P 2203/00; C12P 7/6409; A61K 35/741
See application file for complete search history.

(56) References Cited

U.S. PATENT DOCUMENTS

| 8,835,665 | B2 | 9/2014 | Reaney et al. | |
|---|---|---|---|---|
| 9,708,630 | B1 | 7/2017 | Pfleger | |
| 2014/0199281 | A1* | 7/2014 | Henn | A23L 33/127 424/93.46 |
| 2015/0050246 | A1* | 2/2015 | Jones | A61K 9/0053 424/93.4 |
| 2015/0374761 | A1* | 12/2015 | Sadowsky | A61K 35/741 424/489 |

FOREIGN PATENT DOCUMENTS

| CN | 104328144 A | 2/2015 | | |
|---|---|---|---|---|
| WO | WO 2008070561 A1 | 6/2008 | | |
| WO | WO 2013022998 A2 | 2/2013 | | |
| WO | WO-2013037068 A1 * | 3/2013 | ............ | A61K 35/74 |
| WO | WO-2014152484 A1 * | 9/2014 | ............... | C12N 1/20 |

OTHER PUBLICATIONS

Abdullah, M. and French, D., Substrate Specificity of Pullulanase. *Archives of Biochemical and Biophysical Research Communications*. 1970. 137, 483-493.

Aboulnaga, E.H., Pinkenburg, O., Schiffels, J., El-Refai, A. Buckel, W. and Selmer, T., Effect of an Oxygen-Tolerant Bifurcating Butyryl Coenzyme A Dehydrogenase/Electron-Transferring Flavoprotein Complex from *Clostridium difficile* on Butyrate Production in *Escherichia coli*. *Journal of Bacteriology*. 2013. 195, 3704-3713.

Agler, M.T., Wrenn, B.A., Zinder, S.H. and Angenet, L.T., waste to bioproduct conversion with undefined mixed cultures: the carboxylate platform. *Trends in Biotechnology*. 2011. 29 (2), 70-78.

Anders, S., PYL, P.T. and Huber, W., HTSeq—a Python framework to work with high-throughput sequencing data. *Bioinformatics*. 2015, 31 (2), 166-169.

Andersen, S.J., CAndry, P., Basadre, T., Khor, W.C., Roumr, H., Hernandez-Sanabria, E., Coma, M. and Rabaey, K., ELectrolytic extraction drives volatile fatty acid chain elengation through lactic acid and replaces chemical pH control in thin stillage fermentation. *Biotechnology for Biofuels*. 2015. 8:221.

Andersen, S.J., De Groof, V., Khor, W.C., Roume, H., Props, R., Coma, M. and Rabaey, K., *A Clostridium* Group IV Species Dominates and Suppresses a Mixed Culture Fermentation by Tolerance to Medium Chain Fatty Acids Products. *Frontiers in Bioengineering and Biotechnology*, 2017. 5, 8.

Angenent, L.T., Richter, H., Buckel, W., Spirito, C.M., Steinbusch, K.J.J,, Plugge, C.M., Strik, D., Grootscholten, T.I.M., Buisman, C.J.N. and Hamelers, H.V.M., Chain Elongation with Reactor Microbiomes: Open-Culture Biotechnology To Produce Biochemicals. *Environmental Science & Technology*, 2016, 50, 2796-2810.

Austin, S., Kontur, W.S., Ulbrich, A., Oshlag, J.Z., Zhang, W., Higbee, A., Zhang, Y., Coon, J.J., Hodge, D.B., Donohue, T.J. and Noguera, D.R., Metabolism of Multiple Aromatic Compounds in Corn Stover Hydroysate by *Rhodopseudomonas palustris*. *Environmental Science & Technology*, 2015. 49, 8914-8922.

Balan, V., Bals, B., Chundawat, S.P.S., Marshall, D. and Dalem D.E., Lignocellulosic Biomass Pretreatment Using AFEX. *Biofuels: Methods and Protocols, Methods in Molecular Biology*. 2009. 581, 61-77.

Barter, R.L. and Yu, B., Superheat: An R package for Creating Beautiful and Extendable Heatmaps for Visualizing Complex Data. *Journal of Computational and Graphical Statistics*. 2018. 27(4):910-922.

(Continued)

*Primary Examiner* — Thane Underdahl
(74) *Attorney, Agent, or Firm* — Daniel A. Blasiole; DeWitt LLP

(57) ABSTRACT

Microbiome compositions and uses thereof. The microbiome compositions include a set of microbes. The sets of microbes contain members of Lactobacillaceae, Eubacteriaceae, Lachnospiraceae, and Coriobacteriaceae. The number of individual physical microbes in the set constitutes a certain percentage of the total number of individual physical microbes in the microbiome composition. The microbiome compositions can be used for producing medium-chain fatty acids from organic substrates through anaerobic fermentation in a medium. The medium can include lignocellulosic stillage.

20 Claims, 16 Drawing Sheets
(15 of 16 Drawing Sheet(s) Filed in Color)
Specification includes a Sequence Listing.

(56) References Cited

OTHER PUBLICATIONS

Bleckwedel, J., Teran, L.C., Bonacina, J., Saavedra, L., Mozzi, F. and Raya, R., Draft Genome Sequence of the Mannitol-Producing Strain *Lactobacillus mucosae* CRL573. *Genome Announcements*. 2014. 2(6).

Buckel, W. and Thauer, R.K., Energy conservation via electron bifurcating ferredoxin reduction and proton/Na+ translocating ferredoxin oxidation. *Biochimica et Biophysica Acta (BBA)—Bioenergetics*. 2013. 1827, 94-113.

Caporaso, J.G., Bittinger, K., Bushman, F.D., DeSantis, T.Z., Andersen, G.L. and Knight, R., PyNAST: A flexible tool for aligning sequences to a template alignment. *Bioinformatics*. 2010. 26(2), 266-267.

Caporaso, J.G., Kuczynski, J., Stombaugh, J., Bittinger, K., Bushman, F.D., Costello, E.K., Fieres, N., Pena, A.G., Goodrich, J.K., Gordon, J.I., Huttley, G.A., Kelley, S.T., Knights, D., Koenig, J.E., Ley, R.E., Lozupone, C.A., McDonald, D., Muegge, B.D., Pirrung, M., Reeder, J., Yatsunenko, T., Zaneveld, J. and Knight, R., Qiime allows analysis of high-throughput community sequencing data, *Nature Methods*. 2010. 7(5), 335-336.

Chao, S.H., Sasamoto, M., Kudo, Y., Fujimoto, J, Tsai, Y.C. and Watanabe, K., *Lactobacillus odoratitofui* sp. Nov., isolated from stinky tofu brine. *International Journal of Systematic and Evolutionary Microbiology*. 2010. 60, 2903-2907.

Collins, M.D. and Wallbanks, S., Comparative sequence analysis of the 16S rRNA genes of *Lactobacillus rimae* and *Streptococcus parvulus*: Proposal for the creation of a new genus *Atopobium*. *FEMS Microbiology Letters*. 1992. 95, 235-240.

Darling, A.E., Jospin, G., Lowe, E., Matsen IV, F.A., Bik, H.M. and Eisen, J.A., PyhloSift: phylogenetic analysis of genomes and metagenomes, *Peer J*. 2014. 2:E243.

De Kok, S., Meijer, J., Van Loosdrecht, M.C.M. and Kleerebezem, R., Impact of Dissolved hydrogen partial pressure on mixed culture fermentations. *Applied Microbiology and Biotechnology*. 2013. 97: 2617-2625.

Dellaglio, F., Vancanneyt, M., Enso, A., Vandamme, P., Felis, G.E., Castioni, A., Fujimoto, J., Watanabe, K. and Okadam S., *Lactobacillus durianis* Leisner et al. 2002 is a later heterotypic synonym of *Lactobacillus vaccinostercus* Kozaki and Okada 1983. *International Journal of Systematic and Evolutionary Microbiology*. 2006. 56, 1721-1724.

Demmer, J.K., Pal Chowdhury, N., Selmer, T., Ermler, U. and Buckel, W., The semiquinone swing in the bifurcating electron transferring flavoprotein/butyryl-CoA dehydrogenase comples from *Clostridium difficile*. *Nature Communications*. 2017. 8: 1577.

Devarapalli, P., Deshpande, N. and Hirwani, R.R., Xylose utilization in ethanol production: a patent landscape. *Biofuels, Bioproducts and Biorefining*. 2016. 10, 534-541.

DeWhirst, F.E., Paster, B.J., Tzellas, N., Coleman, B., Downes, J., Spratt, D.A. and Wade, W.G., Characterization of novel human oral isolates and cloned 16S rDNA sequences that fall in the family *Coriobacteriaceae*: description of *Olsenella* gen. nov., reclassification of *Lactobacillus uli* as *Olsenella uli* comb. nov. and description of *Olsenella profuse* sp. nov. *International Journal of Systematic and evolutionary Microbiology*. 2001. 51, 1797-1804.

Dodd, D., Kocherginskaya, S.A., Spies, M.A., Beery, K.E., Abbas, C.A., Mackie, R.I. and Cann, I.K.O., Bioichemical Analysis of a β-D-Xylosidase and a Bifunctional Xylanase-Ferulic Acid Esterase from a Xylanolytic Gene Cluster in *Prevotella ruminicola* 23. *Journal of Bacteriology*. 2009. 191(10), 3328-3338.

Duncan, S.H., Aminov, R.I., Scott, K.P., Louis, P., Stanton, T.B. and Flint, H.J., Proposal of *Roseburia faecis* sp. nov., *Roseburia hominis* sp. nov. and *Roseburia inulinivorans* sp. nov., based on isolates from human faeces. *International Journal of Systematic and Evolutionary Microbiology*. 2006. 56, 2437-2441.

Duncan, S.H., Hold, G.L., Barcenilla, A., Stewart, C.S. and Flint, H.J., *Roseburia intestinalis* sp. nov., a novel saccharolytic, butyrate-producing bacterium from human faeces. *International Journal of Systematic and Evolutionary Microbiology*. 2002. 52, 1515-1620.

Edgar, R.C., Search and clustering orders of magnitude faster than BLAST, *Bioinformatics*. 2010. 26(19), 2460-2461.

Edgar, R.C., Muscle: a multiple sequence alignment method with reduced time and space complexity. *BMC Bioinformatics*, 2004. 5: 113.

Edgar, R.C., Muscle: multiple sequence alignment with high accuracy and high throughput, *Nucleic Acids Research*, 2004. 32(5), 1792-1797.

English, A.C., Richards, S., Han, Y., Wang, M., Vee, V., Qu, J., Qin, X., Muzny, D.M., Reid, J.G., Worley, K.C. and Gibbs, R.A., Mind the Gap: Upgrading Genomes with Pacific Biosciences RS Long-Read Sequence Technology. *PLoS One*. 2012. 7(11), e47768.

Eren, A.M., Esen, O.C., Quince, C., Vineis, J.H., Morrison, H.G., Sogin, M.L. and Delmont, T.O., Anvi'o: an advanced analysis and visualization platform for 'omics data. *PeerJ*, 2015. 3, e1319.

Garde, A., Jonsson, G., Schmidt, A.S. and Ahring, B.K., *Bioresource Technology*. 2002. 81, 217-223.

Ge, S., Usack, J.G., Spirito, C.M. and Angenent, L.T., Long-Term n-Caproic Acid Production from Yeast-Fermentation Beer in an Anaerobic Bioreactor with Continuous Product Extraction. *Environmental Science & Technology*. 2015. 49, 8012-8021.

Gelfand, I., Sahajpal, R., Zhang, X., Izaurralde, R.C., Gross, K.L. and Robertson, G.P., Sustainable Bioenergy Production from Marginal Lands in the US Midwest, *Nature*, 2013. 493, 514-517.

Gerbrandt, K., Chu, P.L., Simmonds, A., Mullins, K.A., MacLean, H.L., Griffins, W.M. and Saville, B.A., *Current Opinion in Biotechnology*. 2016. 38, 63-70.

Ghosh, S., Conrad, J.R. and Klass, D.L., Anaerobic Acidogenesis of Wastewater Sludge. *Research Journal of the Water Pollution Control Federation*. 1975. 47, 30-45.

Grootscholten, T.I.M., Dal Borgo, F.K., Hamelers, H.V.M. and Buisman, C.J.N., Promotin Chain Elongation in Mixed Culture Acidification Reactors by Addition of Ethanol. *Biomass & Bioenergy*. 2013. 48, 10-16.

Grootscholten, T.I.M., Strik, . P. B. T. B. K., Steinbusch, J.J., Buisman, C.J.N. and H. V. M. Hamelers. Two-stage Medium Chain Fatty Acid (MCFA) Production from Municiple Solid Waste and Ethanol. *Applied Energy*. 2014. 116, 223-229.

Haas, B.J., Geveres, D., Earl, A.M., Feldgarden, M., Ward, D.V., Giannoukos, G., Ciulla, D., Tabbaa, D., Highlander, S.K., Sodergren, E., Methe, B., DeSantis, T.Z., Petrosino, J.F., Knight, R., Birren, B.W. and Consortium, H.M., Chimeric 16S rRNA Sequence Formation and Detection in Sanger and 454-Pyrosequenced PCR Amplicons. *Genome Research*. 2011. 21, 494-504.

Han, W., He, P., Shao, L. and Lu, F., Metabolic Interactions of a Chain Elongation Microbiome. *Applied and Environmental Microbiology*. 2018. DOI: 10.1128/AEM.01614-18.

Hegner, R., Koch, C., Riechert, V. and Harnisch, F., Microbiome-based Carboxylic Acids Production: from Serum Bottles to Bioreactors. *RSC Advances*. 2017. 7, 15362-15371.

Holdeman, L.V., Elizabeth, C.P. and Moore, W.E.C., Amended Description of Ramibacterium Alactolyticum Prevot and Taffanel with Proposal of a Neotype Strain. *International Journal of Systematic Bacteriology*. 1967. 17, 323-341.

Holtzapple, M.T. and Granda, C.B., Carboxylate Platform: The MixAlco Process Part 1: Comparison of Three Biomass Conversion Platforms. *Biotechnology and Applied Biochemistry*. 2009. 1565, 95-106.

Humbird, D., Davis, R., Tao, L., Kinchin, C., Hsu, D., Aden, A., Schoen, P., Lukas, J., Olthof, B., Worley, M., Sexton, D. and Dudgeon, D. Process Design and Economics for Biochemical Conversion of Lignocellolosic Biomass to Ethanol. *National Renewable Energy Laboratory*. 2011.

Hyatt, D., Chen, G.L., Locascio, P.F., Land, M.L., Larimer, F.W. and Hauser, L.J., Prodigal: Prokaryotic Gene Recognition and Translational Initiation Site Identification. *BMC Bioinformatics*. 2010. 11, 119.

Jeon, B.S., Choi, O., Um, Y. and Sang, B.I., Production of Medium-Chain Carboxylic Acids by *Magasphaera* sp. MH with Supplemental Electron Acceptors. *Biotechnology for Biofuels*. 2016. 9.

Jovita, M.R., Collins, M.D., Sjoden, B. and Falsen, E., Characterization of a Novel Atopobium Isolate from the Human Vagina:

(56) References Cited

OTHER PUBLICATIONS

Description of *Atopobium vaginae* sp. Nov. *International Journal of Systematic Bacteriology*. 1999. 49, 1573-1576.

Kenealy, W.R., Cao, Y. and Weimer, P.J., Production of Caproic Acid by Cocultures of Ruminal Cellulolytic Bacteria and Clostridium Kluyveri Grown on Cellulose and Ethanol. *Applied Microbiology and Biotechnology*. 1995. 44, 507-513.

Kielbasa, S.M., Wan, R., Sato, K., Horton, P. and Frith, M.C., Adaptive Seeds Tame Genomic Sequence Comparison. *Genome Research*. 2011. 21, 487-493.

Kim, M., Oh, H.S., Park, S.C. and Chun, J., Towards a Taxonomix Coherence Between Average Nucleotide Identity and 16S RNA gene Sequence Similarity for Species Demarcation of Prokaryotes. *International Journal of Systematic and Evolutionary Microbiology*. 2014. 64, 1825-1825.

Kleerebezem, M., Boekhorst, J., Van Kranenburg, R., Molenaar, D., Kuipers, O.P., Leer, R., Tarchini, R., Peters, S.A., Sandbrink, H.M., Fiers, M.W., Stiekema, W., Lankhorst, R.M., Bron, P.A., Hoffer, S.M, Groot, M.N., Kerkhoven, R., De Vries, M., Ursing, D., De Vos, W.M. and Siezen, R.J., Complete Genome Sequence of Lactobacillus. *Proceedings of the National Academy of Sciences of the United States of America*. 2003. 100, 1990-1995.

Klindworth, A., Pruesse, E., Schweer, T., Peplies, J., Quast, C., Horn, M. and Glockner, F.O., Evaluation of General 16S Ribosomal RNA gene PCR Primeres for Classical and Next-Generation Sequencing-Based Diversity Studies. *Nucleic Acids Research*. 2013. 41.

Konwar, K.M., Hanson, N.W., Bhatia, M.P., Kim, D., Wu, S.J., Hahn, A.S., Morgan-Lang, C., Cheung, H.K. and Hallam,S.J., MetaPathways v2.5: Quantitative Functional, Taxonomic and Usability Improvements. *Bioinformatics*. 2015. 31, 3345-3347.

Kopylova, E., Noe, L. and Touzet, H., SortMeRNA: Fast and Accurate Filtering of Ribosomal RNAs in Metatranscriptomic Data. *Bioinformatics*. 2012. 28, 3211-3217.

Kraatz, M., Wallace, R.J. and Svensson, L., *Olsenella umbonata* sp. Nov., a Microaerotolerant Anaerobic Lactic Acid Bacterium from the Sheep Rumen and Pig Jejunum, and Emended Descriptions of Olsenella, Olsenella uli, and Olsenella Profusa. *International Journal of Systematic and Evolutionary Microbiology*. 2011. 61, 795-803.

Krooneman, J., Faber, F., Alderkamp, A.C., Elferink, S.J.H.W.O., Driehuis, F., Cleenwerck, I., Swings, J., Gottschal, J.C. and Vancanneyt, M., *Lactobacillus diolivorans* sp. nov., a 1,2-Propanediol-Degrading Bacterium Isolated from Aerobically Stable Maize Silage. *International Journal of Systematic and Evolutionay Microbiology*. 2002. 52, 639-646.

Kucek, L.A., Nguyen, M. and Angenet, L.T., Conversion of L-Lactate Into N-Caproate By A Continuously Fed Reactor Microbiome. *Water Research*. 93, 163-171.

Kucek, L.A., Spirito, C.M. and Angenent, L.T., High N-Caprylate Productivities and Specificities from Dilute Ethanol and Acetate: Chain Elongation with Microbiomes to Upgrade Products from Syngas Fermentation. *Energy & Environmental Science*. 2016. 9, 3482-3494.

Kucek, L.A., Xu, J.J., Nguyen, M. and Angenent, L.T., Waste Conversion into n-Caprylate and n-Caproate: Resource Recovert from Wine Lees Using Anaerobic Reacto Microbiomes and In-line Extraction. *Frontiers in Microbiology*. 2016, 7.

Kumar, A. and Sokhansanj, S., Switchgrass (*Panicum Vigratum*, L.) Delivery to a Biorewnery Using Integrated Biomass Supply Analysis and Logistics (IBSAL) Model. *Bioresource Technology*. 2007. 98, 1033-1044.

Larkin M. A., et al. ClustalW2, ClustalW and ClustalX version 2. *Bioinformatics*. 2007. 23(21): 2947-2948.

Lawlis, V.B., Dennis, M.S., Chen, E.Y., Smith, D.H. and Henner, D.J., Cloning and Sequencing of the Xylose Isomerase and Xylulose Kinase Genes of *Escherichia coli*. *Applied and Environmental Microbiology*. 1984. 47, 15-21.

Lawson, C.E., Wu, S., Bhattacharjee, A.S., Hamilton, J.J., McMahon, K.D., Goel, R. and Noguera, D.R., Metabolic Network Analysis Reveals Microbial Community Interations in Anammox Geanules. *Nature Communications*. 2017. 8, 15416.

Li, X., Jensen, R.L., Hojberg, O., Canibe, N. and Jensen, B.B., *Olsenella scatoligenes* Sp. Nov., A 3-Methylindole-(Skatole) and 4-Methylphenol-(P-Cresol) Producing Bacterium Isolated from Pig Faeces. *International Journal of Systematic and Evolutionary Microbiology*. 2015. 65, 1227-1233.

Li, F., Hinderberger, J ., Seedorf, H., Zhang, J., Buckel, W. and Thauer, R.K., Coupled Ferredoxin and Crotonyl Coenzyme A (Coa) Reduction With NADH Catalyzed by the Butyryl-Coa Dehydrogenase/ Etf Complex From Clostridium Kluyveri. *Journal of Bacteriology*. 2008. 190, 843-850.

Liang, S. and Wan, C., Carboxylic Acid Production from Brewer's Spent Grain Via Mixed Culture Fermentation. *Bioresource Technology*. 2015. 182, 179-183.

Lombard, V., Golaconda Ramulu, H., Drula, E., Coutinho, P.M. and Henrissat, B., The Carbohydrate-Active Enzymes Database (CAZy) in 2013. *Nucleic Acids Research*. 2014. 42, D490-495.

Magoc, T. and Salzberg, S.L., Flash: Fast Length Adjustment of Short Reads to Improve Genome Assemblies. *Bioinformatics*. 2011. 27, 2957-2963.

McMurdie, P.J. and Holmes, S., Phyloseq: An R Package for Reproducible Interactive Analysis and Graphics of Microbiome Census Data. *PLoS One*. 2013. 8.

Nasr, N., Elbeshbishy, E., Hafez, H., Nakhla, G. and El Naggar, M.H., Comparative Assessment of Single-Stage Anaerobic Digestion for the Treatment of Thin Stillage. *Bioresource Technology*. 2012. 111, 122-126.

Nelson, R., Peterseon, D., Karp, E., Beckham, G. and Salvachúa, D., Mixed Carboxylic Acid Production by Megasphaera elsdenii from Glucose and Lignocellulosic Hydrolysate. *Fermentation*. 2017. 3, 10.

Notredame et al. T-Coffee: A novel method for multiple sequence alignments. *Journal of Molecular Biology*. 2000. 302: 205-217.

Nurk, S., Meleshko, D., Korobeynikov, A. and Pevzner, P.A., MetaSPAdes: A New Versatile Metagenomic Assembler. *Genome Research*. 2017. 27, 824-834.

Ong, R.G., Higbee, A., Bottoms, S., Dickinson, Q., Xie, D., Smith, S.A., Serate, J., Pohlmann, E., Jones, A.D., Coon, J.J., Sato, T.K., Sandford, G.R., Eilert, D., Oates, L.G., Piotrowaki, J.S., Bates, D.M., Cavalier, D. and Zhang, Y. Inhinition of Microbial Biofuel Production In Drought-Stressed Switchgrass Hydrolysate. *Biotechnology for Biofuels*. 2016. 9, 237.

Parks, D.H., Imelfort, M., Skennerton, C.T., Hugenholtz, P. and Yson, G.W., CheckM: Assessing The Quality of Microbial Genomes Recovered from Isolates, Single Cells, and Metagenomes. *Genome Research*. 2015. 25, 1043-1055.

Parreiras, L.S., Breuer, R.J., Avanasi Narasimhan, R., Higbee, A.J., LA Reau, A., Tremaine, M., Qin, L., Willis, L.B., Bice, B.D., Bonfert, B.L., Pinhancos, R.C., Balloon, A.J., Uppugundla, N., Liu, T., Li, C., Tanjore, D., Ong, I.M., Li, H., Pohlmann, E.L., Serate, J., Withers, S.T., Simmons, B.A., Hodge, D.B., Westphall, M.S., Coon, J.J., Dale, B.E., Balan, V., Keating, D.H., Zhang, Y., Landick, R., Gasch, A.P. and Sato, T.K., Engineering and Two-Stage Evolution of a Lignocellulosic Hydrolysate-Tolerant *Saccharomyces cerevisiae* Strain for Anaerobic Fermentation of Xylose from AFEX Pretreated Corn Stover. *PLoS One*. 2014, 9, e107499.

Pinheiro, J. 2017. Package 'nlme'. retrieves from cran.r-project.org/ web/packages/nlme/nlme.pdf.

Quast, C., Pruesse, E., Yilmaz, P., Gerken, J., Schweer, T., Yarza, P., Peplies, J. and Glockner, F.O., The SILVA Ribosomal RNA Gene Database Project: Improved Data Processing and Web-Based Tools. *Nucleic Acids Research*. 2013. 41, D590-D596.

Richter, M., Rossello-Mora, R., Oliver Glockner, F. and Peplies, J. JSpeciesWS: A Web Server for Prokaryotic Species Circumscription Based on Pairwise Genome Comparison. *Bioinformatics*. 2016. 32, 929-931.

Rodriguez, J., Kleerebezem, R., Lema, J.M. and Van Loosdrecht, M.C.M, Modeling Product Formation in Anaerobic Mixed Culture Fermentations. *Biotechnology and Bioengineering*. 2006. 93, 592-606.

(56) References Cited

OTHER PUBLICATIONS

Ronimus, R.S. and Morgan, H.W., The Biochemical Properties and Phylogenies of Phosphofructokinases from Extremophiiles. *Extremophiles*. 2001. 5, 357-373.

Roos, S., Karner, F., Axelsson, L. and Jonsson, H., *Lactobacillus mucosae* Sp. Nov., A New Species With In Vitro Mucos-Binding Activity Isolated From Pig Intestine. *International Journal of Systematic and Evolutionary Micrbiology*. 2000, 50 Pt 1, 251-258.

Sakamoto, T. and Thibault, J.F., Exo-Arabinanase of Penicillium Chrysogenum Able to Release Arabinobiose from a-1,5-L-Arabinan. *Applied and Environmental Microbiology*. 2001. 67, 3319-3321.

Sarria, S., Kruyer, N.S. and Peralta-Yahy, P., Microbial Synthesis of Medium-Chain Chemicals from Renewables. *Nature Biotechnology*. 2017. 35, 1158-1166.

Scarborough MJ, Lawson CE, Hamilton JJ, Donohue TJ, Noguera DR. Metatranscriptomic and Thermodynamic Insights into Medium-Chain Fatty Acid Production Using and Enaerobic Microbiome. *mSystems*. 2018. DOI: 0.1128/msystems.00221-18.

Scarborough MJ, Lynch G, Dickson M, McGee M, Donohue TJ, Noguera DR., Increasing the Economic Value of Lignocellulosic Stillage Through Medium-Chain Fatty Acid Production. *Biotechnology for Biofuels*. Jul. 2018. 19;11:200. doi: 10.1186/s1306/-018-1193-x. eCollection 2018.

Seider, W.D., Seader, J.D., Lewin, D.R. and Widagdo, S., "Product and process design principles: synthesis, analysis, and evaluation." John Wiley and Sons, Inc., Hoboken, New Jersey, 3rd ed., 2009. (Book—Copy not Provided).

Senate and House of Representatives of the United States of America. Energy Policy Act of 2005, US Government Publishing Office, Washington, D.C., 2005.

Senate and House of Representatives of the United States of America. Energy Independence and Security Act of 2007, US Government Publishing Office, Washington, D.C., 2007.

Smith, P.K., Krohn, R.I., Hermanson, G.T, Mallia, A.K., Gertner, F.H., Provenzano, M.D., Fujimoto, E.K., Goeke, N.M., Olson, B.J. and Klenk, D.C., Measurement of Protein Using Bicinchoninic Acid. *Analytical Biochemistry*. 1985. 150, 76-85.

Sokhansanj, S., Mani, S., Turhollow, A., Kumar, A., Bransby, D., Lynd, L. Laser, M., Large-Scale Production, Harvest and Logistics of Switchgrass (*Panicum virgatum* L.)—Current Technology and Envisioning a Mature Technology. *Biofuels, Bioproducts and Biorefining*. 2009. 3, 124-141.

Spirito, C.M., Richter, H., Rabaey, K., Stams, A.J., and Angenent, L.T., Chain Elongation in Anaerobic Reactor Microbiomes to Recover Resources from Waste. *Current Opinion in Biotechnology*. 2014. 27, 115-122.

Stamatakis, A. RaxML Version 8: A Tool Phylogenetic Analysis and Post-Analysis of Large Phylogenies. *Bioinformatics*. 2014. 30, 1312-1213.

Stams, A.J. and Plugge, C.M., Electron Transfer in Syntrophic Communities of Anaerobic Bacteria and Archaea. *Nature Reviews Microbiology*. 2009. 7, 568-577.

Stanton, T.B. and Savage, D.C., *Roseburia cecicola* Gen. Nov., Sp. Nov., A Motile, Obligateley Anaerobic Bacterium From a Mouse Cecum. *International Journal of Systematic Bacteriology*. 1983. 33, 618-627.

Strauber, H., Lucas, R. and Kleinsteuber, S., Metabolic and Microbial Community Dynamics During the Anaerobic Digestion of Maize Silage in a Two-Phase Process. *Applied Microbiology and Biotechnology*. 2016. 100, 479-491.

Thompson, J.D., Higginsm D. G., Gibson, T. J., Clustal, W: improving the sensitivity of progressive multiple sequence alignment through sequence weighting, position-specific gap penalties and weight matrix choice. *Nucleic Acids Research*. 1994. 22: 4673-4680.

Tian, Z.L., Mohan, G.R., Ingram, L. and Pullammanappallil, P., Anaerobic Digestion for Treatment of Stillage From Cellulosic Bioethanol Production. *Bioresource Technology*. 2013. 144, 387-395.

Urban, C., Xu, J., Sträuber, H., Dos Santos Dantas,T.R., Mühlenberg, J., Härtig, C., Angenent, L.T. and Harnisch, F., *Energy & Environmental Science*. 2017. DOI: 10.1039/c7ee01303e.

Vasudevan, D., Richter, H. and Angenent, L.T., *Bioresource Technology*. 2014. 151, 378-382.

W. E. F. American Public Health Association, and American Water Works Association Standard Methods for the Examination of Water and Wastewater: 21st Edition, American Public Health Association, 2005 (Book—Copy Not Provided).

Wang, Z.X., Zhuge, J., Fang, H.Y. and Prior, B.A., Anaerobi Digestion for Treatment of Stillage from Cellulosic Bioethanol Production. *Biotechnology Advances*. 2001. 19, 2001-223.

Weimer, P.J., Nerdahl, M. and Brandl, D.J., Production of Medium-Chain Volatile Fatty Acids by Mixed Ruminal Microorganisms is Enhanced by Ethano in Co-Culture with Clostridium Kluyveri. *Bioresource Technology*. 2015. 175, 97-101.

Wu, Y.W., Simmons, B.A. and Singer, S.W., MaxBin 2.0: An Automated Binning Algorithm to Recover Genomes from Multiple Metagenomic Datasets. *Bioinformatics*. 2016. 32, 605-607.

Xiong, B.Y., Richard, T.L. and Kumar, M., Integrated Acidogenic digestion and carboxylic acid separation by nanofiltration membranes for the lignocellulosic carboxylate platform. *Journal of Membrane Science*. 2015. 489, 275-283.

Yemm. E.W. and Willis, A.J., The Estimation of Carbohydrates in Plant Extracts by Anthrone. *Biochemical Journal*. 1954. 57, 508-514.

Yu, C.S., Chen, Y.C.,Lu, C.H. and Hwang, J.K., Prediction of Protein Subcellular Localization. *Proteins*. 2006. 64, 643-651.

Zhang, F., Zhang, Y., Chen, M., Van Loosdrecht, M.C.M. and Zeng, R.J., A Modified Metabolic Model for Mixed Culture Fermentation With Energy Conserving Electron Bifurication Reaction and Metabolite Transport Energy. *Biotechnology and Bioengineering*. 2013, 110, 1884-1894.

Zhang, Y. and Vadlani, P.V., Latic Acid Production from Biomass-Derived Sugars via Co-fermentation of Lactobacillus Brevis and Lactobacillus Plantarum. *Journal of Bioscience and Bioengineering*. 2015. 119, 694-699.

Zhu, X., Tao, Y., Liang, C., Li, X., Wei, N., Zhang, W., Zhou, Y., Yang, Y. and Bo, T., The Synthesis of N-Caproate from Lactate: A New Efficient Process for Medium-Chain Carboxylates Production. *Scientific Reports*. 2015. 5, 14360.

Zhu, X., Zhou, Y., Wang, Y., Wu, T., Li, X., Li, D. and Tao, T, Production of High-Concentration N-Caproic Acid from Lactate Through Fermentation Using a Newly Isolated Ruminococcaceae Bacterium CPB8. *Biotechnology for Biofules*2017. 10, 102.

Zurawski, J.V., Khatibi, P.A., Akinosho, H,O., Straub, C.T.,Compton, S.H., Conway, J.M., Lee, L.L., Ragauskas, A.J., Davison, B.H.M., Adams, M.W.M. and Kelly, R.M., Bioavailability of Carbohydrate Content in Natural and Transgenic Switchgrasses for the Extreme Thermophile Caldicellulosiruptor bescii. *Applied and Environmental Microbiology*. 2017. 83.

* cited by examiner

US 11,242,544 B2

MICROBIOMES AND METHODS FOR PRODUCING MEDIUM-CHAIN FATTY ACIDS FROM ORGANIC SUBSTRATES

CROSS-REFERENCE TO RELATED APPLICATIONS

Priority is claimed to U.S. Application 62/846,378, filed May 10, 2019, U.S. Application 62/697,249, filed Jul. 12, 2018, and U.S. Application 62/696,677, filed Jul. 11, 2018, each which is incorporated herein by reference in its entirety.

STATEMENT REGARDING FEDERALLY SPONSORED RESEARCH

This invention was made with government support under DE-FC02-07ER64494 and DE-SC0018409 awarded by the US Department of Energy. The government has certain rights in the invention.

SEQUENCE LISTING

The instant application contains a Sequence Listing which has been submitted in ASCII format via EFS-Web and is hereby incorporated by reference in its entirety. The ASCII copy, created on May 16, 2019, is named "USPTO-190606-Pat_App-P170271U505-SEQUENCE LISTING ST25.txt" and is 44,306 kilobytes in size.

FIELD OF THE INVENTION

The invention is directed to microbiomes and uses thereof, particularly for producing medium-chain fatty acids from organic substrates.

BACKGROUND

In lignocellulosic biorefining, the non-sugary parts of plants (e.g., corn stover) and dedicated energy crops (e.g., switchgrass, *Miscanthus*, poplar trees) are converted to biofuels by fermentation. To improve the revenue from lignocellulosic biorefining, other valuable chemicals (e.g., specialty chemicals) need to be produced from the cellulosic biomass.

After distilling ethanol and/or other compounds from the fermented hydrolysate, the remaining residue (also known as stillage) contains a high amount of chemical energy, approximately 100,000 mg/L as soluble chemical oxygen demand (sCOD). This amount of chemical energy, comparable in magnitude with the amount of chemical energy recovered as ethanol or other fuel compounds, is in the form of unreacted polysaccharides and sugars, proteins, and other complex plant materials that are not used by the alcohol-producing microorganisms.

In existing processes, lignocellulosic stillage is digested to produce biogas, which is a mixture of methane, carbondioxide, and other trace gases. Biogas is combusted in a combined heat and power generation process. A portion of the generated heat and power is used for operating facilities, and excess electricity can be sold. Alternatively, biogas can be converted to natural gas and injected into a natural gas pipeline. Given the high sCOD content of stillage, however, alternative uses for the stillage are possible and are needed to improve the economic and carbon sustainability of new biorefineries.

SUMMARY OF THE INVENTION

The present invention is directed to technology useful for converting the residues from lignocellulosic fuel (e.g., ethanol, isobutanol, etc.) production to valuable medium-chain fatty acids (such as hexanoic and octanoic acids) using an anaerobic microbiome.

The present invention provides microbiomes and methods for converting unreacted chemical components in stillage to valuable medium-chain fatty acids (such as hexanoic and octanoic acids) using a mixture of microbes (e.g., anaerobic microbiome). Operationally, a portion of the stillage stream can be separated and fed to a bioreactor containing the mixture of microbes, which transforms a fraction of the stillage to medium-chain fatty acids. The other fraction of the stillage can be sent on to the anaerobic digester to generate electricity (similar to existing biorefineries).

Exemplary conditions that lead to hexanoic and octanoic acid accumulation include a pH of about 5.5, a reactor temperature of about 35° C., a solids retention time (SRT) of about 6 days, and allowing the desired products to accumulate inside of the bioreactor. Drastic deviations from these parameters can lead to production of lactic acid and acetic acid instead of medium-chain fatty acids.

Hexanoic and octanoic acid are toxic to many microorganisms. In existing processes, these products are removed to prevent inhibition of the producing microorganisms. In preferred versions of the present invention, the acids are allowed to accumulate to saturation levels. This controls the microbiome and prevents the growth of undesired organisms that otherwise would decrease the yield of the acids.

Other processes that recover mixtures of short- and medium-chain fatty acids require the use of chemicals to inhibit the growth of methanogenic organisms. In preferred versions of the present invention, methanogens are eliminated from the microbial community by: (1) originating the community from an inoculum that does not contain methanogens, (2) operating the reactor at a pH that discourages the growth of methanogens, and (3) accumulating the medium-chain fatty acids to near saturation level or to levels that prevent the accumulation of such unwanted microbes.

The present invention provides an alternative use for a portion of the stillage that allows for the production of value-added chemicals while simultaneously allowing for biogas production to fulfill a biorefinery's energy requirements. Technoeconomic analysis shows that converting 16% of the sCOD in the conversion residue (to hexanoic acid (14.5%) and octanoic acid (1.5%), prior to anaerobic digestion) allows for the generation of a product stream (the sum of medium-chain fatty acids and biogas) having approximately 10 times more value than anaerobic digestion alone.

Accordingly, one aspect of the invention is directed to a microbiome composition. The microbiome composition preferably comprises a set of microbes. The microbes in the set preferably consist of members of Lachnospiraceae, Eubacteriaceae, Coriobacteriaceae, and Lactobacillaceae. The number of individual physical microbes in the set preferably constitute at least 60% of the total number of individual physical microbes in the microbiome composition.

The Lachnospiraceae in the set preferably include members of a genus selected from the group consisting of *Roseburia* and *Shuttleworthia*. In some versions, the Lachnospiraceae in the set comprise one or more microbes with a genome comprising a sequence at least 90% identical to at least 1 contiguous kilobase of any one or more of SEQ ID NOS:1-10. The members of Lachnospiraceae in the set preferably constitute at least 40% of the total number of individual microbes in the microbiome composition.

The Eubacteriaceae in the set preferably include members of *Pseudoramibacter*. In some versions, the Eubacteriaceae in the set comprise one or more microbes with a genome comprising a sequence at least 90% identical to at least 1 contiguous kilobase of any one or more of SEQ ID NOS: 11-39. The members of Eubacteriaceae in the set preferably constitute at least 2% of the total number of individual microbes in the microbiome composition.

The Coriobacteriaceae in the set preferably include members of a genus selected from the group consisting of *Olsenella* and *Atopobium*. In some versions, the Coriobacteriaceae in the set comprise one or more microbes with a genome comprising a sequence at least 90% identical to at least 1 contiguous kilobase of any one or more of SEQ ID NOS:40-420. The members of Coriobacteriaceae in the set preferably constitute at least 3% of the total number of individual microbes in the microbiome composition.

The Lactobacillaceae in the set preferably include members of *Lactobacillus*. In some versions, the Lactobacillaceae comprise one or more microbes with a genome comprising a sequence at least 90% identical to at least 1 contiguous kilobase of any one or more of SEQ ID NOS: 421-745. The members of Lactobacillaceae preferably constitute at least 7% of the total number of individual microbes in the microbiome composition.

In some versions, the number of individual microbes in the set constitutes at least 85% of the total number of individual microbes in the microbiome composition.

In some versions, less than 1% of the number of individual microbes in the microbiome composition are members of *Ethanoligenens, Desulfitobacterium, Clostridium, Propionibacterium, Bifidobacterium*, Ruminococcaceae, and Bifidobacteriaceae.

Another aspect of the invention is directed to a method of producing medium-chain fatty acids from an organic substrate. The method preferably comprises anaerobically fermenting the organic substrate for a time sufficient to produce medium-chain fatty acids from the organic substrate with a microbiome composition of the invention. The organic substrate preferably comprises a component selected from the group consisting of xylose, complex carbohydrates, and glycerol. The medium in some versions comprises a lignocellulosic ethanol fermentation residue (lignocellulosic stillage). The fermenting in some versions is performed at a pH of about 5 to about 6.5. In some versions, the fermenting is performed without the addition of ethanol. In some versions, the fermenting does not produce methane.

The objects and advantages of the invention will appear more fully from the following detailed description of the preferred embodiment of the invention made in conjunction with the accompanying drawings.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

(FIG. 2A) Compounds removed from stillage; (FIG. 2B) production of odd-chain propionic (C3), pentanoic (C5) and heptanoic (C7) acids; (FIG. 2C) production of even-chain acetic (C2), butyric (C4), hexanoic (C6), and octanoic (C8) acids; (FIG. 2D) removal of COD, percent conversion of carbohydrates, and percent conversions of COD to SCFA (C2 to C5) and MCFA (C6 to C8).

DETAILED DESCRIPTION OF THE INVENTION

Figure 1:
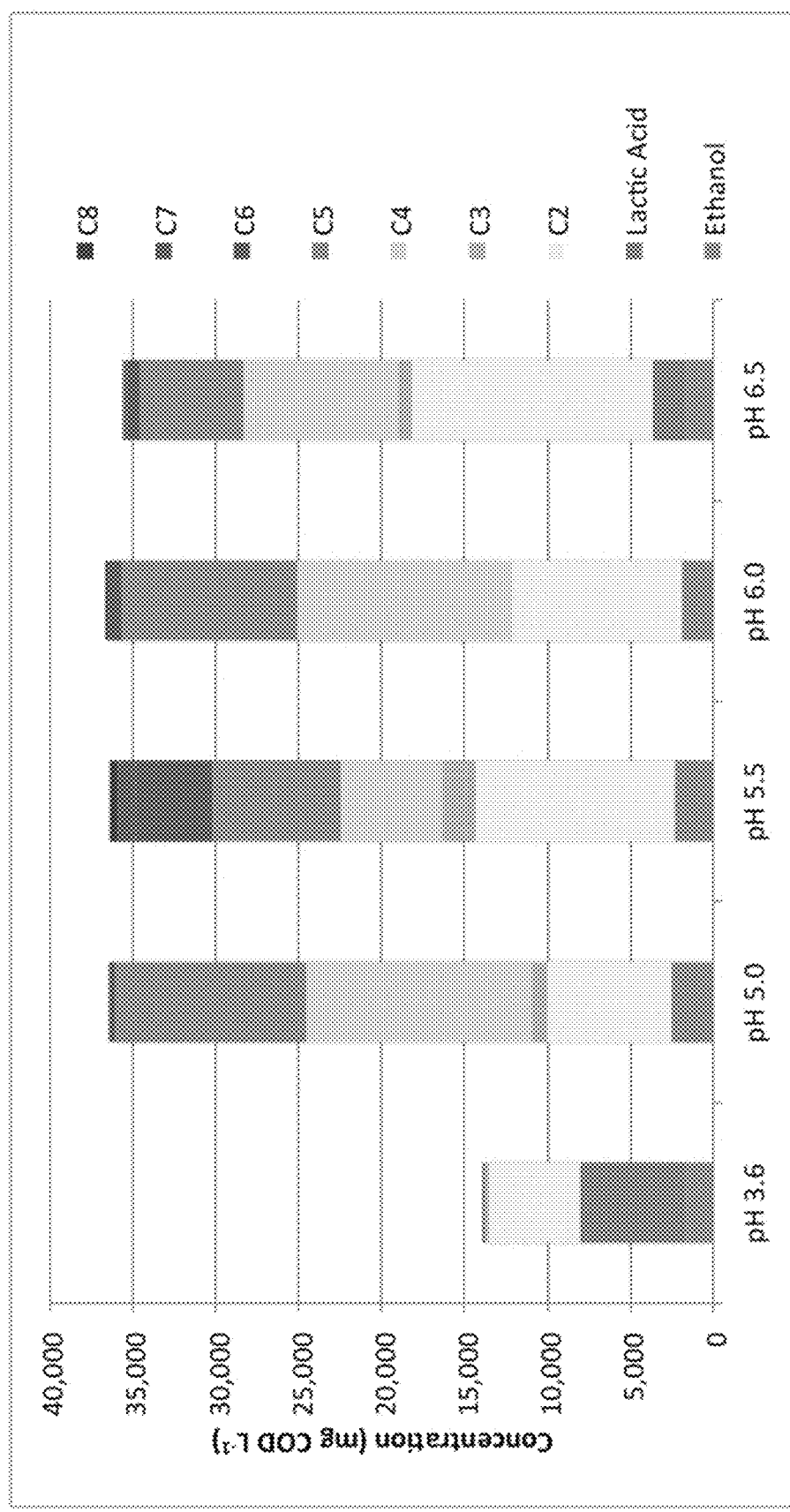
FIG. 1. Chemical analysis for mixed culture fermentations after 6 days under different pH conditions.

The invention is directed to microbiome compositions and methods of using same for producing medium-chain fatty acids from organic substrates.

The microbiome compositions of the invention comprise a set of microbes. The microbes in the set comprise several different types of microbes, and the number of individual physical microbes in the set comprises a certain proportion of the total number of individual physical microbes in the microbiome composition.

In some versions of the invention, the microbes in the set consist of members of Lachnospiraceae, Eubacteriaceae, Coriobacteriaceae, and Lactobacillaceae.

In some versions, the Lachnospiraceae in the set comprise, consist essentially of, or consist of members of a genus selected from the group consisting of *Roseburia* and *Shuttleworthia*.

In some versions, the Lachnospiraceae in the set comprise, consist essentially of, or consist of one or more microbes with a genome comprising a sequence at least 10%, at least 15%, at least 20%, at least 25%, at least 30%, at least 35%, at least 40%, at least 45%, at least 50%, least 55%, at least 60%, at least 65%, at least 70%, at least 75%, at least 80%, at least 85%, at least 90%, at least 95% or more identical to at least 0.5 contiguous kilobases, at least 1 contiguous kilobase, at least 2 contiguous kilobases, at least 3 contiguous kilobases, at least 4 contiguous kilobases, at least 5 contiguous kilobases, at least 6 contiguous kilobases, at least 7 contiguous kilobases, at least 8 contiguous kilobases, at least 9 contiguous kilobases, at least 10 contiguous kilobases, at least 11 contiguous kilobases, at least 12 contiguous kilobases, at least 13 contiguous kilobases, at least 14 contiguous kilobases, at least 15 contiguous kilobases, at least 20 contiguous kilobases, at least 25 contiguous kilobases, at least 30 contiguous kilobases, at least 40 contiguous kilobases, at least 50 contiguous kilobases, at least 60 contiguous kilobases, at least 70 contiguous kilobases, at least 80 contiguous kilobases, at least 90 contiguous kilobases, at least 100 contiguous kilobases, at least 110 contiguous kilobases, at least 120 contiguous kilobases, at least 130 contiguous kilobases, at least 140 contiguous kilobases, at least 150 contiguous kilobases, at least 200 contiguous kilobases, at least 300 contiguous kilobases, at least 400 contiguous kilobases, at least 500 contiguous kilobases, at least 600 contiguous kilobases, at least 700 contiguous kilobases, at least 800 contiguous kilobases, at least 900 contiguous kilobases, at least 1,000 contiguous kilobases of, or the entirety of, any one or more of SEQ ID NOS:1-10.

Each microbe corresponding to the LCO1 and LCO1.1 metagenome-assembled genomes provided in the examples is considered herein to be a member of the *Roseburia* and/or *Shuttleworthia* genera of Lachnospiraceae.

In some versions, the Eubacteriaceae in the set comprise, consist essentially of, or consist of members of *Pseudoramibacter*.

In some versions, the Eubacteriaceae in the set comprise, consist essentially of, or consist of one or more microbes with a genome comprising a sequence at least 10%, at least 15%, at least 20%, at least 25%, at least 30%, at least 35%, at least 40%, at least 45%, at least 50%, least 55%, at least 60%, at least 65%, at least 70%, at least 75%, at least 80%, at least 85%, at least 90%, at least 95% or more identical to at least 0.5 contiguous kilobases, at least 1 contiguous kilobase, at least 2 contiguous kilobases, at least 3 contiguous kilobases, at least 4 contiguous kilobases, at least 5 contiguous kilobases, at least 6 contiguous kilobases, at least 7 contiguous kilobases, at least 8 contiguous kilobases, at least 9 contiguous kilobases, at least 10 contiguous kilobases, at least 11 contiguous kilobases, at least 12 contiguous kilobases, at least 13 contiguous kilobases, at least 14 contiguous kilobases, at least 15 contiguous kilobases, at least 20 contiguous kilobases, at least 25 contiguous kilobases, at least 30 contiguous kilobases, at least 40 contiguous kilobases, at least 50 contiguous kilobases, at least 60 contiguous kilobases, at least 70 contiguous kilobases, at least 80 contiguous kilobases, at least 90 contiguous kilobases, at least 100 contiguous kilobases, at least 110 contiguous kilobases, at least 120 contiguous kilobases, at least 130 contiguous kilobases, at least 140 contiguous kilobases, at least 150 contiguous kilobases, at least 200 contiguous kilobases, at least 300 contiguous kilobases, at least 400 contiguous kilobases, at least 500 contiguous kilobases, at least 600 contiguous kilobases, at least 700 contiguous kilobases, at least 800 contiguous kilobases, at least 900 contiguous kilobases, at least 1,000 contiguous kilobases of, or the entirety of, any one or more of SEQ ID NOS:11-39.

Each microbe corresponding to the EUB1 and EUB1.1 metagenome-assembled genomes provided in the examples is considered herein to be a member of the *Pseudoramibacter* genus of Eubacteriaceae.

In some versions, the Coriobacteriaceae in the set comprise, consist essentially of, or consist of members of a genus selected from the group consisting of *Olsenella* and *Atopobium*.

In some versions, the Coriobacteriaceae in the set comprise, consist essentially of, or consist of one or more microbes with a genome comprising a sequence at least 10%, at least 15%, at least 20%, at least 25%, at least 30%, at least 35%, at least 40%, at least 45%, at least 50%, least 55%, at least 60%, at least 65%, at least 70%, at least 75%, at least 80%, at least 85%, at least 90%, at least 95% or more identical to at least 0.5 contiguous kilobases, at least 1 contiguous kilobase, at least 2 contiguous kilobases, at least 3 contiguous kilobases, at least 4 contiguous kilobases, at least 5 contiguous kilobases, at least 6 contiguous kilobases, at least 7 contiguous kilobases, at least 8 contiguous kilobases, at least 9 contiguous kilobases, at least 10 contiguous kilobases, at least 11 contiguous kilobases, at least 12 contiguous kilobases, at least 13 contiguous kilobases, at least 14 contiguous kilobases, at least 15 contiguous kilobases, at least 20 contiguous kilobases, at least 25 contiguous kilobases, at least 30 contiguous kilobases, at least 40 contiguous kilobases, at least 50 contiguous kilobases, at least 60 contiguous kilobases, at least 70 contiguous kilobases, at least 80 contiguous kilobases, at least 90 contiguous kilobases, at least 100 contiguous kilobases, at least 110 contiguous kilobases, at least 120 contiguous kilobases, at least 130 contiguous kilobases, at least 140 contiguous kilobases, at least 150 contiguous kilobases, at least 200 contiguous kilobases, at least 300 contiguous kilobases, at least 400 contiguous kilobases, at least 500 contiguous kilobases, at least 600 contiguous kilobases, at least 700 contiguous kilobases, at least 800 contiguous kilobases, at least 900 contiguous kilobases, at least 1,000 contiguous kilobases of, or the entirety of, any one or more of SEQ ID NOS:40-420.

Each microbe corresponding to the COR1, COR2, COR3, COR1.1, COR3.1, and COR4.1 metagenome-assembled genomes provided in the examples is considered herein to be a member of the *Olsenella* and/or *Atopobium* genera of Coriobacteriaceae.

In some versions, the Lactobacillaceae in the set comprise, consist essentially of, or consist of members of *Lactobacillus*.

In some versions, Lactobacillaceae in the set comprise, consist essentially of, or consist of one or more microbes with a genome comprising a sequence at least 10%, at least 15%, at least 20%, at least 25%, at least 30%, at least 35%, at least 40%, at least 45%, at least 50%, least 55%, at least 60%, at least 65%, at least 70%, at least 75%, at least 80%, at least 85%, at least 90%, at least 95% or more identical to at least 0.5 contiguous kilobases, at least 1 contiguous kilobase, at least 2 contiguous kilobases, at least 3 contiguous kilobases, at least 4 contiguous kilobases, at least 5 contiguous kilobases, at least 6 contiguous kilobases, at least 7 contiguous kilobases, at least 8 contiguous kilobases, at least 9 contiguous kilobases, at least 10 contiguous kilobases, at least 11 contiguous kilobases, at least 12 contiguous kilobases, at least 13 contiguous kilobases, at least 14 contiguous kilobases, at least 15 contiguous kilobases, at least 20 contiguous kilobases, at least 25 contiguous kilobases, at least 30 contiguous kilobases, at least 40 contiguous kilobases, at least 50 contiguous kilobases, at least 60 contiguous kilobases, at least 70 contiguous kilobases, at least 80 contiguous kilobases, at least 90 contiguous kilobases, at least 100 contiguous kilobases, at least 110 contiguous kilobases, at least 120 contiguous kilobases, at least 130 contiguous kilobases, at least 140 contiguous kilobases, at least 150 contiguous kilobases, at least 200 contiguous kilobases, at least 300 contiguous kilobases, at least 400 contiguous kilobases, at least 500 contiguous kilobases, at least 600 contiguous kilobases, at least 700 contiguous kilobases, at least 800 contiguous kilobases, at least 900 contiguous kilobases, at least 1,000 contiguous kilobases of, or the entirety of, any one or more of SEQ ID NOS:421-745.

Each microbe corresponding to the LAC1, LAC2, LAC3, LAC4, LAC5, LAC1.1, LAC2.1, LAC4.1, LAC5.1, LAC6.1, and LAC7.1 metagenome-assembled genomes provided in the examples is considered herein to be a member of the *Lactobacillus* genus of Lactobacillaceae.

The sequences corresponding to the SEQ ID NOs provided herein are the sequences of the metagenome-assembled genomes of exemplary microorganisms of the invention. A correspondence between the SEQ ID NOs and the metagenome-assembled genomes is shown in Table 1.

TABLE 1

Sequences of metagenome-assembled genomes (MAGs).

| MAG | NO. OF SEQUENCES | SEQ ID NOS |
|---|---|---|
| LCO1.1 | 10 | 1-10 |
| EUB1.1 | 29 | 11-39 |
| COR1.1 | 82 | 40-121 |
| COR2 | 157 | 122-278 |
| COR3.1 | 134 | 279-412 |
| COR4.1 | 8 | 413-420 |
| LAC1.1 | 9 | 421-429 |
| LAC2.1 | 37 | 430-466 |
| LAC3 | 175 | 467-641 |
| LAC4.1 | 53 | 642-694 |
| LAC5.1 | 6 | 695-700 |
| LAC6.1 | 12 | 701-712 |
| LAC7.1 | 33 | 713-745 |

The metagenome-assembled genome sequences for LCO1.1, EUB1.1, COR1.1, COR3.1, LAC1.1, LAC2.1, LAC4.1, and LAC5.1 encompass the metagenome-assembled genome sequences for LCO1, EUB1, COR1, COR3, LAC1, LAC2, LAC4, and LAC5 of the examples, respectively.

The terms "percent sequence identity" or "percent identical" are used interchangeably with respect to two polynucleotide sequences and refer to the percentage of bases that are identical in the two sequences when the sequences are optimally aligned. Thus, 80% amino acid sequence identity means that 80% of the amino acids in two optimally aligned polypeptide sequences are identical.

The term "identical," in the context of two polynucleotide sequences, means that the bases in the two sequences are the same when aligned for maximum correspondence, as measured using a sequence comparison or analysis algorithm such as those described herein. For example, if when properly aligned, the corresponding segments of two sequences have identical residues at 5 positions out of 10, it is said that the two sequences have a 50% identity or are 50% identical. Most bioinformatic programs report percent identity over aligned sequence regions, which are typically not the entire molecules. If an alignment is long enough and contains enough identical residues, an expectation value can be calculated, which indicates that the level of identity in the alignment is unlikely to occur by random chance.

The term "alignment" refers to a method of comparing two or more sequences for the purpose of determining their relationship to each other. Alignments are typically performed by computer programs that apply various algorithms, however it is also possible to perform an alignment by hand. Alignment programs typically iterate through potential alignments of sequences and score the alignments using substitution tables, employing a variety of strategies to reach a potential optimal alignment score. Commonly-used alignment algorithms include, but are not limited to, CLUSTALW, (see, Thompson J. D., Higgins D. G., Gibson T. J., CLUSTAL W: improving the sensitivity of progressive multiple sequence alignment through sequence weighting, position-specific gap penalties and weight matrix choice, Nucleic Acids Research 22: 4673-4680, 1994); CLUSTALV, (see, Larkin M. A., et al., CLUSTALW2, ClustalW and ClustalX version 2, Bioinformatics 23(21): 2947-2948, 2007); Jotun-Hein, Muscle et al., MUSCLE: a multiple sequence alignment method with reduced time and space complexity, BMC Bioinformatics 5: 113, 2004); Mafft, Kalign, ProbCons, and T-Coffee (see Notredame et al., T-Coffee: A novel method for multiple sequence alignments, Journal of Molecular Biology 302: 205-217, 2000). Exemplary programs that implement one or more of the above algorithms include, but are not limited to MegAlign from DNAStar (DNAStar, Inc. 3801 Regent St. Madison, Wis. 53705), MUSCLE, T-Coffee, CLUSTALX, CLUSTALV, JalView, Phylip, and Discovery Studio from Accelrys (Accelrys, Inc., 10188 Telesis Ct, Suite 100, San Diego, Calif. 92121). In a non-limiting example, MegAlign is used to implement the CLUSTALW alignment algorithm with the following parameters: Gap Penalty 10, Gap Length Penalty 0.20, Delay Divergent Seqs (30%) DNA Transition Weight 0.50, Protein Weight matrix Gonnet Series, DNA Weight Matrix IUB.

Sequence alignment and the determination of sequence identity in some versions can be performed as described in U.S. Pat. No. 9,708,630, which is incorporated herein by reference.

In some versions of the invention, the number of individual physical microbes in the set constitutes at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or more of the total number of individual physical microbes in the microbiome composition.

In some versions, the members of Lachnospiraceae in the set constitute at least 1%, at least 2%, at least 3%, at least 4%, at least 5%, at least 6%, at least 7%, at least 8%, at least 9%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or more of the total number of individual physical microbes in the microbiome composition. In some versions, the members of Lachnospiraceae in the set constitute up to 5%, up to 6%, up to 7%, up to 8%, up to 9%, up to 10%, up to 15%, up to 20%, up to 25%, up to 30%, up to 35%, up to 40%, up to 45%, up to 50%, up to 55%, up to 60%, up to 65%, up to 70%, up to 75%, up to 80%, up to 85%, up to 90%, up to 95% or more of the total number of individual physical microbes in the microbiome composition.

In some versions, the members of Eubacteriaceae in the set constitute at least 0.1%, at least 0.2%, at least 0.3%, at least 0.4%, at least 0.5%, at least 0.6%, at least 0.7%, at least 0.8%, at least 0.9%, at least 1%, at least 2%, at least 3%, at least 4%, at least 5%, at least 6%, at least 7%, at least 8%, at least 9%, at least 10%, at least 15%, at least 20%, at least 25%, at least 30%, at least 35%, at least 40%, at least 45%, at least 50% at least 55%, at least 60%, at least 65%, at least 70%, at least 75%, at least 80%, at least 85%, at least 90%, at least 95% or more of the total number of individual physical microbes in the microbiome composition. In some versions, the members of Eubacteriaceae in the set constitute up to 1%, up to 2%, up to 3%, up to 4%, up to 5%, up to 6%, up to 7%, up to 8%, up to 9%, up to 10%, up to 15%, up to 20%, up to 25%, up to 30%, up to 35%, up to 40%, up to 45%, up to 50%, up to 55%, up to 60%, up to 65%, up to 70%, up to 75%, up to 80%, up to 85%, up to 90%, up to 95% or more of the total number of individual physical microbes in the microbiome composition.

In some versions, the members of Coriobacteriaceae in the set constitute at least 0.1%, at least 0.2%, at least 0.3%, at least 0.4%, at least 0.5%, at least 0.6%, at least 0.7%, at least 0.8%, at least 0.9%, at least 1%, at least 2%, at least 3%, at least 4%, at least 5%, at least 6%, at least 7%, at least 8%, at least 9%, at least 10%, at least 15%, at least 20%, at least 25%, at least 30%, at least 35%, at least 40%, at least 45%, at least 50% at least 55%, at least 60%, at least 65%, at least 70%, at least 75%, at least 80%, at least 85%, at least 90%, at least 95% or more of the total number of individual physical microbes in the microbiome composition. In some versions, the members of Coriobacteriaceae in the set constitute up to 1%, up to 2%, up to 3%, up to 4%, up to 5%, up to 6%, up to 7%, up to 8%, up to 9%, up to 10%, up to 15%, up to 20%, up to 25%, up to 30%, up to 35%, up to 40%, up to 45%, up to 55%, up to 60%, up to 65%, up to 70%, up to 75%, up to 80%, up to 85%, up to 90%, up to 95% or more of the total number of individual physical microbes in the microbiome composition.

In some versions, the members of Lactobacillaceae in the set constitute at least 1%, at least 2%, at least 3%, at least 4%, at least 5%, at least 6%, at least 7%, at least 8%, at least 9%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% or more of the total number of individual physical microbes in the microbiome composition. In some versions, the members of Lactobacillaceae in the set constitute up to 5%, up to 6%, up to 7%, up to 8%, up to 9%, up to 10%, up to 15%, up to 20%, up to 25%, up to 30%, up to 35%, up to 40%, up to 45%, up to 50%, up to 55%, up to 60%, up to 65%, up to 70%, up to 75%, up to 80%, up to 85%, up to 90%, up to 95% or more of the total number of individual physical microbes in the microbiome composition.

In some versions, 0% or less than 0.1%, less than 0.2%, less than 0.3%, less than 0.4%, less than 0.5%, less than 0.6%, less than 0.7%, less than 0.8%, less than 0.9%, less than 1%, less than 2%, less than 3%, less than 4%, or less than 5%, of the number of individual physical microbes in the microbiome composition are methanogens.

In some versions, 0% or less than 0.1%, less than 0.2%, less than 0.3%, less than 0.4%, less than 0.5%, less than 0.6%, less than 0.7%, less than 0.8%, less than 0.9%, less than 1%, less than 2%, less than 3%, less than 4%, or less than 5%, of the number of individual physical microbes in the microbiome composition are members of *Ethanoligenens, Desulfitobacterium, Clostridium, Propionibacterium, Bifidobacterium*, Ruminococcaceae, and/or Bifidobacteriaceae.

The relative abundance of the number of individual physical microbes in the set with respect to the total number of individual physical microbes in the microbiome composition can be determined by quantitating operational taxonomic units (OTUs) or metagenome-assembled genomes (MAGs), as described in the following examples.

The methods of the invention comprise methods of producing medium-chain fatty acids from an organic substrate. Steps in the methods include anaerobically fermenting a microbiome composition as described herein in a medium comprising the organic substrate for a time sufficient to produce medium-chain fatty acids from the organic substrate. "Medium-chain fatty acids" refers to C6 to C12 fatty acids. "Organic substrate" refers to organic matter contributing to a positive chemical oxygen demand (COD) value.

In some versions, the organic feedstock comprises a component selected from the group consisting of xylose, complex carbohydrates, and glycerol. Other organic matter may also be present, including xylose, pyruvate, xylitol, succinate, lactate, formate, acetate, butyrate, hexanoate, octanoate, propionate (propanoate), valerate, heptanoate, 2-methyl propanoic acid, 3-methyl butanoic acid, 4-methyl pentanoic acid, ethanol, proteins, and aromatic compounds such as vanillamide, 4-hydroxybenzyl alcohol, syringamide, coumaryl amide, 4-hydroxybenzoic acid, feruloyl amide, vanillic acid, p-coumaric acid, ferulic acid, and benzoic acid.

The xylose may be present in the medium in an amount (measured as chemical oxygen demand (COD)) of at least 1%, at least 5%, at least 10%, at least 15%, at least 20%, at least 25%, at least 30%, at least 35%, at least 40%, at least 45%, at least 50% at least 55%, at least 60%, at least 65%, at least 70%, at least 75% or more and up to 5%, up to 10%, up to 15%, up to 20%, up to 25%, up to 30%, up to 35%, up to 40%, up to 45%, up to 55%, up to 60%, up to 65%, up to 70%, up to 75%, up to 80%, up to 85%, up to 90% or more of the COD in the medium.

The complex carbohydrates may be present in the medium in an amount (measured as chemical oxygen demand (COD)) of at least 1%, at least 5%, at least 10%, at least 15%, at least 20%, at least 25%, at least 30%, at least 35%, at least 40%, at least 45%, at least 50% at least 55%, at least 60%, at least 65%, at least 70%, at least 75% or more and up to 5%, up to 10%, up to 15%, up to 20%, up to 25%, up to 30%, up to 35%, up to 40%, up to 45%, up to 55%, up to 60%, up to 65%, up to 70%, up to 75%, up to 80%, up to 85%, up to 90% or more of the COD in the medium.

The glycerol may be present in the medium in an amount (measured as chemical oxygen demand (COD)) of at least 0.1%, at least 0.2%, at least 0.3%, at least 0.4%, at least 0.5%, at least 0.6%, at least 0.7%, at least 0.8%, at least 0.9%, at least 1%, at least 2%, at least 3%, at least 4%, at least 5%, at least 6%, at least 7%, at least 8%, at least 9%, at least 10%, at least 15%, at least 20%, at least 25%, at least 30%, at least 35%, at least 40%, at least 45%, at least 50% at least 55%, at least 60%, at least 65%, at least 70%, at least 75% or more and up to 5%, up to 10%, up to 15%, up to 20%, up to 25%, up to 30%, up to 35%, up to 40%, up to 45%, up to 55%, up to 60%, up to 65%, up to 70%, up to 75%, up to 80%, up to 85%, up to 90% or more of the COD in the medium.

In some versions, total soluble carbohydrates are present in the medium in an amount of from about 2,000 mg COD/L to about 50,000 mg COD/L. Amounts above and below these values are acceptable.

In some versions, total soluble proteins are present in the medium in an amount of from about 500 mg COD/L to about 5,000 mg COD/L. Amounts above and below these values are acceptable.

In some versions, vanillamide is present in the medium in an amount of from about 40 µg COD/L to about 4000 µg COD/L, such as about 300 µg COD/L to about 500 µg COD/L. Amounts above and below these values are acceptable.

In some versions, 4-hydroxybenzyl alcohol is present in the medium in an amount of from about 20 µg COD/L to about 2000 µg COD/L, such as about 90 µg COD/L to about 400 µg COD/L. Amounts above and below these values are acceptable.

In some versions, syringamide is present in the medium in an amount of from about 20 µg COD/L to about 2000 µg COD/L, such as about 90 µg COD/L to about 400 µg COD/L. Amounts above and below these values are acceptable.

In some versions, coumaryl amide is present in the medium in an amount of from about 500 µg COD/L to about 100,000 µg COD/L, such as about 1000 µg COD/L to about 20,000 µg COD/L. Amounts above and below these values are acceptable.

In some versions, 4-hydroxybenzoic acid is present in the medium in an amount of from about 30 µg COD/L to about 3000 µg COD/L, such as about 200 µg COD/L to about 400 µg COD/L. Amounts above and below these values are acceptable.

In some versions, feryloyl amide is present in the medium in an amount of from about 300 µg COD/L to about 100,000 µg COD/L, such as about 1000 µg COD/L to about 15,000 µg COD/L. Amounts above and below these values are acceptable.

In some versions, vanillic acid is present in the medium in an amount of from about 30 µg COD/L to about 3,000 µg COD/L, such as about 100 µg COD/L to about 600 µg COD/L. Amounts above and below these values are acceptable.

In some versions, p-coumaric acid is present in the medium in an amount of from about 10 µg COD/L to about 30,000 µg COD/L, such as about 500 µg COD/L to about 5,000 µg COD/L. Amounts above and below these values are acceptable.

In some versions, ferulic acid is present in the medium in an amount of from about 10 µg COD/L to about 2,500 µg COD/L, such as about 50 µg COD/L to about 500 µg COD/L. Amounts above and below these values are acceptable.

In some versions, benzoic acid is present in the medium in an amount of from about 100 µg COD/L to about 20,000 µg COD/L, such as about 500 µg COD/L to about 3,000 µg COD/L. Amounts above and below these values are acceptable.

In some versions, glucose is absent from the medium or is present in the medium in an amount (measured as chemical oxygen demand (COD)) less than 30%, less than 25%, less than 20%, less than 15%, less than 10%, less than 5%, less than 2.5%, less than 1%, less than 0.5%, less than 0.1%, or less than 0.01% of the COD in the medium.

In some versions, the medium comprises or is a lignocellulosic stillage. The lignocellulosic stillage may comprise stillage resulting from distillation of ethanol or other components from fermented lignocellulosic biomass hydrolysate.

In some versions, the fermenting is performed at a pH of about 5 to about 6, such as a pH of about 5.5.

In some versions, the fermenting is performed at a temperature from about 10° C. to about 60° C., such as from about 15° C. to about 55° C., from about 20° C. to about 50° C., from about 25° C. to about 45° C., from about 30° C. to about 40° C., or about 35° C.

In some versions, the fermenting is performed at a solids retention time (SRT) of from about 1 day to about 12 days, such as from about 2 days to about 11 days, from about 3 days to about 10 days, from about 3 days to about 9 days, from about 4 days to about 8 days, from about 5 days to about 7 days, or about 6 days.

In some versions, the fermenting is performed without the addition of ethanol. In some versions, the fermenting does not produce methane. In some versions, the medium-chain fatty acids are not removed during the fermenting and are accumulated in the medium to near saturating levels.

The elements and method steps described herein can be used in any combination whether explicitly described or not.

All combinations of method steps as used herein can be performed in any order, unless otherwise specified or clearly implied to the contrary by the context in which the referenced combination is made.

As used herein, the singular forms "a," "an," and "the" include plural referents unless the content clearly dictates otherwise.

Numerical ranges as used herein are intended to include every number and subset of numbers contained within that range, whether specifically disclosed or not. Further, these numerical ranges should be construed as providing support for a claim directed to any number or subset of numbers in that range. For example, a disclosure of from 1 to 10 should be construed as supporting a range of from 2 to 8, from 3 to 7, from 5 to 6, from 1 to 9, from 3.6 to 4.6, from 3.5 to 9.9, and so forth.

All patents, patent publications, and peer-reviewed publications (i.e., "references") cited herein are expressly incorporated by reference to the same extent as if each individual reference were specifically and individually indicated as being incorporated by reference. In case of conflict between the present disclosure and the incorporated references, the present disclosure controls.

U.S. Application 62/846,378, filed May 10, 2019; U.S. Application 62/697,249, filed Jul. 12, 2018; U.S. Application 62/696,677, filed Jul. 11, 2018; Scarborough and Lynch et al. 2018 (carborough M J, Lynch G, Dickson M, McGee M, Donohue T J, Noguera D R. Increasing the economic value of lignocellulosic stillage through medium-chain fatty acid production. *Biotechnol Biofuels.* 2018 Jul. 19; 11:200. doi: 10.1186/s13068-018-1193-x. eCollection 2018.); and Scarborough and Lawson et al. 2018 (Scarborough M J, Lawson C E, Hamilton J J, Donohue T J, Noguera D R. Metatranscriptomic and Thermodynamic Insights into Medium-Chain Fatty Acid Production Using an Anaerobic Microbiome. mSystems. 2018 Nov. 20; 3(6). pii: e00221-18. doi: 10.1128/mSystems.00221-18. eCollection 2018 November-December) are specifically incorporated by reference in their entireties.

It is understood that the invention is not confined to the particular construction and arrangement of parts herein illustrated and described, but embraces such modified forms thereof as come within the scope of the claims.

EXAMPLES

Increasing the Economic Value of Lignocellulosic Stillage Through Medium-Chain Fatty Acid Production

Summary

Lignocellulosic biomass is seen as an abundant renewable source of liquid fuels and chemicals that are currently derived from petroleum. When lignocellulosic biomass is used for ethanol production, the resulting liquid residue (stillage) contains large amounts of organic material that could be further transformed into recoverable bioproducts, thus enhancing the economics of the biorefinery.

Here we test the hypothesis that a bacterial community could transform the organics in stillage into valuable bioproducts. We demonstrate the ability of this microbiome to convert stillage organics into medium-chain fatty acids (MCFAs), identify the predominant community members, and perform a technoeconomic analysis of recovering MCFAs as a co-product of ethanol production. Steady-state operation of a stillage-fed bioreactor showed that 18% of the organic matter in stillage was converted to MCFAs. Xylose and complex carbohydrates were the primary substrates transformed. During the MCFA production period, the five major genera represented more than 95% of the community, including *Lactobacillus, Roseburia, Atopobium, Olsenella,* and *Pseudoramibacter.* To assess the potential benefits of producing MCFA from stillage, we modeled the economics of ethanol and MCFA co-production, at MCFA productivities observed during reactor operation.

The analysis predicts that production of MCFA, ethanol, and electricity could reduce the minimum ethanol selling price from $2.15 gal$^{-1}$ to $1.76 gal$^{-1}$ ($2.68 gal$^{-1}$ gasoline equivalents) when compared to a lignocellulosic biorefinery that produces only ethanol and electricity.

BACKGROUND

The production of food, fuels, pharmaceuticals and many chemicals depends on microbial fermentations. When one considers the sum of microbial biomass, excreted metabolic end-products, and non-metabolized nutrients, there is considerable residual organic matter in the liquid residue (stillage) remaining after distillation. One common co-product of ethanol production is biogas, which is generated by anaerobic digestion of stillage. Combusting lignin and biogas creates heat and power used to operate the biorefinery, and any excess electricity can be sold as a co-product.[1] In a techno-economic analysis (TEA) conducted by the National Renewable Energy Laboratory (NREL), a 61 million gallon per year lignocellulosic ethanol biorefinery produced fuel at a price of $2.15 gal$^{-1}$ ($3.27 gal$^{-1}$ gasoline-equivalents) and electricity worth $6.57 million yr$^{-1}$.[1,2]

The Renewable Fuel Standards (RFS), created by the Energy Policy Act of 2005 and expanded by the Energy Independence and Security Act of 2007, set production goals for many renewable energy sources, including lignocellulosic-derived ethanol.[3,4] While several lignocellulosic biorefineries have opened, total lignocellulosic ethanol production in the United States remains short of original targets. The high costs of obtaining biomass and producing enzymes to hydrolyze biomass are cited as barriers to achieving an acceptable level of profitability for lignocellulosic biorefineries.[2]

One way to potentially improve the economics of lignocellulosic fuel production is to produce valuable co-products, such as medium-chain fatty acids (MCFAs), from stillage. MCFAs are monocarboxylic acids containing six to twelve carbon atoms and are utilized for the production of rubbers, dyes, pharmaceuticals, and antimicrobials.[5] They can also be used as precursors for chemicals currently derived from fossil fuels.[6] In addition to being valuable, MCFAs also have decreased solubility compared to short-chain fatty acids (SCFAs), which should allow for easier extraction from an aqueous medium.

In this example, we investigated the valorization of switchgrass-derived stillage to MCFAs. Switchgrass has been identified as a promising feedstock for biofuel production that can be cultivated on marginal lands.[7] In this example, we tested the ability of using mixed culture anaerobic fermentation, as in the so-called carboxylate platform,[8,9] to valorize stillage to MCFAs. Here total MCFA is the sum of hexanoate and octanoate since it is still largely unknown how to direct metabolism to production of only one MCFA. In several past studies, ethanol has been used as an electron donor to drive MCFA production from either added acetate or acetate produced by the community as a fermentation intermediate.[10-13] Conversion of lactic acid to MCFAs has also been investigated.[14,15] Recently, a pure culture of *Megasphaera elsdenii* was used to convert glucose in lignocellulosic hydrolysate to MCFAs.[16] Stillage from corn-derived ethanol has also been used to produce MCFAs.[17] Andersen et. al used a mixture of lignocellulosic stillage and dilute ethanol to produce MCFAs at titers greater than their solubility concentrations.[18] However, MCFA production from industrial streams having minimal amounts of glucose or ethanol remains largely unexplored. In addition, there is no published TEA investigating production of MCFAs from stillage.

While past studies have investigated MCFA production from lignocellulosic materials, none have evaluated production of ethanol followed by MCFA production from the resulting stillage in a biorefinery. Thus, the objectives of this example are to (1) test the hypothesis that a stillage-fed microbial community can sustain production of MCFAs; (2) investigate the stability of the microbiome and potential roles of abundant community members in the MCFA-producing reactor; and (3) evaluate the technoeconomics of producing MCFAs from ethanol stillage. To achieve the third objective, we modeled a modified lignocellulosic biorefinery producing MCFA as a co-product to ethanol and electricity (see Scarborough and Lynch et al. 2018, which is incorporated herein by reference, at FIG. 2.1). After accounting for the amount of organic matter in stillage that is directed to MCFA production, the reduction in overall biogas and electricity production, and the increased capital and operational costs associated with MCFA production, our data predict that the potential revenue from producing MCFAs at levels observed in this example would have a positive impact on the economics of lignocellulosic biorefining.

Methods

Switchgrass stillage production. Shawnee switchgrass, grown in 2010 at the Arlington Agricultural Research Center in Wisconsin, USA, was used as the biomass source for this example. Switchgrass was treated using ammonia-fiber expansion (AFEX), enzymatically hydrolyzed, and fermented, as described previously.[19] During processing, hydrolysate is filtered to remove insoluble components, including insoluble lignin. Past work has demonstrated that switchgrass hydrolysates generated with this process contain sufficient nutrients and trace elements to sustain microbial growth[19]. Ethanol fermentations of switchgrass hydrolysate were performed with *Saccharomyces cerevisiae* Y128, an engineered yeast strain with improved xylose utilization and lignotoxin tolerance.[20] Ethanol was removed post-fermentation using a glass distillation apparatus consisting of a 1 L boiling flask, heating mantle, distillation column, and condenser. During distillation, the fermented hydrolysate was heated to approximately 100° C. to maintain a distillation neck temperature of 78° C. Therefore, the distillation process not only removed ethanol but also sterilized the stillage. The stillage remaining after distillation was stored at 4° C. until fed to the bioreactor.

Mixed culture fermentation bioreactor. A mixed culture fermentation bioreactor was inoculated with sludge from an acid-phase digester at the Nine Springs Wastewater Treatment Plant in Madison, Wis. The bench-scale reactor consisted of a vessel with a 150 mL working volume that was continuously stirred at 150 rpm with a magnetic stir bar and maintained at 35° C. using a water bath. The reactor was sealed with a rubber stopper and vented so that any gas produced was released to the atmosphere. For all experiments, the solids retention time (SRT) is equal to the hydraulic retention time.

Initially, we conducted short-term (6 day) experiments to assess if microbial growth could be sustained in stillage and to determine the primary fermentation end products under different pH conditions. For these initial experiments, the pH was either uncontrolled or controlled at set-points of 5.0, 5.5, 6.0, or 6.5 with 5M KOH. A hydraulic retention time of two days was utilized for these initial experiments by pumping 75 mL day$^{-1}$ (3.13 mL hr$^{-1}$) both into and out of the reactor. A shorter SRT was utilized to allow for fast turn-over and stabilization of the microbial community. While this short SRT resulted in production of MCFA, we elected to increase the SRT for a long-term experiment in an attempt to improve overall MCFA titers. For the long-term (252 day) sustained experiment, the pH was controlled at a set-point of 5.50 with 5M KOH and the SRT was controlled at 6 days by pumping 25 mL day$^{-1}$ (1.04 mL hr$^{-1}$) into and out of the reactor.

Chemical analyses. We collected samples from the reactor and stillage for chemical analyses. All samples were filtered using 0.22 μm syringe filters (ThermoFisher Scientific SLGP033RS, Waltham, Mass., USA). Soluble chemical oxygen demand (COD) analysis was performed using High Range COD Digestion Vials (Hach 2125915, Loveland, Colo., USA) per standard methods.[21] Soluble carbohydrates were measured with the anthrone method.[22] Total soluble proteins were measured with the bicinchoninic acid assay using the Pierce™ BCA Assay Kit (ThermoFisher Scientific 23225, Waltham, Mass., USA) and the Compat-Able™ Protein Assay Preparation Reagent Set (ThermoFisher Scientific 23215, Waltham, Mass., USA).[23]

Glucose, xylose, acetic acid, formic acid, lactic acid, succinic acid, pyruvic acid, glycerol and xylitol were analyzed with high performance liquid chromatography (HPLC) and quantified with an Agilent 1260 Infinity refractive index detector (Agilent Technologies, Inc. Palo Alto, Calif.) using a 300×7.8 mm Bio-Rad Aminex HPX-87H column with Cation-H guard (BioRad, Inc., Hercules, Calif.). A column temperature of 50° C. was used, and 0.02 N $H_2SO_4$ was used for the mobile phase with a flow rate of 0.50 min$^{-1}$.

Acetamide, ethanol, n-propionic acid, n-butyric acid, iso-butyric acid, n-pentanoic acid, iso-pentanoic acid, n-hexanoic acid, iso-hexanoic acid, n-heptanoic acid, and n-octanoic acid were analyzed with tandem gas chromatography-mass spectrometry (GC-MS). An Agilent 7890A GC system (Agilent Technologies, Inc. Palo Alto, Calif.) with a 0.25 mm Restek Stabilwax DA 30 column (Restek 11008, Belefonte, Pa.) was used. The GC-MS system was equipped with a Gerstel MPS2 (Gerstel, Inc. Baltimore, Md.) auto sampler and a solid-phase micro-extraction gray hub fiber assembly (Supelco, Bellefonte, Pa.). The MS detector was a Pegasus 4D TOF-MS (Leco Corp., Saint Joseph, Mich.). Stable isotope labeled internal standards were used for each of the analytes measured with GC-MS.

Aromatic compounds were analyzed with liquid chromatography-tandem mass spectrophotometry (LC-MS/MS). For LC-MS/MS analyses. An Ultimate HPG-3400RS pump and WPS-3000RS auto sampler (Thermo Fisher) were mated to an ACQUITY UPLC HSS T3 reversed phase column (2.1×150 mm, 1.8 μm particle diameter, Waters Corporation) with a guard cartridge. Gradient elution was performed at 0.400 mL/min. The LC system was coupled to a TSQ Quantiva Triple Quadrupole mass spectrometer (Thermo Scientific). The Ion Transfer Tub Temp was kept at 350° C. as was the vaporizer temperature. Analytes measured with LC-MS/MS included vanillamide, 4-hydroxybenzyl alcohol, syringamide, coumaryl amide, 4-hydroxybenzoic acid, feruloyl amide, vanillic acid, p-coumaric acid, ferulic acid, and benzoic acid. Detailed chemical analysis data is provided in Scarborough and Lynch et al. 2018, which is incorporated herein by reference, at Additional File 1.

Microbial community analysis. Amplification and sequencing of the V3-V4 region of the 16S rRNA gene was performed to classify and determine the relative abundance of bacteria in the reactor. For the initial short term (six day) experiments, biomass samples were collected from the inoculum acid digester sludge and from the reactor every two days for six days. For the long-term (252 day) experiment, biomass samples were collected from the inoculum acid digester sludge, and from the reactor at Days 2, 4, and 6, and then every six days for the duration of the experiment. Biomass was harvested by centrifuging samples at a relative centrifugal force of 10,000 g for 10 minutes and decanting supernatant. Biomass was then stored at −80° C. until DNA extraction was performed.

DNA was extracted using a Power Soil® DNA Isolation Kit (MoBIO Laboratories 12888, Carlsbad, Calif.). The purity of extracted DNA was analyzed using a NanoDrop spectrophotometer (Thermo Fisher Scientific ND-2000, Waltham, Mass.), and DNA was quantified using a Qubit 3.0 (Thermo Fisher Scientific Q33126, Waltham, Mass.). The V3 and V4 regions of the 16S rRNA gene were amplified using the primer set S-D-Bact-0341-b-S-17/S-D-Bact-1061-a-A-17 as described by Klindworth et al.[24] Amplicons were sequenced on an Illumina MiSeq sequencer (Illumina, San Diego, Calif.) using pair-end 250 base pair kits at the University of Wisconsin-Madison Biotechnology Center.

Paired-end reads were merged with Fast Length Adjustment of Short Reads (FLASH) using default parameters.[25] The merged reads were analyzed with the Qiime pipeline, utilizing the split libraries command to remove low quality sequences.[26] Sequences were clustered into operational taxonomic units (OTUs) using uclust.[27] Sequences were aligned with PyNast, and chimera detection was performed with ChimeraSlayer.[28,29] Singleton OTUs were removed, and the samples were rarefied to an equal depth, with 130,000 sequences retained for the long-term (252 day) reactor experiment and 45,000 sequences retained for the short-term (6 day) reactor experiments. A representative sequence for each OTU was taxonomically classified using the SILVA database.[30] Tables of OTUs with taxonomic assignments are provided in Scarborough and Lynch et al. 2018, which is incorporated herein by reference, at Additional File 2. The Phyloseq package version 1.14.0 was used for data visualization, and heat maps were generated with the superheat package.[31,32] To construct phylogenetic trees, multiple sequence alignments were performed using MUSCLE, and maximum likelihood phylogenetic trees were constructed with RAxML using the GTRGAMMA method with 1,000 bootstraps.[33,34]

Statistical analysis of microbial community data was performed using multivariate repeated measures ANOVA with the nlme package in R to generate generalized least squares models in which time was correlated to all predictor variables using the corAR1 structure.[35] Redundancy analysis was also performed using the rda command in the vegan package.[36] Environmental factors were iteratively selected until all were statistically significant (p<0.1) based on 999 model permutations.

Technoeconomic analysis. To estimate the economic impact of producing MCFA from ethanol stillage, a TEA was performed based on information provided in the National Renewable Energy Laboratory (NREL) TEA for a 61 million gallon per year lignocellulosic ethanol facility.[2] We assumed that switchgrass has a similar feedstock cost to corn stover ($58.50 U.S. dry ton$^{-1}$), which is within the range of costs assumed for switchgrass feedstock in other studies.[37,38] Instead of assuming all stillage undergoes anaerobic digestion, we assumed that a portion of the organic matter was converted to organic acids using data obtained in this example, then simulated the extraction of hexanoic and octanoic acids with ASPEN (AspenTech, Bedford, Mass.) to select an organic solvent and determine process separation efficiencies, heating demands, and sizes for reactors and equipment. We selected 2-octanol as the solvent for liquid-liquid extraction due to the high extraction efficiencies predicted with ASPEN. We assumed that the organic matter in the aqueous phase that remains after extracting the MCFA was fed to the anaerobic digester to produce biogas. The specific methane yield (g methane produced per g COD consumed) and biosolids yield (g biomass produced per g COD consumed) were assumed to be the same as in the NREL TEA.[2] The efficiency of combined heat and power generation by combusting biogas, lignin, and biosolids was also assumed to have the same efficiency as the NREL TEA, with a total of 21% of the energy in the combusted material converted to usable heat and power.[2]

The costs for additional reactors and distillation columns were estimated by scaling related costs presented in the NREL TEA.[2] Costs for the liquid-liquid extraction were determined based on the volumetric flow rate and equations available in Seider et al.[39] The KOH usage was calculated based on experimental reactor data. The 2-octanol demand (2-octanol lost to the aqueous phase) was based on modeling the liquid-liquid extraction with ASPEN. Prices for hexanoic acid, octanoic acid and 2-octanol were obtained from Zauba for imported quantities greater than 1,000 kg in 2016 (see Scarborough and Lynch et al. 2018, which is incorporated herein by reference, at Additional File 3).[40] For consistency with past reporting, all costs and profits are reported in 2007 United States Dollars (USD). To convert from 2016 to 2007 USD, cost indices from the St. Louis Federal Reserve were used.[41] Electricity prices from the NREL TEA were used.[2] A 30-year cash flow was calculated using the cash-flow calculation tool available with the NREL TEA,[42] and the minimum ethanol selling price (MESP) was determined by setting the net present value to zero based on a target 10% internal rate of return, consistent with the NREL TEA.[2] Detailed information related to the TEA is provided in Scarborough and Lynch et al. 2018, which is incorporated herein by reference, at Additional File 3.

COD Calculations. Unless otherwise noted, we report concentrations as mass of COD per unit volume. This allows for the direct comparison of relative reducing equivalents contained within each of the compounds consumed and created. The theoretical COD of each compound, or the theoretical amount of oxygen needed to fully oxidize the compound, was used to convert the measured mass units to COD. Protein was assumed to have 1.5 g COD per g of protein, which is consistent with the COD of albumin. A COD of 1.06 g COD per g carbohydrate was used to convert total carbohydrates measured with the anthrone method to COD. This value is consistent with the COD of glucose and xylose. The "Unknown COD" represents the measured COD minus the COD of known components. Where provided, error bars represent standard deviation of technical replicates. The "COD Removed" is calculated as the percentage of COD removed at each time point. "Conversion of Carbohydrates" is calculated based on the difference between total carbohydrates in the switchgrass stillage and the reactor sample for each time point. "Conversion to SCFA" is based on the amount of COD converted to carboxylic acids containing two to five carbons (short-chain fatty acids; SCFA), and "Conversion to MCFA" is based on the COD converted to monocarboxylic acids containing six to eight carbons.

Results

Chemical Analyses of Switchgrass Stillage.

In a lignocellulosic biorefinery, an ethanologenic microorganism ferments biomass sugars to ethanol and the ethanol is removed via distillation, producing an organic-rich stillage fraction. The concentrations of compounds remaining in stillage are therefore dependent on the efficiency of the upstream fermentation. For this example, two batches of stillage (Table 2) were produced from switchgrass hydrolysate fermented with *S. cerevisiae* Y128, a strain with improved utilization of xylose.[20] The starting glucose and xylose concentrations in the hydrolysate prior to fermentation were 56,000±300 mg COD $L^{-1}$ and 36,000±200 mg COD $L^{-1}$, respectively. After the fermentation, the ethanol concentration was 51,000±2,900 mg COD $L^{-1}$ with nearly 100% of the glucose and 47% of the xylose consumed. Glycerol, a common byproduct of yeast fermentation,[43] reached a final concentration of 2,500±100 mg COD $L^{-1}$. Acetic and formic acids decreased slightly during the ethanologenic fermentation, and only a small amount of lactic acid (30±1 mg COD $L^{-1}$) was detected (see Scarborough and Lynch et al. 2018, which is incorporated herein by reference, at Additional File 1). The total COD of the two batches of fermented hydrolysate was 160,000±1,500 mg COD $L^{-1}$ (Scarborough and Lynch et al. 2018, which is incorporated herein by reference, Additional File 1).

TABLE 2

Major chemical components contained within hydrolysate and fermented hydrolysate after fermentation with *Saccharomyces cerevisiae* Y128.

|  | Hydrolysate (mg COD $L^{-1}$) | Fermented Hydrolysate (mg COD $L^{-1}$) |
| --- | --- | --- |
| Glucose | 56,000 ± 300 | 44 ± 1.7 |
| Xylose | 36,000 ± 230 | 19,000 ± 4,500 |
| Glycerol | 310 ± 0.86 | 2,500 ± 130 |
| Acetic acid | 2,065 ± 30 | 1,600 ± 68 |
| Ethanol | <100 | 51,000 ± 2,900 |

The COD remaining in stillage, after distilling ethanol from the fermented hydrolysate, was approximately 60% of the COD in the fermented hydrolysate. The major chemical energy components in the stillage included xylose, acetamide (derived from acetate during ammonia-based pretreatment of switchgrass), glycerol, and acetic acid (Table 3). Residual glucose was minimal (Table 2), and the ethanol that was not removed in distillation (Table 3) represented less than 3% of the ethanol present in the original fermentation broth (Table 2). Carbohydrates, excluding xylose, accounted for 18% of the COD, while proteins accounted for only 2.2% of the COD in the stillage. In addition, a large portion of the COD is comprised of components with undetermined chemical identity. This "Unknown COD" likely contains a variety of compounds that are either produced during biomass deconstruction, originate from the switchgrass, or are produced during the yeast ethanol fermentation.

TABLE 3

Composition of major organic matter components and aromatic compounds in the two batches of stillage fed to the mixed culture fermentation bioreactor. Major stillage components are reported in mg COD $L^{-1}$ whereas aromatic compounds are reported in µg COD $L^{-1}$.

|  | Stillage Batch 1 | Stillage Batch 2 |
| --- | --- | --- |
| Major Stillage Components | mg COD $L^{-1}$ | |
| Soluble COD | 95,400 ± 432 | 95,800 ± 982 |
| Unknown COD | 38,300 ± 3,250 | 42,100 ± 3,190 |
| Xylose | 20,800 ± 148 | 20,900 ± 168 |
| Other Carbohydrates | 19,300 ± 2,310 | 15,500 ± 2,230 |
| Acetamide | 4,030 ± 270 | 4,200 ± 340 |
| Glycerol | 3,900 ± 32.1 | 3,920 ± 36.3 |
| Acetic acid | 2,550 ± 21.1 | 2,580 ± 20.5 |
| Proteins | 2,200 ± 145 | 1,910 ± 162 |
| Ethanol | 1,220 ± 305 | 1,590 ± 161 |
| Aromatic Compounds | µg COD $L^{-1}$ | |
| Coumaroyl amide | 13,000 ± 250 | 5,400 ± 200 |
| Feruloyl amide | 12,000 ± 130 | 3,200 ± 83 |
| p-Coumaric acid | 3,500 ± 43 | 1,100 ± 34 |
| Benzoic acid | 1,700 ± 102 | 2,000 ± 22 |
| Vanillamide | 290 ± 0.95 | 230 ± 0.50 |
| 4-hydroxybenzoic acid | 380 ± 15 | 320 ± 0.46 |
| Vanillic acid | 320 ± 0.09 | 370 ± 4.6 |
| Ferulic acid | 250 ± 13 | 90 ± 3.2 |
| 4-hydroxybenzyl alcohol | 240 ± 3.7 | 110 ± 1.9 |
| Syringamide | 230 ± 0.06 | 138 ± 2.3 |

While major COD components between the two batches of stillage were similar, the aromatic compounds, including known lignotoxins,[19,44] varied between the stillage batches Table 3. Feruloyl amide, p-coumaroyl amide, and coumaric acid were higher in Batch 1 than in Batch 2. Only benzoic acid and vanillic acid were higher in Batch 2. From a reducing-equivalents standpoint, these aromatic compounds account for less than 0.05% of the COD in stillage, but these concentrations are within the range of lignotoxins shown to inhibit fermentation activity by pure cultures of ethanologenic organisms.[20]

Stillage Fermentation Under Different pH Conditions.

Due to the relatively low concentration of six carbon sugars, the complexity of remaining organic materials, and the potential toxicity of aromatic compounds, bacterial growth on stillage derived from AFEX-treated hydrolysate was expected to be challenging. We therefore conducted short-term experiments to determine if a microbial community could metabolize organic materials remaining in stillage. Using inoculum from an acid phase anaerobic digester, we fermented stillage at different pH conditions (uncontrolled, 5.0, 5.5, 6.0, and 6.5) for 6 days using an SRT of 2 days and analyzed both the extracellular end products and the microbial community. Acid phase digester sludge was used as inoculum because the microbial consortia was expected to contain a variety of fermenting organisms and not expected to contain high levels of methanogens.[45,46]

Conditions in which the pH was uncontrolled led to the pH stabilizing at 3.6 and accumulation of lactic and acetic acids (FIG. 1). SCFA and MCFA accumulated in the reactor when the pH was maintained between 5.0 and 6.5. Maintaining a pH of 5.5 resulted in the highest accumulation of MCFA (Scarborough and Lynch et al. 2018, which is incorporated herein by reference, Additional File 4). Analysis of the microbial community by 16S rRNA gene sequencing showed variations in composition with pH (see Scarborough and Lynch et al. 2018, which is incorporated herein by reference, at FIG. 2.S2), with OTUs associated with the genera *Lactobacillus* (89.9%) and *Acetobacter* (9.9%) becoming the most abundant when the pH was uncontrolled. *Lactobacillus* was present in the reactors at all pH conditions. At pH 5.0, Megasphaera was enriched (46.3%), while at pH 5.5, OTUs related to *Pseudoramibacter* (14.3%) and *Olsenella* (14.1%) were abundant. At pH 6.0, Mitsuokella (20.8%), Acetitomaculum (17.0%), and Megasphaera (14.2%) were all abundant. When the reactor was maintained at pH 6.5, more OTUs related to the Bacteriodetes phylum were abundant, including OTUs related to the genera *Prevotella* (12.3%) and *Bacteroides* (40.8%).

These results demonstrated that a community derived from an acid digester sludge inoculum could ferment stillage to carboxylic acids, including MCFAs, under a variety of pH conditions. Further, organisms identified in the stillage-fed reactors included members of the Clostridia (Megasphaera, Pseudoramibacter) that have previously been associated with MCFA production.[5,10,13,15,18,47] Members of Clostridia have been enriched in other MCFA-producing bioreactors under similar pH conditions.[12,18,48] In agreement with our observation of *Lactobacillus* at all pH conditions, *Lactobacillus* is a common genera in MCFA producing microbiomes.[10,15,17,18,47] In total, the fermentation product (FIG. 1) and community (see Scarborough and Lynch et al. 2018, which is incorporated herein by reference, at FIG. 2. S2) data confirmed that materials in stillage could be converted to MCFA by a microbial community originating from a full-scale wastewater treatment plant acid-digester.

Sustained MCFA Production from Switchgrass Stillage.

Figure 2A:
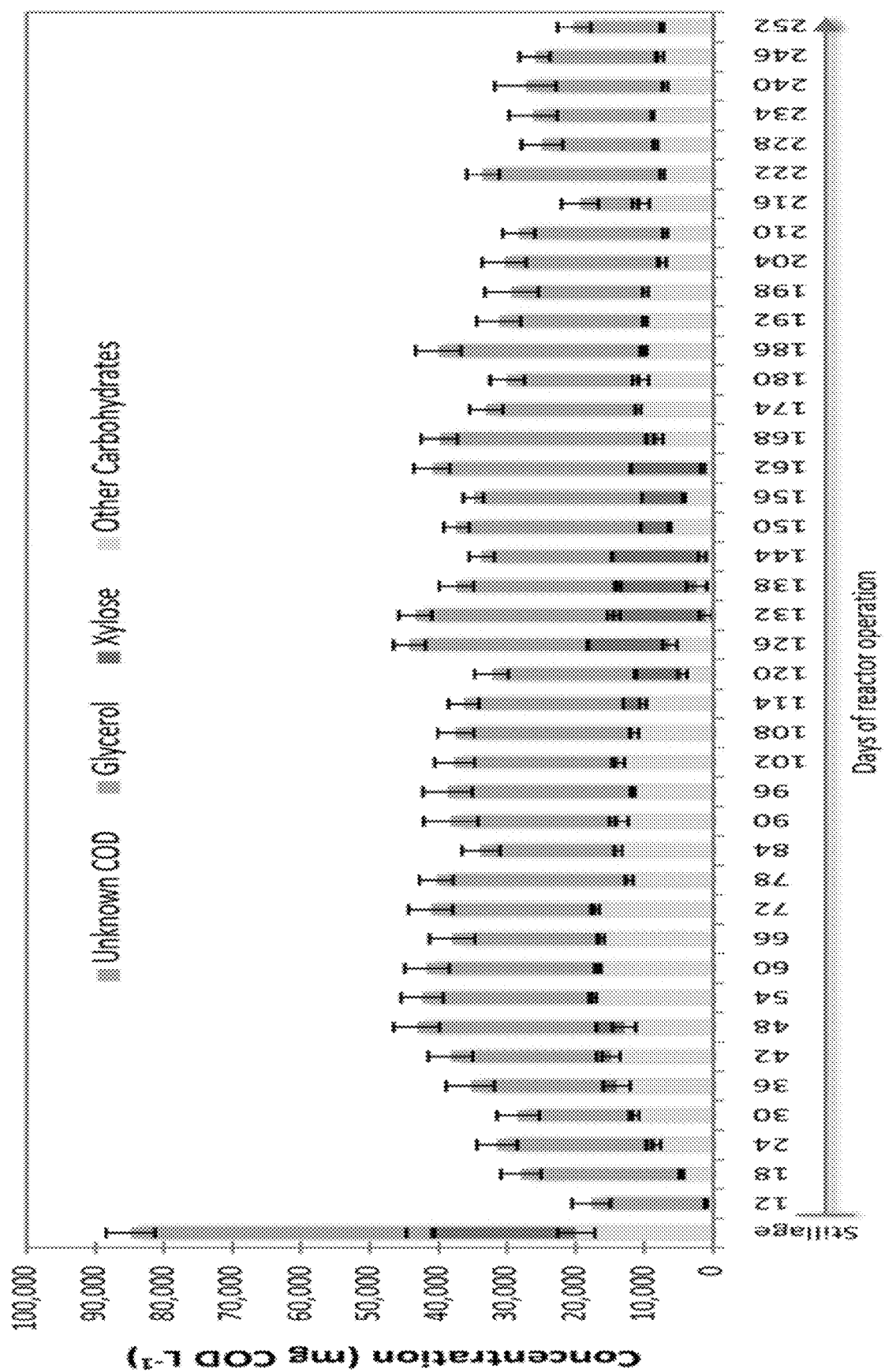
FIGS. 2A-2D. Mixed culture fermentation reactor performance for 252 days.
Figure 2B:
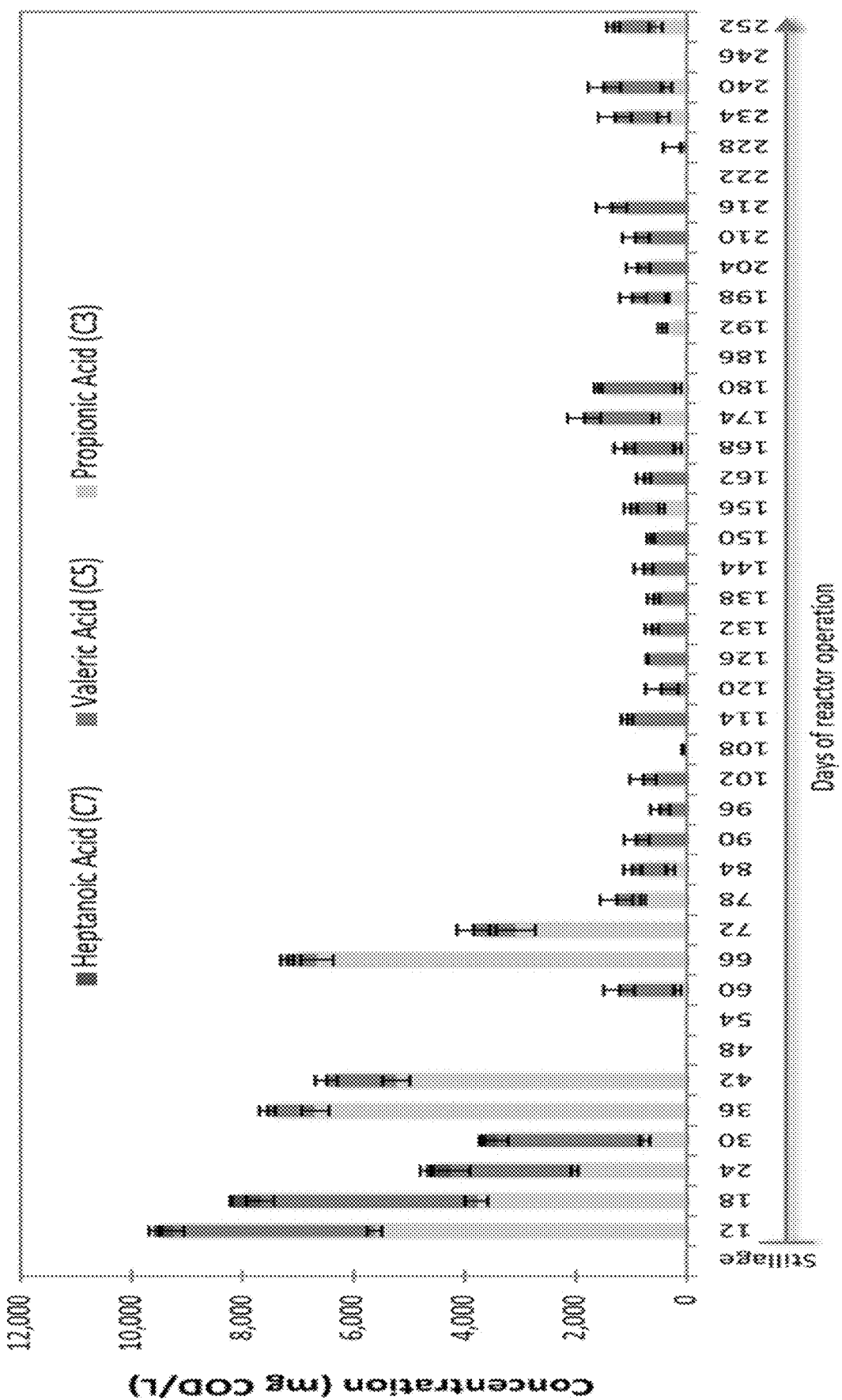
Figure 2C:
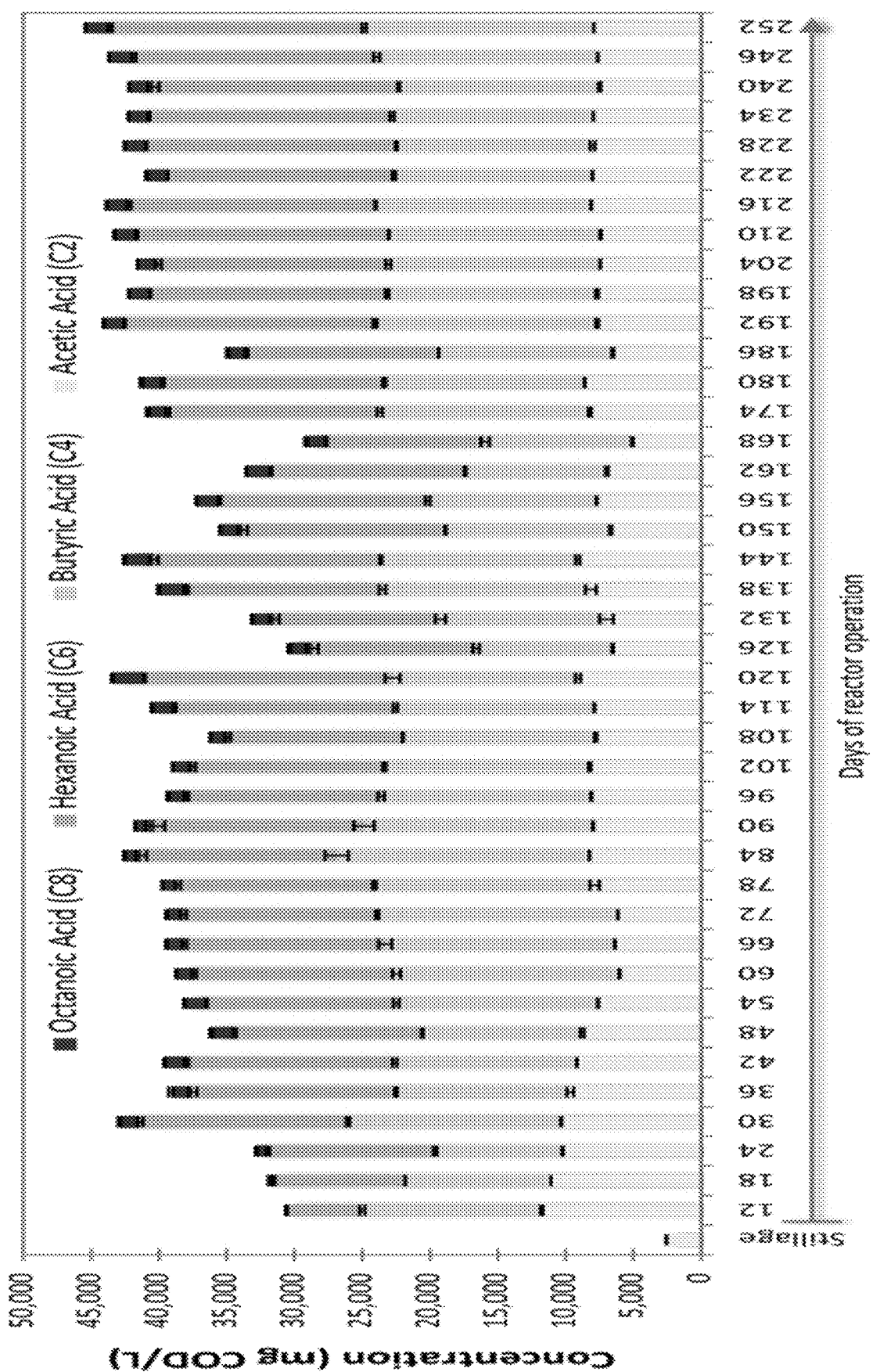
Figure 2D:
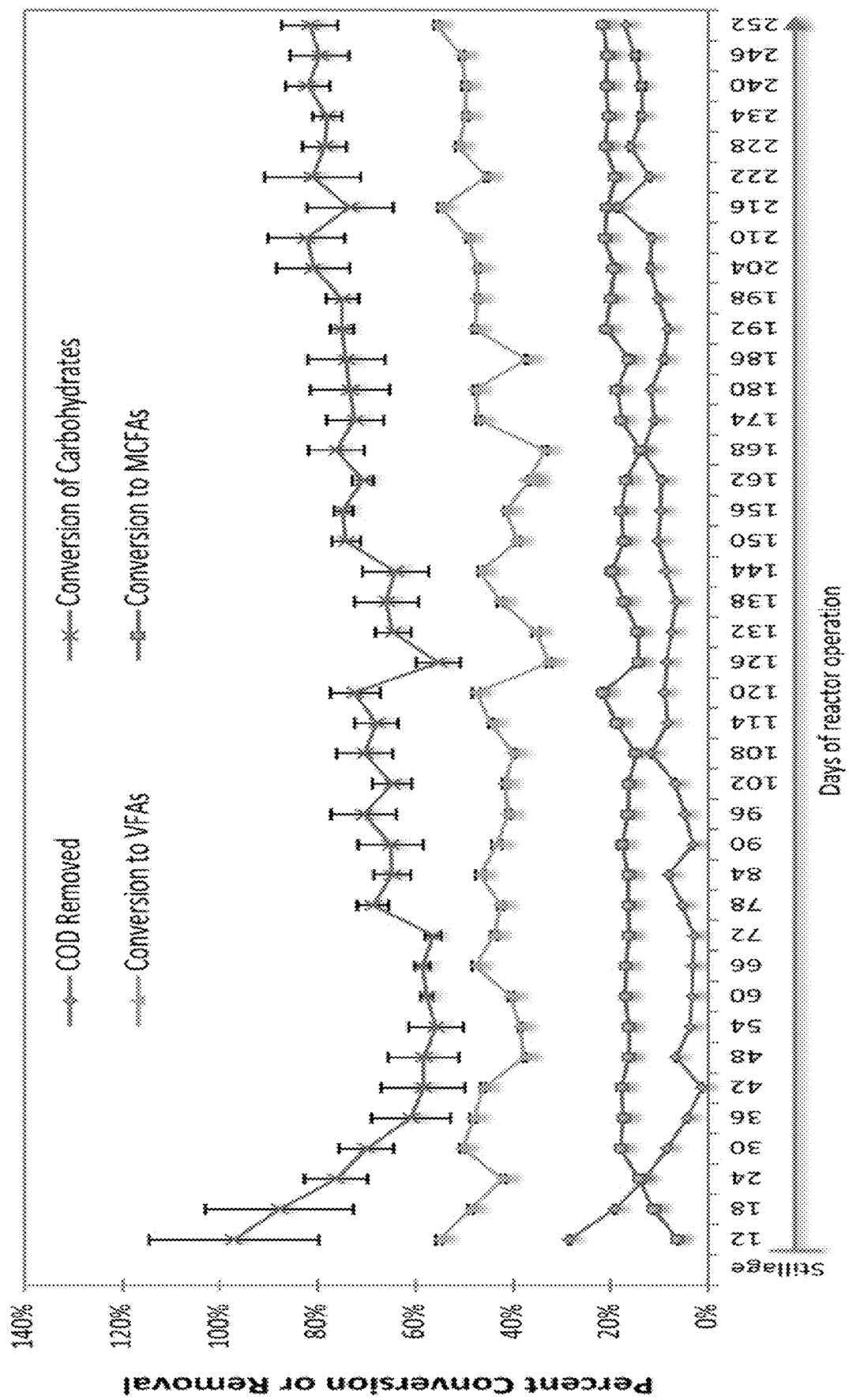

Based on these results, we chose to control the reactor pH at 5.5 for a long-term experiment to demonstrate sustained production of MCFA. Initially, xylose and other carbohydrates were consumed, and a mixture of odd- and even-chain linear fatty acids were produced (FIGS. 2A-2D). The maximum utilization of carbohydrates was achieved at Day 12, with 97±17% of the measured initial carbohydrates consumed (FIG. 2D). During the first 30 days of operation, accumulation of monocarboxylic acids steadily increased, reaching nearly 50% conversion of COD in stillage to monocarboxylic acids (FIG. 2D). As reactor operation continued, the concentration of odd-chain monocarboxylic acids (C3, C5, C7) decreased (FIG. 2B) while that of even-chain acids increased (FIG. 2C). From Day 30 through Day 252, the average conversion of COD in stillage to MCFA was 18±2.1%, and MCFA accounted for 41±7.0% of the total monocarboxylic acids produced.

Microbial Community Analysis.

Figure 3:
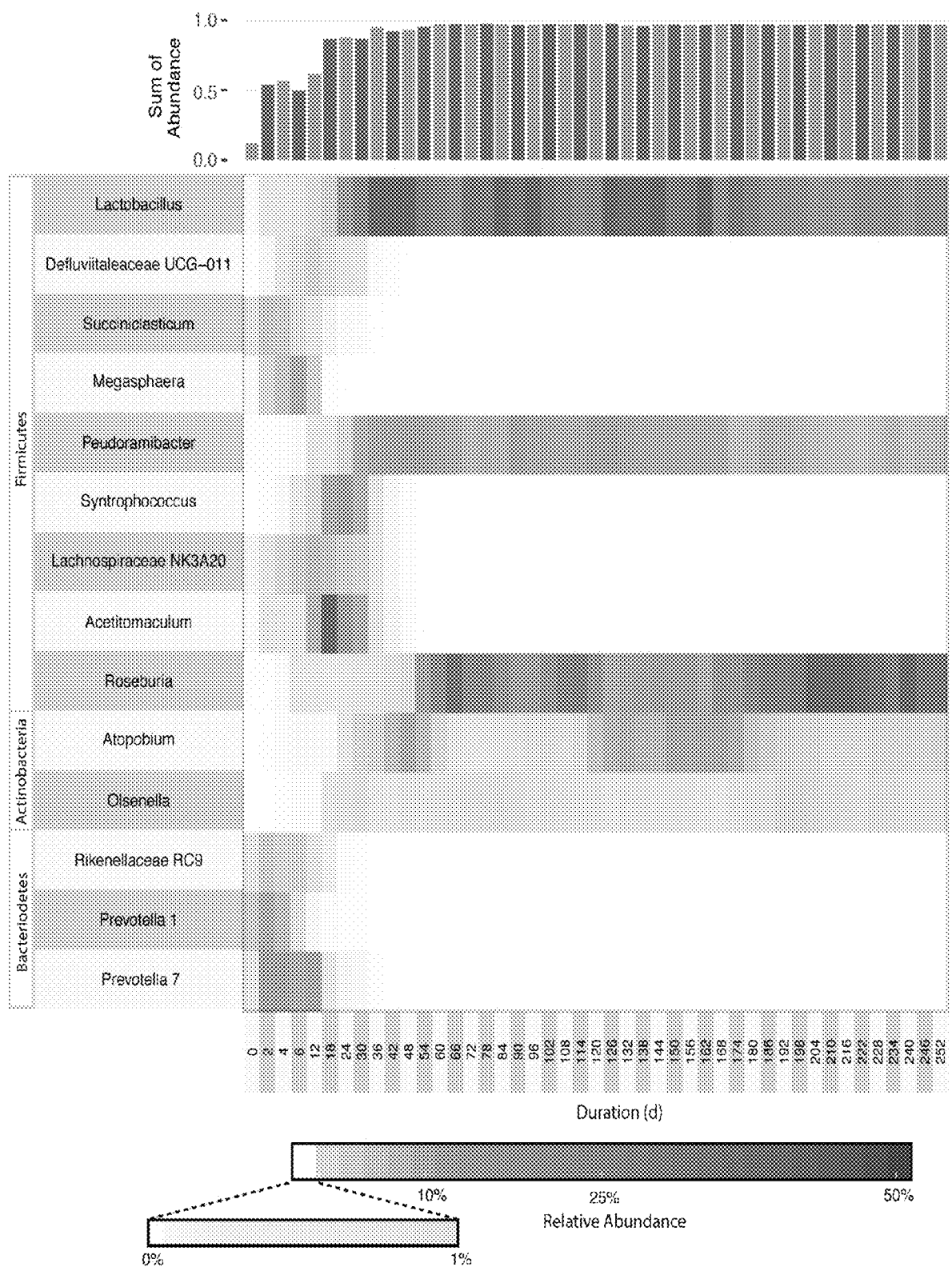
FIG. 3. Relative abundance of bacteria in the mixed culture fermentation reactor for 252 days. Day 0 corresponds to the acid digester sludge inoculum. Bacterial abundance is summarized based on the genera assigned by annotating representative sequences with the SILVA database. The sum of abundance represents the percentage of operational taxonomic units (OTUs) contained within the indicated genera. A heatmap of the top 100 OTUs is provided in Scarborough and Lynch et al. 2018, which is incorporated herein by reference, at Figure S3, and a table of all OTUs is provided in Scarborough and Lynch et al. 2018 at Additional File 4.

We used 16S rRNA gene amplicon sequencing to assess the members of the microbial community in this bioreactor and any changes that occurred in its composition as a function of time (FIG. 3; see also Scarborough and Lynch et al. 2018, which is incorporated herein by reference, at FIG. 2.S3). The initial microbial community contained many *Proteobacteria, Firmicutes*, and *Bacteriodetes* (see Scarborough and Lynch et al. 2018, which is incorporated herein by reference, at FIG. 2.S3). Early on in reactor operations, *Bacteroidetes* and *Firmicutes* became the most abundant organisms, with *Prevotella* species accounting for most of the *Bacteroidetes*. The increase in abundance of *Prevotella* 7 (FIG. 3) corresponds with the time of increased carbohydrate conversion ($p<0.001$), in agreement with *Prevotella*'s described ability to degrade polysaccharides and other complex substrates.[49] Megasphaera, an organism known to produce odd-chain fatty acids (OCFA)[50], was present in the inoculum and increased in abundance during the early phase of reactor operation. The high abundance of Megasphaera ($p=0.0023$) and *Prevotella* 7 ($p=0.0016$) at early stages of reactor operation corresponded with a period of higher OCFA production.

After extended operation, we found that the community composition stabilized and was dominated by organisms from five genera, including three *Firmicutes* (*Lactobacillus, Pseudoramibacter, Roseburia*) and two Actinobacteria (*Olsenella, Atopobium*). At later time points (Day 30-Day 252), the OTUs corresponding to these five genera accounted for greater than 95% of the total 16S rRNA gene sequences (FIG. 3). The relative abundance of *Pseudoramibacter* ($p=0.0045$), *Lactobacillus* ($p=0.0022$), and *Olsenella* ($p=0.014$) all correlated with the period of increased MCFA production. Neither *Roseburia* ($p=0.147$) nor *Atopobium* ($p=0.546$) are significantly correlated to increased MCFA production.

Figure 4:
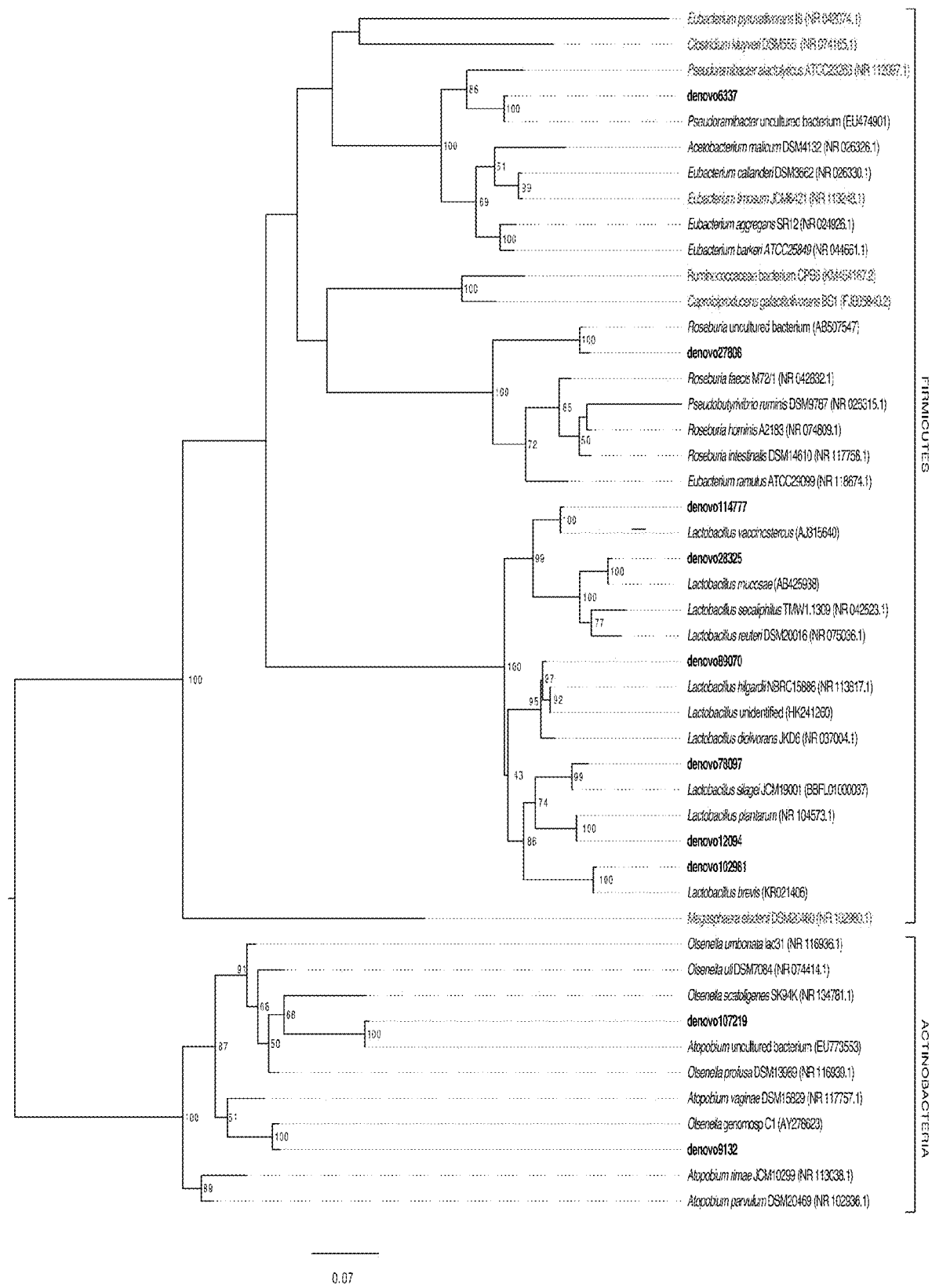
FIG. 4. Phylogenetic tree including the top 10 most abundant OTUs at Day 252. OTUs from this example are shown in bold text. Known chain-elongating bacteria are shown in red text. Bootstrap values greater than 50 are shown, and the phylogenetic tree is rooted to the Actinobacteria phylum. The horizontal branch distance corresponds to the mean nucleotide substitutions per sequence site. The accession numbers for 16S rRNA gene sequences for the indicated bacteria are provided in parentheses.
Figure 5:
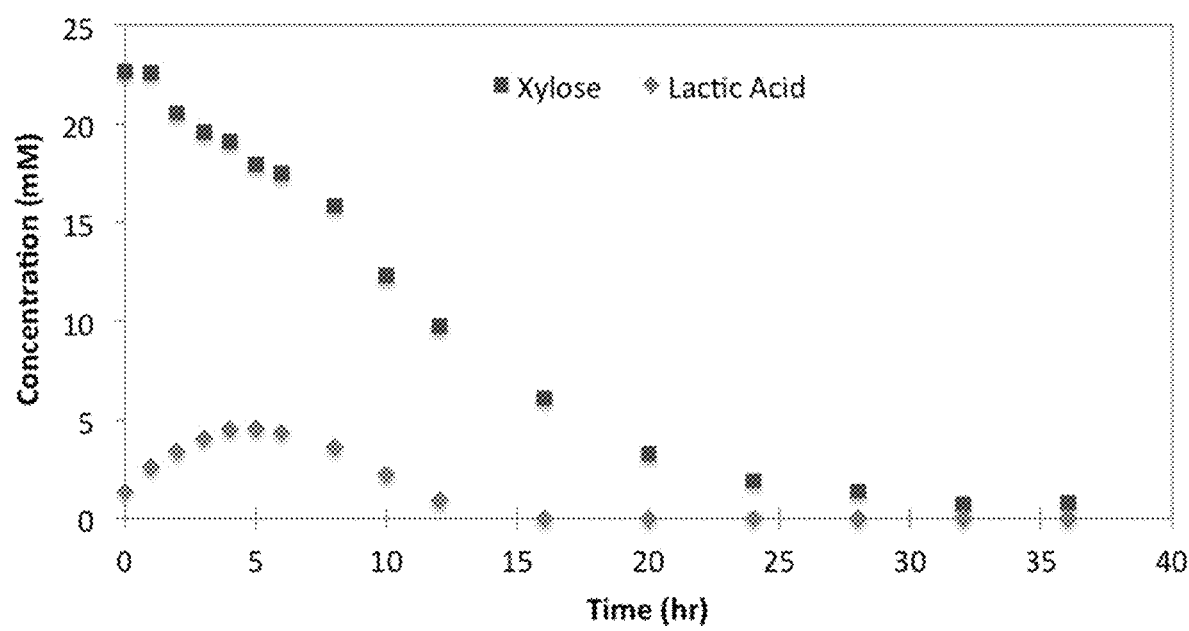
FIG. 5. Time-dependent changes of xylose and lactic acid concentrations. Lactic acid and xylose were measured after adding a spike feed of 25 ml stillage to the reactor at 252 days of operation. As xylose is removed from the media, lactic acid accumulates at approximately one mol of lactic acid per mol of xylose consumed. Extracellular lactic acid begins to decrease six hours after the addition of stillage.

Representative sequences for the most abundant OTUs were used to construct a maximum-likelihood phylogenetic tree (FIG. 4). The six high abundance *Lactobacillus* OTUs (denovo114777, denovo28325, denovo102981, denovo12094, denovo78097, and denovo89070) clustered with known xylose-consuming, heterofermentative Lactobacilli (*L. mucosae, L. plantarum, L. silagei, L. brevis, L. vaccinostercus* and *L. diolivorans*).[51-58] As lactic acid has previously been demonstrated as a substrate for MCFA production,[14,15] it may be a key intermediate for MCFA production in a microbial community.[18] While significant lactic acid accumulation was not observed during steady-state sampling, when we monitored time-dependent changes in the reactor after stillage was spike-fed, lactic acid transiently accumulated to detectable levels in the medium (FIG. 5) suggesting that lactic acid is produced but consumed by other community members.

The two OTUs within the Actinobacteria phylum, denovo9132 and denovo107219, clustered with members of the *Atopobium* and *Olsenella* genera respectively (FIG. 4), in the Coriobacteriaceae family. Several *Atopobium* and *Olsenella* species have been shown to consume carbohydrates and produce lactic acid.[59-62] The most abundant OTU at 252 days of reactor operation (denovo27808) clustered with *Roseburia*, which are known to utilize carbohydrates and acetic acid and produce butyric and lactic acids.[63-65] Another high abundance OTU identified in the microbial community (denovo6337) clustered with *Pseudoramibacter alactolyticus*, (previously *Eubacterium alactolyticum*) a bacterium that has been described as producing hexanoate and octanoate from lactic acid and glucose.[66]

Starting at Day 120, the feed changed from Stillage Batch 1 to Stillage Batch 2, which contained lower concentrations of aromatic compounds (Table 3). While initial changes in community compositions occurred (FIG. 3), with an increase in *Atopobium* and decrease in *Roseburia*, the major genera remained consistent and the community eventually re-stabilized. This initial change in stillage feed source coincided with a reduction in xylose utilization (FIG. 2A), however xylose utilization eventually increased and overall MCFA production was not impacted by this change in the stillage source ($p=0.415$).

We also performed redundancy analysis to relate the community composition with MCFA production, odd-chain fatty acid production (OCFA), and carbohydrate conversion and to investigate co-occurrence of abundant bacteria in the reactor (see Scarborough and Lynch et al. 2018, which is incorporated herein by reference, at FIG. 2.6). For early time points (Days 12-24), the abundance of *Prevotella* and Megasphaera correlate with OCFA production. The analysis also showed that higher relative abundance of *Lactobacillus* is associated with higher relative abundance of *Pseudoramibacter* and higher relative abundance of *Roseburia* correlates with higher relative abundance of *Olsenella* (see Scarborough and Lynch et al. 2018, which is incorporated herein by reference, at FIG. 2.6). These correlations suggest that these organisms may work in tandem during stillage metabolism. In the case of *Lactobacillus* and *Pseudoramibacter*, the *Lactobacillus* may be producing lactate that *Pseudoramibacter* converts to MCFA. This relationship is analogous to that suggested by Andersen et al. in which Megaspahera utilized lactate generated by *Lactobacillus*.[17] Similarly, *Olsenella* may be producing intermediates, such as acetate, that are known to be utilized by *Roseburia*.

Overall, the bacterial community results indicate that a stable fermenting community containing only five genera was enriched from the acid-digester sludge inoculum during growth on stillage. We suspect that Clostridia-related organisms (*Pseudoramibacter* and/or *Roseburia*) are responsible for MCFA production and the remaining community members ferment sugars to intermediate compounds (acetate, lactate, and/or ethanol) that provide substrates for MCFA production.

Economic Analysis of MCFA Production from Stillage.

Based on the sustained production of MCFA in this example, we evaluated the potential value of this process. We did this by modifying the NREL TEA for a lignocellulosic ethanol biorefinery to include a process in which stillage is used to produce MCFA. Using average percent conversions in the bioreactor between Day 30 and Day 252, we estimated that the COD remaining in stillage was converted to end products at the following percentages: 5.4% acetic acid, 15% butyric acid, 16% hexanoic acid, and 1.7% octanoic acid. Further, based on reactor operations during the same time period, 9.1% of the COD is removed from the system as off-gas.

Based on these conversions, a new mass and energy balance for the biorefinery was determined (see Scarborough and Lynch et al. 2018, which is incorporated herein by reference, at FIG. 2.7). The MCFA-producing fermentation reactor was sized for a SRT of 6 days, yielding an estimated total reactor volume of 16 million gallons. Software simulations predicted that a solvent flow rate of 9,000 kg hr$^{-1}$ was needed to recover 99.9% of the octanoic acid and 96.4% of the hexanoic acid, respectively. Software simulations further predicted that of the 9,000 kg hr$^{-1}$ 2-octanol feed, 745 kg hr$^{-1}$ separates into the aqueous phase and needs to be replenished. In our TEA, the organic phase undergoes a column distillation to remove 2-octanol that has a volume of 630 ft$^3$ and requires a total heating duty of 6.3 MW. After distilling the solvent, the model assumes that hexanoic and octanoic acids are separated in a second distillation column with a volume of 240 ft$^3$ that requires a total heating duty of 0.75 MW.

After the liquid-liquid extraction, the aqueous phase is fed to biogas-producing anaerobic digesters (see Scarborough and Lynch et al. 2018, which is incorporated herein by reference, at FIG. 2.7). Anaerobic digestion of lignocellulosic stillage[67] and acid digested stillage[68] for biogas production has been demonstrated by others. The mass flow rate of COD to the anaerobic digesters, including stillage, lignin, and biosolids, is 21,000 kg hr$^{-1}$, resulting in biogas production of 16,600 kg hr$^{-1}$ (compared to 21,900 kg hr$^{-1}$ if the stillage is used directly as in the NREL TEA).[2] The overall power generation from the remaining organics after MCFA removal is reduced from 41.0 MW to 38.0 MW. The reduction in overall power generation is small because lignin contributes the majority of COD to the anaerobic digesters.

As a result of the additional heating demands for the MCFA distillation columns, the net electricity that can be sold decreased from 13.7 MW to 3.8 MW (see Scarborough and Lynch et al. 2018, which is incorporated herein by reference, at Table 2.3). In addition, the capital costs associated with the stillage fermentation reactor, liquid-liquid-extraction, and distillation columns increased the total capital investment from $423 million to $441 million. The additional chemical costs for KOH and 2-octanol added annual operating costs of $14 million and $8.3 million, respectively. However, the MCFA products increased revenue by $57 million ($7.5 million from octanoic acid, and $47.5 million from hexanoic acid). Based on a 30-year cash flow with a 10% internal rate of return, the minimum ethanol selling price was determined to be $1.76 per gallon ($2.68 per gallon gasoline-equivalents; see Scarborough and Lynch et al. 2018, which is incorporated herein by reference, at FIG. 2.S4). This is 18% lower than the $2.15 per gallon for when electricity is generated as the only co-product to ethanol.[2]

Discussion

This example illustrates the use of microbial communities to convert stillage into valuable co-products. In the stillage-fed bioreactor, productivities of hexanoic ($2.6\pm0.3$ g d$^{-1}$) and octanoic ($0.27\pm0.04$ g L$^{-1}$ d$^{-1}$) acids were sustained for 214 days with titers at $66\pm8.2\%$ and $97\pm15\%$ of their solubility in water, respectively. These productivities are consistent with other studies investigating conversion of organic substrates derived from lignocellulosic materials or ethanol production wastes to MCFA (see Scarborough and Lynch et al. 2018, which is incorporated herein by reference, at Table 2.S1). Our system is unique, however, at least in that the primary carbohydrate consumed is xylose and the stillage has already been depleted of a large portion of fermentable sugars and the ethanol that others have used to produce MFCA. While we are proposing the co-production of ethanol and MCFA in this example, recent work has also explored production of MCFA as the main product of a lignocellulosic biorefinery. In work performed by Nelson et al., Megasphaera consumed glucose in lignocellulosic hydrolysate to generate hexanoic acid, but xylose was not consumed.[16] The microbial community like the one presented in this example could be utilized to convert the remaining xylose to MCFA.

The simplicity of the microbial community enriched in this example positions it well as a model community for MCFA production. Others have shown enrichments containing OTUs related to primary sugar fermenters, such as *Lactobacillus*, and OTUs related to Clostridia that may be involved in converting intermediate fermentation products to MCFA.[13-15,17,18,47,69] In our microbial community, at Day 252, only 10 OTUs are present at greater than 1% relative abundance, and these OTUs make up 89.3% of the total OTUs (see Scarborough and Lynch et al. 2018, which is incorporated herein by reference, at FIG. 2.S3). The statistical analyses indicate that *Pseudoramibacter* and *Lactobacillus* are co-enriched, and their abundance correlates with higher MCFA production. We therefore propose that *Lactobacillus* converts xylose to lactate and acetate by heterofermentation, and the lactate is elongated to MCFA by *Pseudoramibacter*. While 16S rRNA gene sequencing allows for the phylogeny of abundant organisms to be estimated, the function of community members should be investigated further utilizing metagenomic approaches. Due to the simplicity of the microbial community obtained in this example, this microbiome is well positioned for further investigation with metagenomic tools. Furthermore, its simplicity makes this a candidate microbiome for simulation with synthetic communities in the future. Of the OTUs that became enriched in the reactor, only *Roseburia* (denovo27808) and *Pseudoramibacter* (denovo6337) emerged as likely MCFA producing bacteria. While *Pseudoramibacter* have been shown to produce MCFA,[66] to our knowledge, the ability of *Roseburia* to produce MCFA has not been studied.

The TEA shows that even at the modest productivities of hexanoic and octanoic acids obtained in this example, MCFA produced from ethanol stillage could improve the economic feasibility of lignocellulosic biorefining. Improvements in the overall conversion of stillage COD to MCFA and production of a higher proportion of octanoic acid would further increase the revenue that can be generated by this strategy. Increasing MCFA product specificity towards octanoic acid is an ongoing area of research. One strategy to increase octanoic acid production is to utilize pertractive extraction of MCFAs to reduce product inhibition, as has been performed in past studies.[13,14] Recent work has also shown that increasing the ratio of ethanol to acetate increases selectivity of octanoic acid production.[13] The model of increasing the ratio of reduced electron donors to acetate suggests that, in the absence of ethanol, increasing the production of lactate as a fermentation intermediate (rather than acetate) could further drive octanoic acid production.

The economy of co-producing MCFA may also be affected by upstream biomass processing (i.e., the conversion of plant polymers to their constituent monomer units) and ethanol fermentation. For example, utilization of xylose by industrial yeast strains, such as *S. cerevisiae*, is limited[20], although attempts to improve pentose utilization by ethanol producers is an area of intense research activity.[70] Even though the *S. cerevisiae* Y128 strain used in this example was engineered for improved xylose utilization, it only consumed 47% of the xylose available in the switchgrass hydrolysate. Future ethanologenic organisms used in a lignocellulosic biorefinery may leave less xylose available for MCFA production. However, given the higher price of MCFA compared to ethanol, decreasing xylose consumption by the ethanologenic organism may actually result in an improved economy of the lignocellulosic biorefinery.

Another simple opportunity for improving the economic potential of co-producing MCFA is utilizing sodium hydroxide for pH control, instead of KOH, as sodium hydroxide is roughly one-sixth the cost of KOH. In our current model, the cost of KOH is a major expense. Alternatives to controlling pH with chemicals, such as electrolytic extraction which both controls the pH and extracts the acid products,[17] should also be explored further.

Conclusion

In this example, we showed that microbial communities could be used to produce valuable compounds from lignocellulosic stillage. We developed conditions for sustained MCFA production by an anaerobic microbiome that uses stillage produced during lignocellulosic biorefining. By fermenting switchgrass stillage, we maintained productivities of hexanoic and octanoic acids of 2.6±0.3 g $L^{-1}$ $d^{-1}$ and 0.27±0.04 g $L^{-1}$ $d^{-1}$, respectively. To our knowledge, this is the first demonstration of MCFA production with xylose and other organics in lignocellulosic ethanol stillage as the primary substrates. The MCFA-producing microbial community was derived from a diverse wastewater treatment ecosystem, but over time it became enriched in OTUs representing only five genera, including members of the Firmicutes phylum (*Lactobacillus*, *Roseburia*, and *Pseudoramibacter*) and of the Actinobacteria phylum (*Olsenella* and *Atopobium*). *Pseudoramibacter* are Clostridia related to known MCFA producing organisms, some of which have been shown to produce hexanoic and octanoic acids.[66]

A TEA, based on an update to an industry-accepted model, shows that, at the productivity of MCFA achieved in this example, valorizing lignocellulosic ethanol stillage to MCFA could improve the economic sustainability of a biorefinery. For example, using the MCFA production experimentally observed, if 16% of the COD remaining in stillage is converted to hexanoic acid and 1.7% is converted to octanoic acid, the minimum ethanol selling price could be reduced by 18%, from $2.15 $gal^{-1}$ to $1.76 $gal^{-1}$. Optimizations to microbiome MCFA productivities, MCFA extraction, solvent recovery and selection of the ethanologenic organism may contribute further to improving the economy of the lignocellulosic biorefinery.

REFERENCES

1. K. Gerbrandt, P. L. Chu, A. Simmonds, K. A. Mullins, H. L. MacLean, W. M. Griffins and B. A. Saville, *Curr. Opin. Biotechnol.*, 2016, 38, 63-70.
2. D. Humbird, R. Davis, L. Tao, C. Kinchin, D. Hsu, A. Aden, P. Schoen, J. Lukas, B. Olthof, M. Worley, D. Sexton and D. Dudgeon, Process Design and Economics for Biochemical Conversion of Lignocellolosic Biomass to Ethanol, NREL, 2011.
3. Senate and House of Representatives of the United States of America, Energy Policy Act of 2005, US Government Publishing Office, Washington, D.C., 2005.
4. Senate and House of Representatives of the United States of America, Energy Independence and Security Act of 2007, US Government Publishing Office, Washington, D.C., 2007.
5. L. T. Angenent, H. Richter, W. Buckel, C. M. Spirito, K. J. J. Steinbusch, C. M. Plugge, D. Strik, T. I. M. Grootscholten, C. J. N. Buisman and H. V. M. Hamelers, *Environ. Sci. Technol.*, 2016, 50, 2796-2810.
6. S. Sarria, N. S. Kruyer and P. Peralta-Yahya, Nat. Biotechnol., 2017, 35, 1158-1166. I. Gelfand, R. Sahajpal, X. Zhang, R. C. Izaurralde, K. L. Gross and G. P. Robertson, *Nature*, 2013, 493, 514-517.
8. M. T. Agler, B. A. Wrenn, S. H. Zinder and L. T. Angenent, *Trends Biotechnol.*, 2011, 29, 70-78.
9. M. T. Holtzapple and C. B. Granda, Appl. Biochem. Biotechnol., 2009, 156, 95-106.
10. M. T. Agler, C. M. Spirito, J. G. Usack, J. J. Werner and L. T. Angenent, *Energy Environ. Sci.*, 2012, 5, 8189.
11. C. Urban, J. Xu, H. Strauber, T. R. dos Santos Dantas, J. Mithlenberg, C. Hartig, L. T. Angenent and F. Harnisch, *Energy Environ. Sci.*, 2017, DOI: 10.1039/c7ee01303e.
12. D. Vasudevan, H. Richter and L. T. Angenent, *Bioresour. Technol.*, 2014, 151, 378-382.
13. L. A. Kucek, C. M. Spirito and L. T. Angenent, *Energy Environ. Sci.*, 2016, 9, 3482-3494.
14. L. A. Kucek, M. Nguyen and L. T. Angenent, *Water Res.*, 2016, 93, 163-171.
15. X. Zhu, Y. Tao, C. Liang, X. Li, N. Wei, W. Zhang, Y. Zhou, Y. Yang and T. Bo, Sci. Rep., 2015, 5, 14360.
16. R. Nelson, D. Peterson, E. Karp, G. Beckham and D. Salvachúa, *Fermentation*, 2017, 3, 10.
17. S. J. Andersen, P. Candry, T. Basadre, W. C. Khor, H. Roume, E. Hernandez-Sanabria, M. Coma and K. Rabaey, *Biotechnol Biofuels*, 2015, 8.
18. S. J. Andersen, V. De Groof, W. C. Khor, H. Roume, R. Props, M. Coma and K. Rabaey, *Front Bioeng Biotechnol*, 2017, 5, 8.

19. R. G. Ong, A. Higbee, S. Bottoms, Q. Dickinson, D. Xie, S. A. Smith, J. Serate, E. Pohlmann, A. D. Jones, J. J. Coon, T. K. Sato, G. R. Sanford, D. Eilert, L. G. Oates, J. S. Piotrowski, D. M. Bates, D. Cavalier and Y. Zhang, *Biotechnol Biofuels*, 2016, 9, 237.

20. L. S. Parreiras, R. J. Breuer, R. Avanasi Narasimhan, A. J. Higbee, A. La Reau, M. Tremaine, L. Qin, L. B. Willis, B. D. Bice, B. L. Bonfert, R. C. Pinhancos, A. J. Balloon, N. Uppugundla, T. Liu, C. Li, D. Tanjore, I. M. Ong, H. Li, E. L. Pohlmann, J. Serate, S. T. Withers, B. A. Simmons, D. B. Hodge, M. S. Westphall, J. J. Coon, B. E. Dale, V. Balan, D. H. Keating, Y. Zhang, R. Landick, A. P. Gasch and T. K. Sato, *PLoS One*, 2014, 9, e107499.

21. W. E. F. American Public Health Association, and American Water Works Association Standard Methods for the Examination of Water and Wastewater: 21st Edition, American Public Health Association, 2005.

22. E. W. Yemm and A. J. Willis, *Biochem. J.*, 1954, 57, 508-514.

23. P. K. Smith, R. I. Krohn, G. T. Hermanson, A. K. Mallia, F. H. Gartner, M. D. Provenzano, E. K. Fujimoto, N. M. Goeke, B. J. Olson and D. C. Klenk, *Anal. Biochem.*, 1985, 150, 76-85.

24. A. Klindworth, E. Pruesse, T. Schweer, J. Peplies, C. Quast, M. Horn and F. O. Glockner, *Nucleic Acids Res.*, 2013, 41.

25. T. Magoc and S. L. Salzberg, *Bioinformatics*, 2011, 27, 2957-2963.

26. J. G. Caporaso, J. Kuczynski, J. Stombaugh, K. Bittinger, F. D. Bushman, E. K. Costello, N. Fierer, A. G. Pena, J. K. Goodrich, J. I. Gordon, G. A. Huttley, S. T. Kelley, D. Knights, J. E. Koenig, R. E. Ley, C. A. Lozupone, D. McDonald, B. D. Muegge, M. Pirrung, J. Reeder, J. R. Sevinsky, P. J. Tumbaugh, W. A. Walters, J. Widmann, T. Yatsunenko, J. Zaneveld and R. Knight, *Nat. Methods*, 2010, 7, 335-336.

27. R. C. Edgar, *Bioinformatics*, 2010, 26, 2460-2461.

28. J. G. Caporaso, K. Bittinger, F. D. Bushman, T. Z. DeSantis, G. L. Andersen and R. Knight, *Bioinformatics*, 2010, 26, 266-267.

29. B. J. Haas, D. Gevers, A. M. Earl, M. Feldgarden, D. V. Ward, G. Giannoukos, D. Ciulla, D. Tabbaa, S. K. Highlander, E. Sodergren, B. Methe, T. Z. DeSantis, J. F. Petrosino, R. Knight, B. W. Birren and H. M. Consortium, *Genome Res.*, 2011, 21, 494-504.

30. C. Quast, E. Pruesse, P. Yilmaz, J. Gerken, T. Schweer, P. Yarza, J. Peplies and F. O. Glockner, *Nucleic Acids Res.*, 2013, 41, D590-D596.

31. P. J. McMurdie and S. Holmes, *PLoS One*, 2013, 8.

32. Barter R L, Yu B. Superheat: An R package for creating beautiful and extendable heatmaps for visualizing complex data. *J Comput Graph Stat.* 2018; 27(4):910-922.

33. R. C. Edgar, *Nucleic Acids Res.*, 2004, 32, 1792-1797.

34. A. Stamatakis, *Bioinformatics*, 2014, 30, 1312-1313.

35. Pinheiro, J. (2017). Package 'nlme'. Retrieved from cran.r-project.org/web/packages/nlme/nlme.pdf.

36. R. B. O. H. R. Minchin, Gavin L. Simpson, Peter Solymos, M. Henry H. Stevens, Eduard Szoecs and Helene and Wagner, vegan: Community Ecology Package. R package version 2.4-1, CRAN.R-project. org/package=vegan).

37. A. Kumar and S. Sokhansanj, *Bioresour. Technol.*, 2007, 98, 1033-1044.

38. S. Sokhansanj, S. Mani, A. Turhollow, A. Kumar, D. Bransby, L. Lynd and M. Laser, Biofuels, *Bioproducts and Biorefining*, 2009, 3, 124-141.

39. W. D. Seider, J. D. Seader, D. R. Lewin and S. Widagdo, Product and process design principles: synthesis, analysis, and evaluation. John Wiley and Sons, Inc., Hoboken, N.J., 3rd edn., 2009.

40. Zauba Technologies and Data, Search Import Export Data, www.zauba.com/shipment_search, (accessed Apr. 20, 2017).

41. United States Federal Reserve, Producer Price Index by Commodity for Chemicals and Allied Products: Industrial Chemicals (WPU061), (accessed May 1, 2017).

42. Process Design for Biochemical Conversion of Biomass to Ethanol (2002 and 2011 Design Reports), www.nrel.gov/extranet/biorefinery/aspen models, (accessed Mar. 3, 2017, 2017).

43. Z. X. Wang, J. Zhuge, H. Y. Fang and B. A. Prior, *Biotechnol. Adv.*, 2001, 19, 201-223.

44. S. Austin, W. S. Kontur, A. Ulbrich, J. Z. Oshlag, W. Zhang, A. Higbee, Y. Zhang, J. J. Coon, D. B. Hodge, T. J. Donohue and D. R. Noguera, *Environ. Sci. Technol.*, 2015, 49, 8914-8922.

45. S. Ghosh, J. R. Conrad and D. L. Klass, *J. Water Pollut. Control Fed.*, 1975, 47, 30-45.

46. H. Strauber, R. Lucas and S. Kleinsteuber, *Appl. Microbiol. Biotechnol.*, 2016, 100, 479-491.

47. L. A. Kucek, J. J. Xu, M. Nguyen and L. T. Angenent, *Front. Microbiol.*, 2016, 7.

48. S. Ge, J. G. Usack, C. M. Spirito and L. T. Angenent, *Environ. Sci. Technol.*, 2015, 49, 8012-8021.

49. D. Dodd, S. A. Kocherginskaya, M. A. Spies, K. E. Beery, C. A. Abbas, R. I. Mackie and I. K. O. Cann, *J. Bacteriol.*, 2009, 191, 3328-3338.

50. B. S. Jeon, O. Choi, Y. Um and B. I. Sang, Biotechnology for Biofuels, 2016, 9.

51. J. Bleckwedel, L. C. Teran, J. Bonacina, L. Saavedra, F. Mozzi and R. R. Raya, *Genome Announc*, 2014, 2.

52. S. Roos, F. Kamer, L. Axelsson and H. Jonsson, *Int. J. Syst. Evol. Microbiol.*, 2000, 50 Pt 1, 251-258.

53. M. Kleerebezem, J. Boekhorst, R. van Kranenburg, D. Molenaar, O. P. Kuipers, R. Leer, R. Tarchini, S. A. Peters, H. M. Sandbrink, M. W. Fiers, W. Stiekema, R. M. Lankhorst, P. A. Bron, S. M. Hoffer, M. N. Groot, R. Kerkhoven, M. de Vries, B. Ursing, W. M. de Vos and R. J. Siezen, *Proc. Natl. Acad. Sci. U.S.A*, 2003, 100, 1990-1995.

54. S. H. Chao, M. Sasamoto, Y. Kudo, J. Fujimoto, Y. C. Tsai and K. Watanabe, *Int. J. Syst. Evol. Microbiol.*, 2010, 60, 2903-2907.

55. Y. Zhang and P. V. Vadlani, *J. Biosci. Bioeng.*, 2015, 119, 694-699.

56. A. Garde, G. Jonsson, A. S. Schmidt and B. K. Ahring, *Bioresour. Technol.*, 2002, 81, 217-223.

57. F. Dellaglio, F. Vancanneyt, A. Endo, P. Vandamme, G. E. Felis, A. Castioni, J. Fujimoto, K. Watanabe and S. Okada, *Int. J. Syst. Evol. Microbiol.*, 2006, 56, 1721-1724.

58. J. Krooneman, F. Faber, A. C. Alderkamp, S. J. H. W. O. Elferink, F. Driehuis, I. Cleenwerck, J. Swings, J. C. Gottschal and M. Vancanneyt, *Int. J. Syst. Evol. Microbiol.*, 2002, 52, 639-646.

59. M. D. Collins and S. Wallbanks, *FEMS Microbiol. Lett.*, 1992, 95, 235-240.

60. M. R. Jovita, M. D. Collins, B. Sjoden and E. Falsen, *Int. J. Syst. Bacteriol.*, 1999, 49, 1573-1576.

61. F. E. Dewhirst, B. J. Paster, N. Tzellas, B. Coleman, J. Downes, D. A. Spratt and W. G. Wade, *Int. J. Syst. Evol. Microbiol.*, 2001, 51, 1797-1804.

62. X. Li, R. L. Jensen, O. Hojberg, N. Canibe and B. B. Jensen, *Int. J. Syst. Evol. Microbiol.*, 2015, 65, 1227-1233.
63. T. B. Stanton and D. C. Savage, *Int. J. Syst. Bacteriol.*, 1983, 33, 618-627.
64. S. H. Duncan, G. L. Hold, A. Barcenilla, C. S. Stewart and H. J. Flint, *Int. J. Syst. Evol. Microbiol.*, 2002, 52, 1615-1620.
65. S. H. Duncan, R. I. Aminov, K. P. Scott, P. Louis, T. B. Stanton and H. J. Flint, *Int. J. Syst. Evol. Microbiol.*, 2006, 56, 2437-2441.
66. L. V. Holdeman, C. P. Elizabeth and W. E. C. Moore, *Int. J. Syst. Bacteriol.*, 1967, 17, 323-341.
67. Z. L. Tian, G. R. Mohan, L. Ingram and P. Pullammanappallil, *Bioresour. Technol.*, 2013, 144, 387-395.
68. N. Nasr, E. Elbeshbishy, H. Hafez, G. Nakhla and M. H. El Naggar, *Bioresour. Technol.*, 2012, 111, 122-126.
69. R. Hegner, C. Koch, V. Riechert and F. Harnisch, *Rsc Adv*, 2017, 7, 15362-15371.
70. P. Devarapalli, N. Deshpande and R. R. Hirwani, *Biofuel Bioprod Bior*, 2016, 10, 534-541.
71. B. Xiong, T. L. Richard and M. Kumar, *J. Membr. Sci.*, 2015, 489, 275-283.
72. P. J. Weimer, M. Nerdahl and D. J. Brandl, *Bioresour. Technol.*, 2015, 175, 97-101.
73. S. Liang and C. Wan, *Bioresour. Technol.*, 2015, 182, 179-183.

Example 2. Metatranscriptomic and Thermodynamic Insights into Medium-Chain Fatty Acid Production Using an Anaerobic Microbiome

Summary

Biomanufacturing from renewable feedstocks can offset fossil fuel-based chemical production. One potential biomanufacturing strategy is production of medium-chain fatty acids (MCFA) from organic feedstocks using either pure cultures or microbiomes. While the set of microbes in a microbiome can often metabolize more diverse organic materials than a single species, and the role of specific species may be known, knowledge of the carbon and energy flow within and between organisms in MCFA producing microbiomes is only starting to emerge. Here, we integrate metagenomic, metatranscriptomic, and thermodynamic analyses to predict and characterize the metabolic network of an anaerobic microbiome producing MCFA from organic matter derived from lignocellulosic ethanol fermentation conversion residue. A total of 37 high quality (>80% complete, <10% contamination) metagenome-assembled genomes (MAGs) were recovered from the microbiome and metabolic reconstruction of the 10 most abundant MAGs was performed. Metabolic reconstruction combined with metatranscriptomic analysis predicted that organisms affiliated with *Lactobacillus* and Coriobacteriaceae degraded carbohydrates and fermented sugars to lactate and acetate. Lachnospiraceae and Eubacteriaceae affiliated organisms were predicted to transform these fermentation products to MCFA. Thermodynamic analyses identified conditions in which $H_2$ is expected to be either produced or consumed, suggesting a potential role of $H_2$ partial pressure on MCFA production. From an integrated systems analysis perspective, we propose that MCFA production could be improved if microbiomes are engineered to use homofermentative instead of heterofermentative *Lactobacillus*, and if MCFA-producing organisms are engineered to preferentially use a thioesterase instead of a CoA transferase as the terminal enzyme in reverse β-oxidation.

Introduction

Biological production of chemicals from renewable resources is an important step to reduce societal dependence on fossil fuels. One approach that shows potential for the biological production of chemicals from renewable resources, the carboxylate platform,[1,2] uses anaerobic microbial communities to bio-transform complex substrates into carboxylic acids, including medium-chain fatty acids (MCFAs). MCFAs such as hexanoate (a six carbon monocarboxylate, C6) and octanoate (an eight carbon monocarboxylate, C8) are used in large quantities for the production of pharmaceuticals, antimicrobials, and industrial materials, and can be processed to chemicals currently derived from fossil fuels.[3,4]

Previous applications of the carboxylate platform have focused on converting organics from undistilled corn beer,[5,6] food,[7,8] winery residue,[9] thin stillage from corn ethanol production,[10] and lignocellulose-derived materials[11-13] to MCFAs, and as we have shown for lignocellulosic biofuel production,[4] one can anticipate economic benefits from converting organic residues from these industries into MCFAs.

MCFA producing bioreactors contain diverse microbial communities.[4,5,12] While the roles of some community members in these microbiomes can be inferred from studies with pure cultures and from phylogenetic relationships,[10,12,14,15] detailed knowledge of specific metabolic activities in many members of these microbiomes is only starting to emerge.[16] In general, some community members participate in hydrolysis and fermentation of available organic substrates, while others are involved in the conversion of intermediates to MCFAs via reverse β-oxidation, a process also known as chain elongation.[1] In reverse β-oxidation, an acyl-CoA unit is combined with acetyl-CoA, with each cycle elongating the resulting carboxylic acid by two carbons.[1] Energy conservation in organisms using reverse β-oxidation as the main metabolic process for growth relies on ATP generation with reduced ferredoxin, which is generated through both pyruvate ferredoxin oxidoreductase and an electron bifurcating acyl-CoA dehydrogenase.[17] A proton translocating ferredoxin, NAD reductase, is used to reduce NAD with ferredoxin and create an ion motive force which is used to generate ATP.[17] The even-chain butyric (C4), hexanoic (C6), and octanoic (C8) acids are all potential products of reverse β-oxidation when the process is initiated with acetyl-CoA. The odd-chain valeric (C5) and heptanoic (C7) acids are products of reverse β-oxidation when the chain elongation process starts with propionyl-CoA. While there are demonstrations of this wide range of possible products from chain elongation,[5,18] and MCFA-producing bioreactors typically produce more than one product,[4,12,14,15,19,20] a strategy to control the final product length has not yet emerged. We are interested in obtaining the knowledge needed for the rational development and implementation of strategies to improve MCFA yields and control product formation in MCFA-producing microbiomes.

In the previous example we showed a bioreactor that produced a mixture of C2, C4, C6 and C8 from lignocellulosic stillage.[4] Based on 16S rRNA tag sequencing, we found that five major genera, three *Firmicutes* (*Lactobacillus, Roseburia, Pseudoramibacter*) and two Actinobacteria (*Atopobium, Olsenella*), represented more than 95% of the community.[4] Based on the phylogenetic association of these organisms, the *Lactobacillus* and the Actinobacteria were hypothesized to produce lactic acid, while *Roseburia* and *Pseudoramibacter* were hypothesized to produce the even-chain C4, C6, and C8 acids.[4] Furthermore, lactic acid was proposed as the key fermentation product that initiated chain elongation in the microbiome.[4] However, since phylogenetic association is not enough to understand in detail the metabolism of these organisms, the earlier example did not generate sufficient knowledge to help understand how to control a MCFA-producing microbiome.

Here we show further aspects of the MCFA-producing microbiome discussed in Example 1.[4] Se utilized a combination of metagenomic, metatranscriptomic, and thermodynamic analyses to reconstruct the combined metabolic activity of the microbial community. We analyzed the gene expression patterns of the ten most abundant community members during steady-state reactor operation. Our results identify several community members that expressed genes predicted to be involved in complex carbohydrate degradation and in the subsequent fermentation of degradation products to lactate and acetate. Genes encoding enzymes for reverse β-oxidation were expressed by two abundant organisms affiliated with the class Clostridia. Based on a thermodynamic analysis of the proposed MCFA-producing pathways, we predict that individual Clostridial organisms use different substrates for MCFA production (lactate, versus a combination of xylose, $H_2$, and acetate). We also show that, under certain conditions, production of MCFA provides energetic benefits compared to production of butyrate, thus generating hypotheses for how to control the final products of chain elongation. This knowledge lays a foundation to begin addressing how to engineer and control MCFA producing microbiomes.

Results

Microbiome Characterization

Figure 6A:
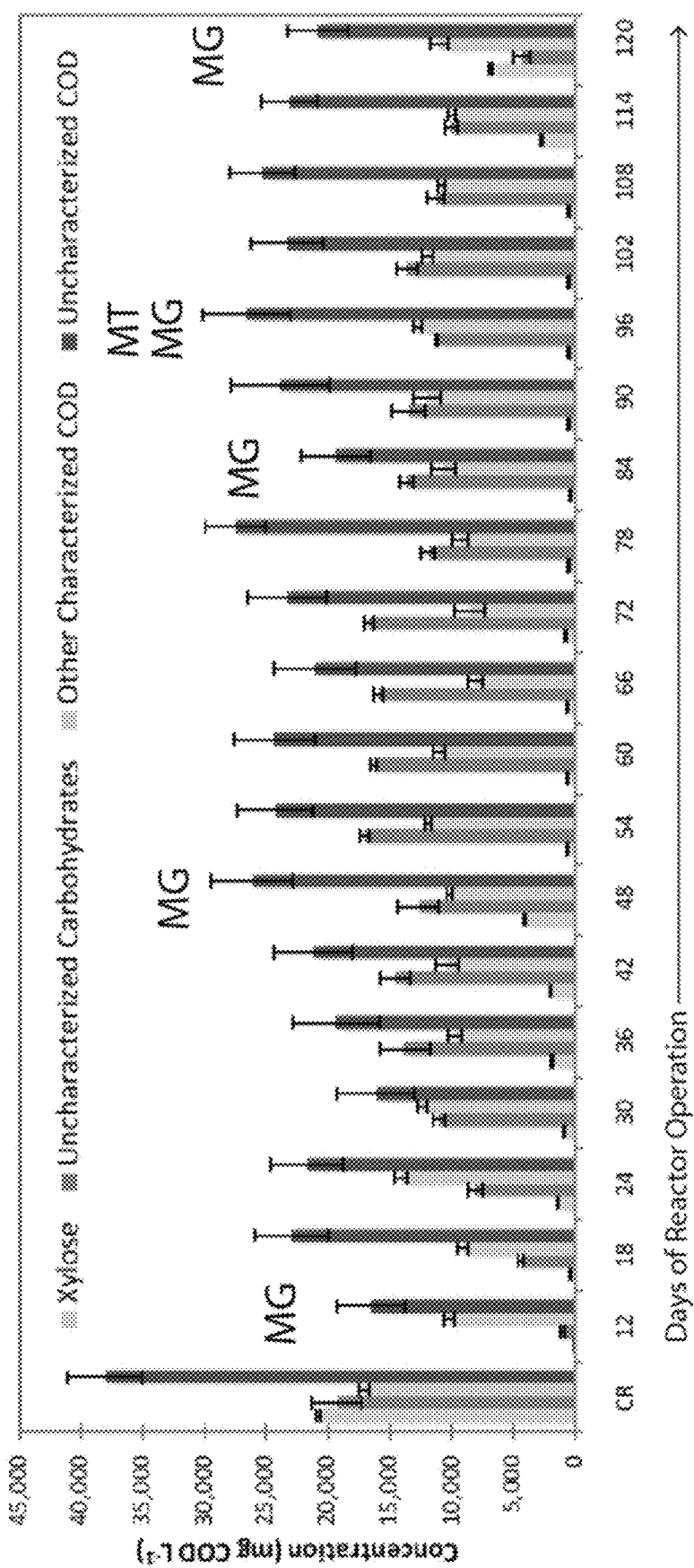
FIGS. 6A-6C Transformation of materials in lignocellulosic ethanol conversion residue by an anaerobic microbiome (FIGS. 6A and 6B) and abundance of metagenome-assembled genomes (MAGs) (FIG. 6C). During 120 days of reactor operation, compounds in conversion residue (CR) (i.e., stillage) were converted to medium-chain fatty acids. For FIGS. 6A and 6B, the first set of bars in the figure describe concentrations in the feed (CR), whereas the rest of the bars describe concentrations in the reactor. A more detailed description of the operation of this reactor is presented elsewhere[4]. Samples were taken for metagenomic (MG) analysis from five timepoints (Day 12, Day 48, Day 84, Day 96, and Day 120 and for metatranscriptomic analysis (MT) from one time point (Day 96). Overall, the bioreactor transformed xylose, uncharacterized carbohydrates and uncharacterized COD to acetic (C2), butyric (C4), hexanoic (C6) and octanoic (C8) acids. The microbial community was enriched in 10 MAGs.
Figure 6B:
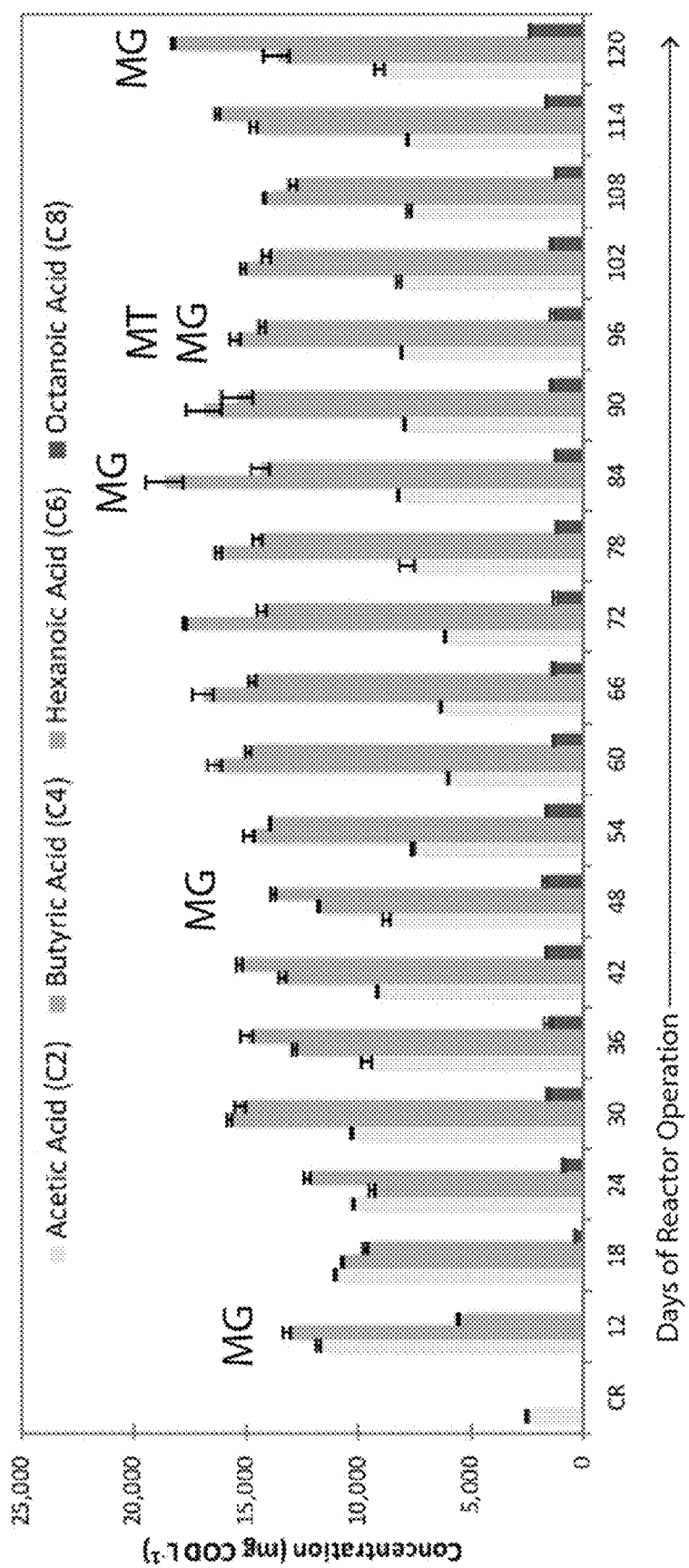
Figure 6C:
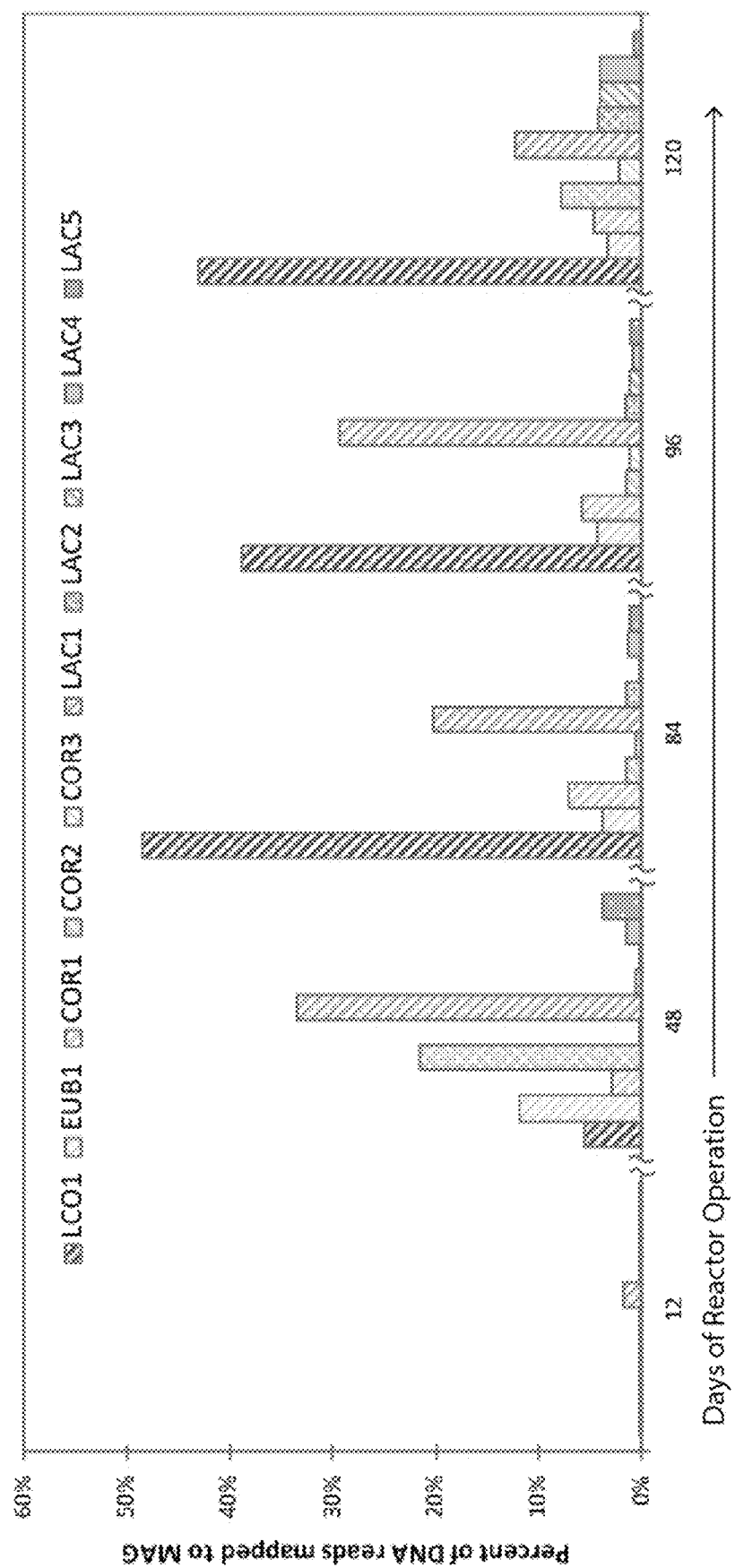

We previously described the establishment of a microbiome that produces MCFA in a bioreactor that is continuously fed with the residues from lignocellulosic ethanol production.[4] The reactor feed, identified as conversion residue (CR) in FIGS. 6A-6C, contained high amounts of xylose, carbohydrate oligomers, and uncharacterized organic matter. To gain insight into the microbial activities that were associated with this MCFA-producing microbiome, samples were collected for metagenomic analysis at five different times (Days 12, 48, 84, 96, and 120), and RNA was prepared for metatranscriptomic analysis at Day 96. At the time of metatranscriptomic sampling, the bioreactor converted 16.5% of the organic matter (measured as chemical oxygen demand (COD)) in conversion residue to C6 and C8. During the period of reactor operation described in FIGS. 6A-6C, the bioreactor converted 16.1±3.1% of COD to C6 and C8, and, therefore, Day 96 is representative of the overall reactor performance.

Figure 7:
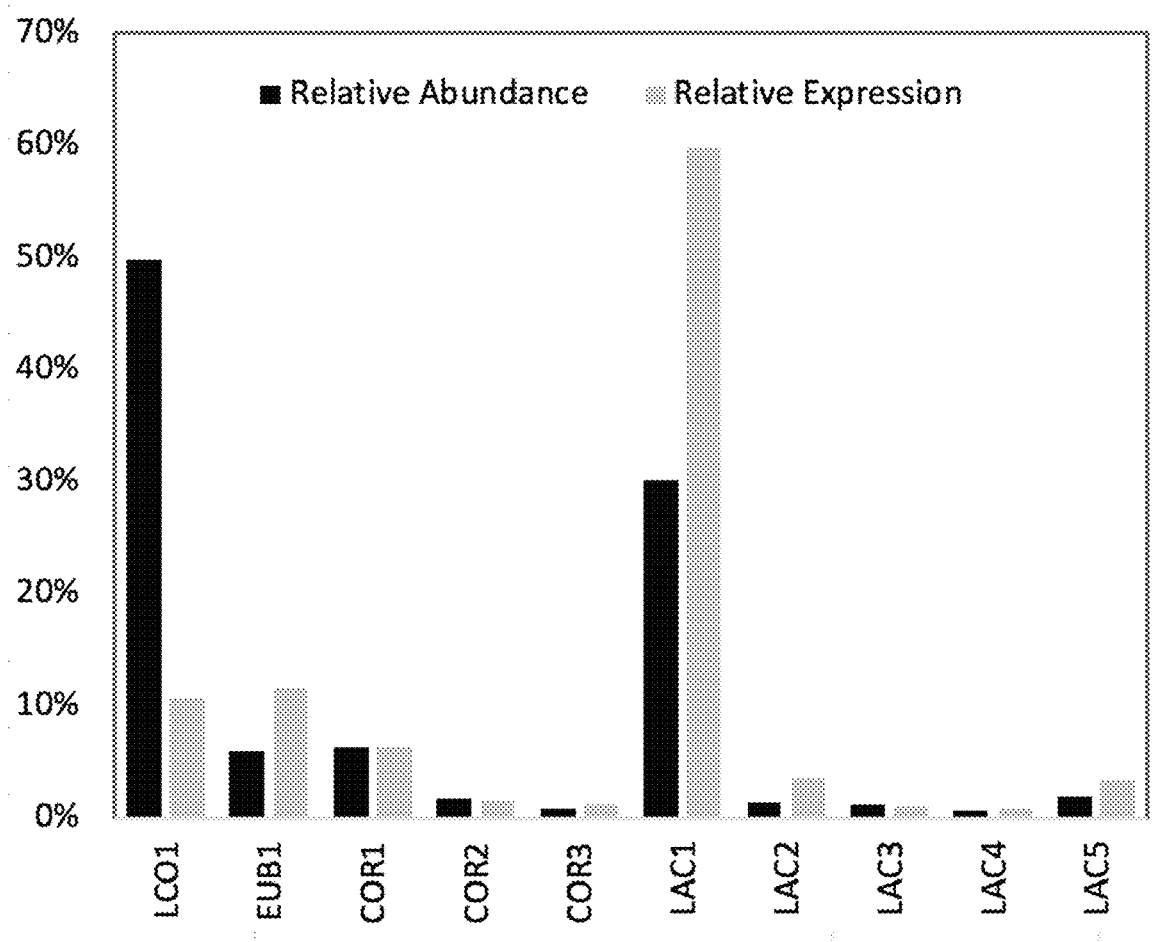
FIG. 7. Relative abundance and expression of the 10 most abundant MAGs in the bioreactor at Day 96. Relative abundance was determined by mapping DNA sequencing reads to the MAG and normalizing to the length of the MAG genome. Relative transcript abundance (expression) was determined by mapping c-DNA sequencing reads to the MAG and normalizing to the length of the MAG genome.

From the metagenomic samples, a total of 219 million DNA reads were assembled and binned, resulting in 37 high quality (>80% complete, <10% contamination) MAGs (see Scarborough and Lawson et al. 2018, which is incorporated herein by reference, at Supplementary Data File 1). MAGs are the collection of genes that were assembled into contigs and represent the population of organisms associated with this collection. For the Day 96 sample, 86% of the DNA reads mapped to the ten most abundant MAGs (Table 4), and each individual MAG mapped more than 0.9% of the DNA reads or more than 0.9% of the cDNA reads (see Scarborough and Lawson et al. 2018, which is incorporated herein by reference, at Supplementary Data File 2). Abundance of the top 10 MAGs was calculated from the percent of the total DNA reads from each time point mapped to the MAGs (FIG. 6C). For the Day 96 sample, relative abundance and expression were compared (FIG. 7; see also Scarborough and Lawson et al. 2018, which is incorporated herein by reference, at Supplementary Data File 2). The most abundant MAGs include a Lachnospiraceae (LCO1, 50%), a *Lactobacillus* (LAC1, 30%), a Coriobacteriacea (COR1, 6.3%), and a Eubacteriaceae (EUB1, 6.0%). Four additional Lactobacilli and two additional Coriobacteriacea are also predicted to be within the 10 most abundant MAGs (FIG. 7). The other MAGs corresponded to *Firmicutes* (17 MAGs), Actinobacteria (4 MAGs), Tenericutes (3 MAGs), *Bacteroidetes* (2 MAGs), and Spirochaetes (1 MAG).

TABLE 4

Summary of MAGs obtained from DNA sequence analysis of the reactor microbiome. Taxonomy, completeness, and contamination were estimated with CheckM. Draft genomes were assembled from five independent reactor samples. These MAGs represent the ten most abundant MAGs at Day 96 (FIGS. 6A-6C).

| Bin ID | Taxonomy | Completeness (%) | Contamination (%) | Genome size (bp) | # Scaffolds | N50 | GC (%) | Predicted Genes |
|---|---|---|---|---|---|---|---|---|
| LCO1 | Firmicutes; Clostridia; Clostridiales; Lachnospiraceae; *Shuttleworthia* | 95.4 | 0.0 | 2,106,912 | 44 | 103,964 | 45.7 | 1,900 |
| EUB1 | Firmicutes; Clostridia; Clostridiales; Eubacteriaceae; *Pseudoramibacter* | 97.8 | 0.2 | 2,002,609 | 35 | 142,846 | 51.2 | 1,857 |
| COR1 | Actinobacteria; Actinobacteria; Coriobacteriales; Coriobacteriaceae; *Olsenella* | 99.2 | 0.8 | 2,512,349 | 225 | 22,880 | 59.0 | 2,358 |
| COR2 | Actinobacteria; Actinobacteria; Coriobacteriales; Coriobacteriaceae; *Olsenella* | 100 | 1.6 | 2,422,853 | 155 | 34,678 | 64.8 | 2,185 |

TABLE 4-continued

Summary of MAGs obtained from DNA sequence analysis of the reactor
microbiome. Taxonomy, completeness, and contamination were estimated with CheckM.
Draft genomes were assembled from five independent reactor samples. These MAGs
represent the ten most abundant MAGs at Day 96 (FIGS. 6A-6C).

| Bin ID | Taxonomy | Completeness (%) | Contamination (%) | Genome size (bp) | # Scaffolds | N50 | GC (%) | Predicted Genes |
|---|---|---|---|---|---|---|---|---|
| COR3 | Actinobacteria; Actinobacteria; Coriobacteriales; Coriobacteriaceae; *Olsenella* | 98.4 | 7.4 | 3,647,413 | 533 | 13,368 | 55.5 | 4,068 |
| LAC1 | Firmicutes; Bacilli; Lactobacillales; Lactobacillaceae; *Lactobacillus* | 99.5 | 1.1 | 2,633,889 | 18 | 640,122 | 43.6 | 2,567 |
| LAC2 | Firmicutes; Bacilli; Lactobacillales; Lactobacillaceae; *Lactobacillus* | 99.4 | 1.6 | 3,179,174 | 79 | 122,889 | 40.5 | 2,989 |
| LAC3 | Firmicutes; Bacilli; Lactobacillales; Lactobacillaceae; *Lactobacillus* | 99.2 | 1.4 | 2,704,063 | 174 | 29,509 | 43.0 | 2,731 |
| LAC4 | Firmicutes; Bacilli; Lactobacillales; Lactobacillaceae; *Lactobacillus* | 98.9 | 1.3 | 3,335,227 | 95 | 86,779 | 40.2 | 3,150 |
| LAC5 | Firmicutes; Bacilli; Lactobacillales; Lactobacillaceae; *Lactobacillus* | 80.1 | 0.8 | 1,487,044 | 181 | 12,363 | 46.1 | 1,524 |

Figure 8:
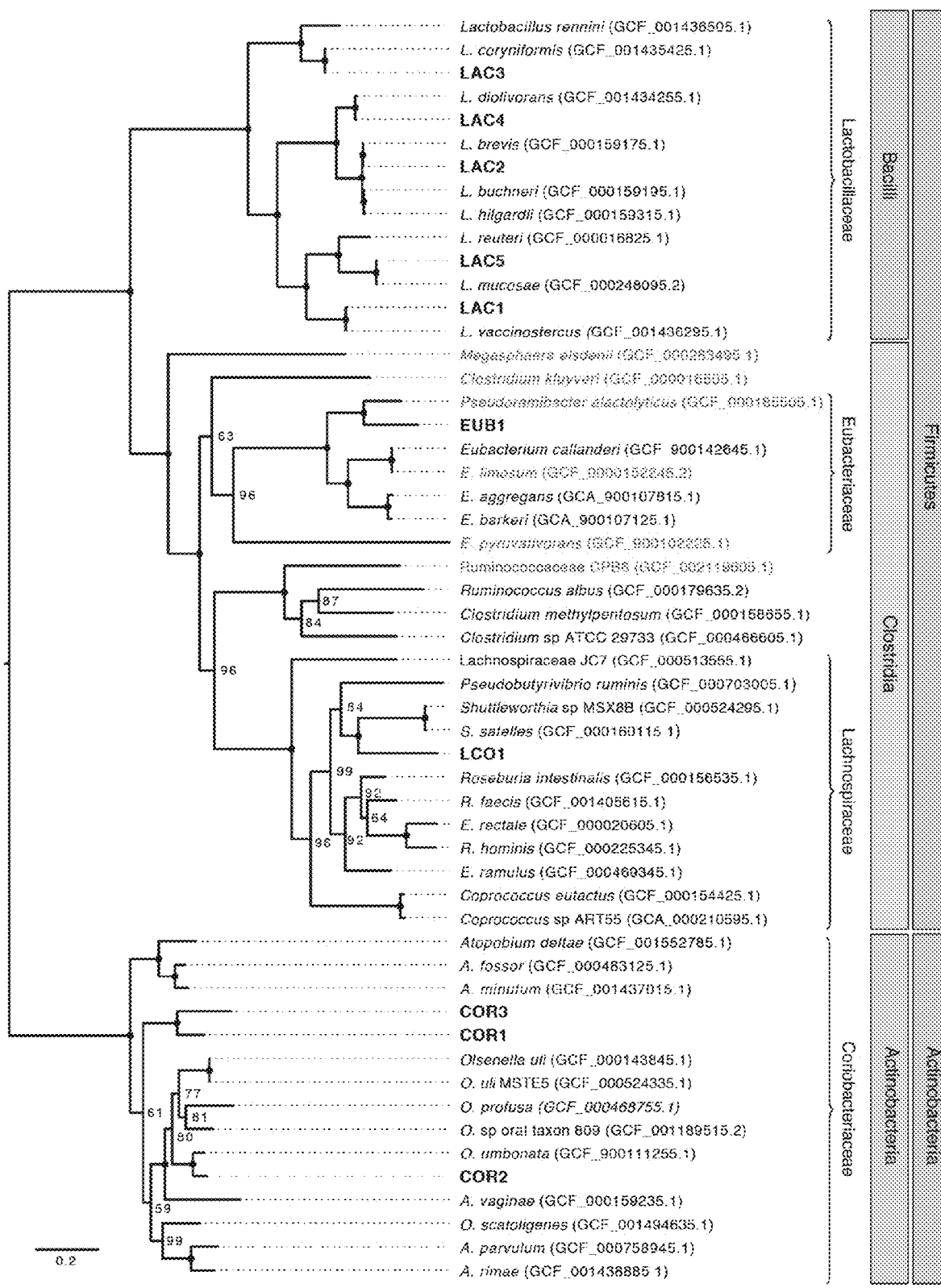
FIG. 8. Phylogenetic analysis for ten MAGs obtained from reactor biomass. Draft genomes from this example are shown in bold text. Red text indicates an organism that has been shown to produce MCFA. National Center for Biotechnology Information assembly accession numbers are shown in parentheses. Node labels represent bootstrap support values with solid circles representing a bootstrap support value of 100. The phyla and class of genomes are shown in shaded boxes and families are indicated by brackets. For Actinobacteria genomes, Actinobacteria is both the phylum and class.

The metatranscriptome data, obtained from the Day 96 sample, contained 87 million cDNA reads. After quality checking and removal of rRNA sequences, 82.6 million predicted transcript reads were used for mapping to MAGs. Of these, 85% of the predicted transcripts (hereafter referred to as transcripts or mRNA) mapped back to the 10 most abundant MAGs. Relative expression was calculated from the total filtered mRNA mapped to the MAGs and normalized to the predicted genome length of these bacteria (FIG. 7). MAGs with the highest levels of transcripts included LAC1 (60%), EUB1 (12%), LCO1 (11%), and COR1 (6.3%), which also displayed high abundance in the metagenome (FIG. 8). Whereas LCO1 was most abundant based on DNA reads, LAC1 appeared to have the highest activity based on transcript levels.

A phylogenetic tree of the ten most abundant MAGs was constructed based on concatenated amino acid sequences of 37 single-copy marker genes (FIG. 8).

Genomic Predictions of Chemical Transformations in the Microbiome

A prediction of metabolic networks in the microbiome was performed by analysis of gene annotations or each of the abundant MAGs, whereas expression of the metabolic network was analyzed by mapping mRNA reads to the open reading frames (ORFs) within each of the ten most abundant bacteria. Metabolic reconstruction was performed with automated prediction algorithms[23] and manual curation, particularly of proposed sugar utilization, fermentation and chain elongation pathways.[1] This analysis identified a set of genes that could be used to model the metabolic potential of the microbiome and also a set of genes with high expression levels in the metatranscriptome. These gene sets were used to analyze the metabolic potential of the microbiome to [1] degrade complex carbohydrates remaining in ethanol conversion residue; [2] transform simple sugars into the fermentation products acetate, lactate, and ethanol; and [3] produce butyrate (C4), C6, and C8 from sugars and fermentation products. The predictions for each of these processes are summarized below.

Degradation of complex carbohydrates. Carbohydrates were a large portion of the organic substrates present in the ethanol conversion residue fed to the bioreactor, and uncharacterized carbohydrates. Quantitative analyses indicated that xylose was the most abundant monosaccharide in the residue, accounting for 22% of the organic matter. Glucose was undetected in most samples or a minor component, and other carbohydrates corresponded to 20% of the organic matter in the residue (see CR bar in FIGS. 6A-6C). Approximately 40% of the uncharacterized carbohydrates were being degraded at the time the metatranscriptomic samples were obtained (Day 96; FIGS. 6A-6C).

To investigate the expression of genes related to degradation of complex carbohydrates, we analyzed the predicted MAG ORFs using the carbohydrate-active enzyme (CAZyme) database[24]. Of particular interest was production of predicted extracellular enzymes that hydrolyze glycosidic bonds in complex carbohydrates, as these may release sugars that can be subsequently metabolized by community members that do not express complex carbohydrate degrading enzymes. The subcellular localization software, CELLO, was used to predict whether individual CAZyme proteins were located within the cytoplasm or targeted to the extracellular space[25].

This analysis showed that transcripts encoding genes for several types of glycoside hydrolases (GHs) were abundant in several MAGs in the microbiome (see Scarborough and Lawson et al. 2018, which is incorporated herein by reference, at FIG. 3.S1). All LAC MAGs expressed genes encoding extracellular CAZymes that cleave glycosidic bonds between hexose and pentose moieties in xylans. In particular, LAC1 LAC2, and LAC4 expressed genes that encode several extracellular exo-β-xylosidases that could remove terminal xylose molecules from xylans present in the conversion residue (GH43 and GH120; FIG. 5l; Supplement 5). LAC2 also had high levels of transcripts for an exo-α-L-1,5-arabinanase (GH93), predicted to release other pentose sugars from arabinan, which accounts for 3% of the sugar polymers in switchgrass[26,27]. In addition, the COR1, COR3 and LAC4 members of the community had high transcript levels for three extracellular CAZymes (GH13) that are predicted to degrade a variety of glucans that may be remaining in switchgrass conversion residue[28]. In sum, this analysis predicts that at the time of sampling glucans were degraded by populations represented by *Lactobacillus* and Coriobacteriaceae MAGs, where the populations represented by the LAC MAGs may also have degraded xylans and arabinans. It further suggests that this microbiome is capable of releasing oligosaccharides and sugar monomers from glucans, xylans, and arabinans, the primary components of switchgrass and other plant biomass. The analysis also predicts that LCO1 and EUB1 are not participating in complex carbohydrate degradation.

Bacterial oligosaccharide hydrolysis can also occur in the cytoplasm. All MAGs in this microbiome contained predicted cytoplasmic GH13 enzymes, which are known to degrade hexose oligosaccharides. The microbiome also contained abundant transcripts for genes encoding predicted cytoplasmic CAZymes that degrade maltose (GH4, GH65), a glucose dimer that may result from extracellular breakdown of glucans (see Scarborough and Lawson et al. 2018, which is incorporated herein by reference, at FIG. 3.S1). Transcripts encoding known or predicted cytoplasmic β-glucosidases (GH1, GH3) and β-galactosidases (GH2) are found across the MAGs (FIG. 5l). In addition, transcripts that encode β-xylosidases (GH1, GH3) and α-L-arabinofuranosidases (GH2), are found in all the LAC MAGs except LAC3 (see Scarborough and Lawson et al. 2018, which is incorporated herein by reference, at FIG. 3.S1). Based on the metatranscriptomic analysis, other cytoplasmic CAZymes predicted to hydrolyze pentose-containing oligosaccharides are predicted to be expressed by the LAC1, LAC2, LAC4, and LAC5 members of this microbiome (Scarborough and Lawson et al. 2018, which is incorporated herein by reference, at FIG. 3.S1).

Transport and production of simple fermentation products from sugars. Simple sugars are abundant in ethanol conversion residue and produced during complex carbohydrate hydrolysis. Sugars are therefore expected to be a major substrate for the microbiome. Despite the use of a yeast strain that was engineered for improved xylose utilization in the ethanol fermentation, xylose was the major abundant monosaccharide present in the remaining conversion residue (CR; FIGS. 6A-6C). As discussed above, the relative transcript levels of genes encoding extracellular GHs (see Scarborough and Lawson et al. 2018, which is incorporated herein by reference, at FIG. 3.S1) by several MAGs in the microbiome predict that additional pentoses and hexoses may be released through degradation of complex carbohydrates.

We therefore analyzed the genomic potential of the community to transport sugars, and metabolize them to fermentation products, particularly the known MCFA precursors lactate, acetate, and ethanol. To investigate the ability of the community to transport sugars, MAG ORFs were annotated with the Transporter Classification Database (Supplement 6). Expression of genes associated with the pentose phosphate pathway, phosphoketolase pathways, and glycolysis (see Scarborough and Lawson et al. 2018, which is incorporated herein by reference, at FIG. 3.4A) was analyzed to predict the potential for sugar metabolism within individual MAGs.

This analysis found that transcripts from genes encoding predicted carbohydrate transporters were among the most highly abundant mRNAs across the microbiome, accounting for 5.8% of the total transcripts. These putative transporters belonged to a variety of families, including many associated with the ATP-binding cassette (ABC) superfamily, and the phosphotransferase system (PTS) family (TD 4.A.-) (Scarborough and Lawson et al. 2018, which is incorporated herein by reference, at FIG. 3.S2). LCO1, LAC1, LAC2, and LAC3 are predicted to contain xylose transporters (XylT) (see Scarborough and Lawson et al. 2018, which is incorporated herein by reference, at FIG. 3.4A), while glucose (GluT), fructose (FruT), and other hexose transporters were expressed across the LAC, COR, and LCO MAGs (see Scarborough and Lawson et al. 2018, which is incorporated herein by reference, at FIG. 3.4A and FIG. S2). EUB1 only encoded transcripts encoding carbohydrate transporters for uptake of fructose and sucrose (see Scarborough and Lawson et al. 2018, which is incorporated herein by reference, at FIG. 3.S2). Overall, this analysis predicts that all MAGs have the potential to transport hexose sugars into the cell, while gene expression patterns observed for the LCO1 and the *Lactobacillus* MAGs (excluding LAC3) predicted that at the time of sampling they played a major role in pentose utilization in this microbiome.

We also analyzed the metatranscriptomic data to investigate potential routes for sugar metabolism. Once transported to the cytoplasm, glucose can be phosphorylated with hexokinase (HK) and converted to fructose-6-phosphate (F-6-P) by glucose-6-phosphate isomerase (GI). Transcripts encoding predicted HK and GI enzymes are abundant for all MAGs within the microbiome (see Scarborough and Lawson et al. 2018, which is incorporated herein by reference, at FIG. 3.4A), except LAC5 for which the assembly does not show homologues of these proteins. Fructose utilization starts with phosphorylation during transport (see Scarborough and Lawson et al. 2018, which is incorporated herein by reference, at FIG. 3.4A). Fructose-6-phosphate (F-6-P) is either phosphorylated to fructose-1,6-bisphosphate (F-1,6-BP) by phosphofructokinase (PFK) in glycolysis or is cleaved to acetyl-P (Ac-P) and erythrose-4-P (E-4-P) by phosphoketolase (PK). While LAC1, LAC2, LAC4, LAC5 and COR3 all lack homologues of genes encoding PFK (a highly-conserved glycolysis enzyme known to be a major target for regulatory control in hexose utilization),[29] they all contain transcripts for homologues of PK (FIG. 4a). In sum, these analyses predict that all of the abundant MAGs in this microbiome can utilize hexoses that may be produced during hydrolysis of complex oligosaccharides.

Transcripts predicted to encode enzymes to convert xylose to xylulose-5-phosphate, xylose isomerase (XI) and xylulose kinase (XK),[30] were abundant in most of the *Lactobacillus* MAGs and LCO1, and either absent or showed very low abundance in LAC3, EUB1 and the COR MAGs (see Scarborough and Lawson et al. 2018, which is incorporated herein by reference, at FIG. 3.4A). Once produced, xylulose-5-P can be degraded through either the phosphoketolase pathway or the pentose phosphate pathway. Transcripts from a gene predicted to encode the diagnostic enzyme of the phosphoketolase pathway, phosphoketolase (PK), which splits xylulose-5-P (X-5-P) into acetyl-P (Ac-P) and glyceraldehyde-3-P (G-3-P), were among the most abundant mRNAs in the *Lactobacillus* MAGs and is also present at high levels in LCO1, accounting for 1.5% of the total transcripts (FIG. 4a; Supplement 4). LCO1 and LAC1 also contained transcripts from homologues of all of the genes needed for the pentose phosphate pathway (RSPE, RSPI, TA, TK in FIG. 3.4A of Scarborough and Lawson et al. 2018, which is incorporated herein by reference). Overall, this analysis predicted that multiple routes of pentose utilization could be utilized by the MAGs in this microbiome.

The predicted routes for both hexose and xylose metabolism in this microbiome lead to pyruvate production (see Scarborough and Lawson et al. 2018, which is incorporated herein by reference, at FIG. 3.4A), so we also analyzed how this and other fermentation products might lead to MCFA production in this community. All MAGs contained transcripts encoding lactate dehydrogenase homologues (LDH) (see Scarborough and Lawson et al. 2018, which is incorporated herein by reference, at FIG. 3.4A), an enzyme which reduces pyruvate to lactate. Transcript analysis also predicts that all of the MAGs (except LAC3) can oxidize pyruvate to acetyl-CoA, utilizing either pyruvate dehydrogenase (PDH) or pyruvate flavodoxin oxidoreductase (PFOR) (see Scarborough and Lawson et al. 2018, which is incorporated herein by reference, at FIG. 3.4A). All MAGs (except EUB1) contain transcripts encoding homologues of acetate kinase (ACK), which converts acetyl-phosphate (Ac-P) to acetate while producing ATP (see Scarborough and Lawson et al. 2018, which is incorporated herein by reference, at FIG. 3.4A). Based on predictions of the gene expression data, the COR and LAC MAGs are also able to convert acetyl-CoA (Ac-CoA) to ethanol with aldehyde dehydrogenase (ADA) and alcohol dehydrogenase (ADH). In summary, analysis of the gene expression patterns in the conversion residue microbiome predicts that the MAGs in the LCO, LAC and COR ferment sugars to acetate and lactate, while the LAC and COR members produce ethanol as an additional fermentation product.

Elongation of fermentation products to MCFAs. Based on the above findings, we analyzed the microbiome gene expression data to predict which members of the microbiome had the potential for conversion of predicted fermentation products to MCFA. The Clostridia (LCO1 and EUB1) are the only MAGs that contained genes encoding homologues of genes known to catalyze chain elongation reactions in the reverse β-oxidation pathway (see Scarborough and Lawson et al. 2018, which is incorporated herein by reference, at FIG. 3.4B). Thus, the subsequent analysis is based on the prediction that only LCO1 and EUB1 are the major producers of MCFA in this microbiome. Furthermore, based on the analysis of sugar utilization above, we predict that LCO1 is the only microorganism in the community that can directly utilize sugars for MCFA production.

Acetate, lactate and ethanol, are all fermentation products that would require transformation to acetyl-CoA before being used as a substrate for elongation by the reverse β-oxidation pathway. Acetate could be converted to acetyl-CoA utilizing ATP via acetyl-CoA synthase (ACS) or the ACK and phosphate acetyltransferase (PTA) route (see Scarborough and Lawson et al. 2018, which is incorporated herein by reference, at FIG. 3.4B). Alternatively, acetate can be converted to acetyl-CoA with a CoA transferase (CoAT) which transfers a CoA from one carboxylic acid to another (e.g., from butyryl-CoA to acetate, producing butyrate and acetyl-CoA) (FIG. 4b). Genes encoding homologues of ACS and ACK were not found in EUB1, but LCO1 contained abundant transcripts that encoded homologues of both ACK and PTA (see Scarborough and Lawson et al. 2018, which is incorporated herein by reference, at FIG. 3.4A). Both MAGs also contained transcripts predicted to encode CoAT enzymes (see Scarborough and Lawson et al. 2018, which is incorporated herein by reference, at FIG. 3.4B). Taken together, this analysis predicts that acetate may be used as a substrate for MCFA production by LCO1 and EUB1.

Lactate has been proposed as a key intermediate in other microbiomes producing MCFA.[12] While transcripts encoding genes for lactate production were abundant in the microbiome (see Scarborough and Lawson et al. 2018, which is incorporated herein by reference, at FIG. 3.4A), lactate did not accumulate to detectable levels during steady operation, but transiently accumulated when the bioreactor received a higher load of conversion residue.[4] Transcripts for a gene encoding a predicted lactate transporter (LacT) were abundant in EUB1. In addition, the assembly of LCO1 did not reveal the presence of lactate transporter genes in this MAG, suggesting that only EUB1 may utilize the lactate produced by other MAGs. Neither EUB1 nor LCO1 accumulated transcripts encoding a predicted ADA homologue, which would be required for conversion of acetaldehyde to acetyl-CoA during utilization of ethanol (see Scarborough and Lawson et al. 2018, which is incorporated herein by reference, at FIG. 3.4B). This indicates that if ethanol is produced in this microbiome, it is not used as a significant substrate for MCFA production. Moreover, since ethanol did not accumulate in the reactor during either steady state operation (FIGS. 6A-6C) or after a high load of conversion residue,[4] we predict that ethanol is not a substrate for MCFA production in this microbiome. Rather, based on the predicted activity of LAC and COR MAGs producing lactate and that of EUB1 consuming lactate, we predict that lactate is a key fermentation intermediate for MCFA production.

Within the reverse β-oxidation pathway (FIG. 4b), a key enzyme is an electron-bifurcating acyl-CoA dehydrogenase (ACD) containing two electron transfer flavoproteins (EtfA, EtfB) that pass electrons from NADH to ferredoxin (see Scarborough and Lawson et al. 2018, which is incorporated herein by reference, at FIG. 3.4B).[31] This electron bifurcating complex has been recognized as a key energy conserving mechanism in strictly anaerobic bacteria and archaea[17,31] and studied in detail in butyrate producing anaerobes.[32,33] Transcripts for genes encoding a homologue of the acyl-CoA dehydrogenase complex (ACD, EtfA, EtfB) were abundant in both LCO1 and EUB1, as are those from other genes predicted to be involved in this pathway (see Scarborough and Lawson et al. 2018, which is incorporated herein by reference, at FIG. 3.4B). Chain elongation by the reverse β-oxidation pathway conserves energy by increasing the ratio of reduced ferredoxin (a highly electropositive electron carrier) to the less electropositive NADH.[1] In organisms that use this pathway, oxidation of ferredoxin by the RNF complex generates an ion motive force, and ATP synthase utilizes the ion motive force to produce ATP.[17] We found that transcripts for genes encoding homologues of all six subunits of the RNF complex were abundant in both EUB1 and LCO1 (RnfABCDEG, FIG. 3.4B in Scarborough and Lawson et al. 2018, which is incorporated herein by reference). To maintain cytoplasmic redox balance, reduced ferredoxin could transfer electrons to H⁺ via hydrogenase, generating $H_2$. LCO1 and EUB1, along with the COR MAGs, contained abundant transcripts for genes predicted to produce ferredoxin hydrogenase (H2ase, FIG. 3.4B in Scarborough and Lawson et al. 2018, which is incorporated herein by reference), supporting the hypothesis that $H_2$ production plays a role within this MCFA-producing microbiome. We also looked for two additional hydrogenases known to conserve energy either through the translocation of protons (EchABCDEF, FIG. 3.4B in Scarborough and Lawson et al. 2018, which is incorporated herein by reference) or by electron confurcation, utilizing electrons from both NADH and reduced ferredoxin (HydABC, FIG. 3.4B in Scarborough and Lawson et al. 2018, which is incorporated herein by reference).[17] It does not appear that these systems play a major role in $H_2$ production in this microbiome since none of the MAGs contained genes encoding homologues of the known components for either of these enzyme complexes (see Scarborough and Lawson et al. 2018, which is incorporated herein by reference, at FIG. 3.4B).

Thermodynamic Analysis of MCFA Production in the Microbiome

The above analysis predicted several potential routes for MCFA production by LCO1 and EUB1 in this microbiome. To evaluate the implications of these potential chain elongation routes, we used thermodynamic analysis to investigate the energetics of the predicted transformations. For this, we reconstructed metabolic pathways for xylose and lactate conversion, as well as ATP yields based on the data obtained from gene expression analyses (see Scarborough and Lawson et al. 2018, which is incorporated herein by reference, at Tables 3.1-2 and Supplementary Data File 7). Metabolic reconstructions considered xylose (see Scarborough and Lawson et al. 2018, which is incorporated herein by reference, at Table 3.1) and lactate (see Scarborough and Lawson et al. 2018, which is incorporated herein by reference, at Table 3.2) as major substrates for synthesis of C4, C6, and C8 products. In addition, both LCO1 and EUB1 have the potential to use a CoAT or a thioesterase (TE) as the terminal enzyme of the reverse β-oxidation pathway (see Scarborough and Lawson et al. 2018, which is incorporated herein by reference, at FIG. 3.4B), so we considered both possibilities in the thermodynamic analysis. We used these reconstructions to calculate the free energy changes of the overall biochemical reactions assuming an intracellular pH of 7.0, a temperature of 35° C., and $H_2$ partial pressures of $1.0 \times 10^{-6}$, 1.0, and 6.8 atm for low, standard, and high $H_2$ partial pressure, respectively. The low value is the approximate concentration of $H_2$ in water that is in equilibrium with the atmosphere and the high value is an expected maximum in a pressurized mixed culture fermentation system.[34] We also compared the efficiency of ATP production to an expected maximum yield of 1 ATP per –60 kJ energy generated by the overall chemical transformation.[35]

The use of xylose as the substrate (see Scarborough and Lawson et al. 2018, which is incorporated herein by reference, at Table 3.1, Eqs. 3-8) is possible for LCO1 but not EUB1, since the later MAG lacks genes to transport and activate xylose to xylulose-5-P (XylT, XI, XK, FIG. 3.4A in Scarborough and Lawson et al. 2018, which is incorporated herein by reference). Our analysis predicts that, with a pathway containing a terminal CoAT enzyme, the ATP yield (mol ATP mol⁻¹ xylose) does not increase if longer chain MCFAs are produced. However, if TE is used for the terminal step of reverse β-oxidation (see Scarborough and Lawson et al. 2018, which is incorporated herein by reference, at Table 3.1, Eqs. 6-8), the overall ATP yield is lower, but it increases with increasing product length, and C8 production provides a 17% increase in ATP yield versus production of C4. This suggests that LCO1 has no energetic benefit for producing C6 or C8 solely from xylose unless TE is used as the terminal enzyme of reverse β-oxidation. Additionally, the higher ATP yield of xylose conversion to C4 (see Scarborough and Lawson et al. 2018, which is incorporated herein by reference, at Table 3.1, Eqs. 3 and 6), in comparison to xylose conversion to lactate and acetate by other members of the microbiome (see Scarborough and Lawson et al. 2018, which is incorporated herein by reference, at Table 3.1, Eq. 2), may explain why LCO1 reached higher abundance in the microbiome compared to the other less abundant MAGs (LAC) that are predicted to ferment xylose to lactate and acetate (FIG. 7). In production of C4 and C8, no $H_2$ is predicted to be formed if a CoAT is utilized (see Scarborough and Lawson et al. 2018, which is incorporated herein by reference, at Table 3.1, Eqs. 3 and 5), whereas $H_2$ production is predicted when C6 is produced (see Scarborough and Lawson et al. 2018, which is incorporated herein by reference, at Table 3.1, Eq. 4). On the other hand, if a TE terminal enzyme is utilized for the reverse β-oxidation, $H_2$ is predicted to be produced for all carboxylic acid products.

Additional metabolic reconstructions analyzed the co-utilization of xylose with a monocarboxylic acid (see Scarborough and Lawson et al. 2018, which is incorporated herein by reference, at Table 3.1, Eq 9-18). This analysis predicted that co-metabolism of these substrates could provide an energetic advantage (i.e., higher mol ATP per mol of xylose) if $H_2$ is utilized as an electron donor. This suggests that $H_2$, produced by either EUB1 or COR MAGs (H2ase, FIG. 5a in Scarborough and Lawson et al. 2018, which is incorporated herein by reference), may be utilized by LCO1 to support MCFA production. If TE is used as the terminal enzyme of reverse β-oxidation (see Scarborough and Lawson et al. 2018, which is incorporated herein by reference, at Table 3.1, Eqs. 14-18), there is no increase in ATP yield versus utilization of xylose as the sole carbon source (see Scarborough and Lawson et al. 2018, which is incorporated herein by reference, at Table 3.1, Eqs. 6-8).

We also modeled MCFA production from lactate by EUB1, since the gene expression data suggested that EUB1 could transform lactate to MCFA. In models utilizing CoAT (see Scarborough and Lawson et al. 2018, which is incorporated herein by reference, at Table 3.2, Eq. 19-21) as a final step in MCFA production, the ATP yield increases as longer chain MCFA are produced, but the free energy released is near the expected limit for ATP production[35] under conditions of low $H_2$ partial pressure and below this limit at high $H_2$ partial pressures (see Scarborough and Lawson et al. 2018, which is incorporated herein by reference, at Table 3.2). If TE is utilized as a final step in MCFA production by EUB1 (see Scarborough and Lawson et al. 2018, which is incorporated herein by reference, at Table 3.2, Eq. 22-24), lower ATP yields are predicted, and in that case the production of longer chain MCFAs has a more pronounced effect on the ATP generated per mol of lactate consumed. For instance, production of C6 results in a 100% increase in the ATP yield compared to producing C4. However, each elongation step reduces the amount of energy released per mol ATP produced, such that production of C8 from lactate results in the release of –58 kJ per ATP produced under high $H_2$ conditions, which is near the expected limits for a cell to conserve chemical energy as ATP. Overall, the thermodynamic analysis does not unequivocally predict which terminal enzyme may be energetically more advantageous for MCFA production from lactate. While using TE would result in more favorable free energy release than when using CoAT, the predicted ATP yields are lower with TE than with CoAT. We also note that although CoAT transcript abundance was higher than TE transcript abundance (see Scarborough and Lawson et al. 2018, which is incorporated herein by reference, at FIG. 3.4B), expression alone cannot be used as a predictor of which terminal enzyme was primarily used since a kinetic characterization of these enzymes is not available. Regardless, the thermodynamic modeling predicts that, in all conditions, $H_2$ will be produced during lactate elongation (see Scarborough and Lawson et al. 2018, which is incorporated herein by reference, at Table 3.2), and that TE could be a better terminal enzyme to force production of longer chain acids in order to maximize ATP yield (see Scarborough and Lawson et al. 2018, which is incorporated herein by reference, at Table 3.2).

When modeling scenarios utilizing lactate plus carboxylic acids as growth substrates (see Scarborough and Lawson et al. 2018, which is incorporated herein by reference, at Table 3.2, Eqs. 25-36), their elongation by EUB1 would increase the amount of ATP it could produce compared to using lactate only if using a terminal CoAT (see Scarborough and Lawson et al. 2018, which is incorporated herein by reference, at Table 3.2, Eqs. 19-21). $H_2$ production or consumption is not predicted in these scenarios, and the calculated free energy released per mol of ATP produced (−50 to −53 kJ mol$^{-1}$ ATP) is low, near the physiological limit of −60 kJ mol$^{-1}$ ATP for energy conservation by the cell. Models with TE as the terminal enzyme in reverse β-oxidation were also analyzed (see Scarborough and Lawson et al. 2018, which is incorporated herein by reference, at Table 3.2, Eqs. 31-36) even though EUB1 is not predicted to have this ability as it lacks ACS and ACK needed to utilize acetate (see Scarborough and Lawson et al. 2018, which is incorporated herein by reference, at FIG. 3.4B). In such models, producing C6 and C8 from lactate plus acetate (see Scarborough and Lawson et al. 2018, which is incorporated herein by reference, at Table 3.2, Eqs. 32-33) is energetically favorable, whereas C4 production is not (see Scarborough and Lawson et al. 2018, which is incorporated herein by reference, at Table 3.2, Eq. 31).

Discussion

Figure 9:
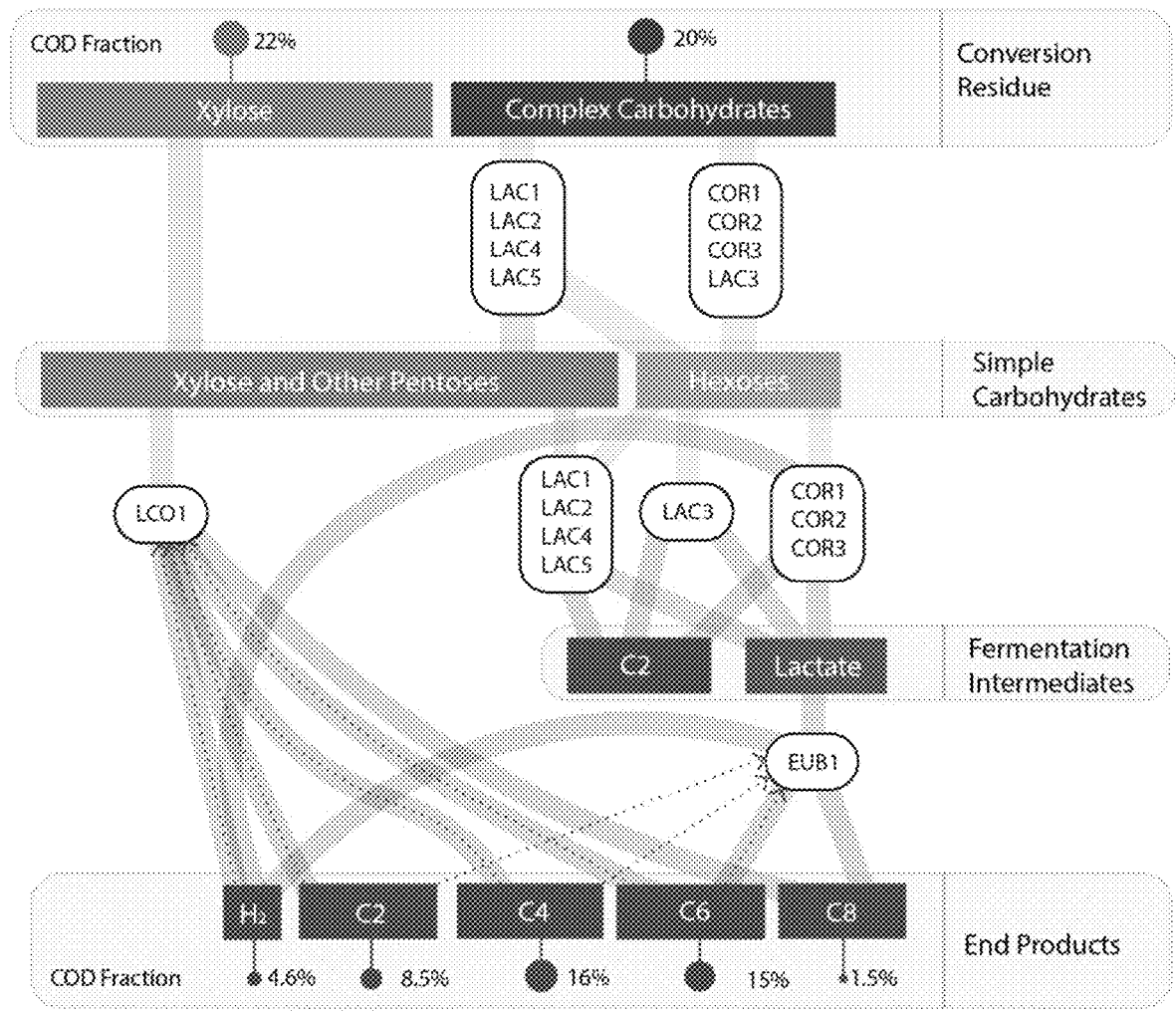
FIG. 9. Predicted transformations of major substrates in conversion residue to medium-chain fatty acids (MCFAs) by this anaerobic microbiome. The microbes in the LAC and COR bins are predicted to produce sugars from complex carbohydrates. Simple carbohydrates, including xylose remaining in conversion residue, are converted to lactate and acetate by *Lactobacillus* (LAC) and Coriobacteriaceae (COR) MAGs. The Lachnospiraceae (LCO1) MAG converts pentoses directly to butyric acid (C4). The Eubacteriaceae (EUB1) produces hexanoic acid (C6) and octanoic acid (C8) from lactate. Further, LCO1 may utilize hydrogen to elongate C2 and C4 to MCFAs, as represented by dashed lines. Additionally, EUB1 may elongate C2, C4 and C6 to C8.

In this example, we illustrate how combining genomic, computational and thermodynamic predictions can illustrate how a microbial community can convert organic substrates in lignocellulosic conversion residues into MCFAs (FIG. 9). Specifically, this approach predicts that the coordinated and step-wise metabolic activity of different members of this microbiome allow cleavage of complex five- and six-carbon containing polysaccharides; conversion of sugars into simple fermentation products; and utilization of sugars and intermediate fermentation products for MFCA production. This approach further predicts the role of intracellular and extracellular reductants in these processes. Below, we illustrate the new insight that has been gained on the activity of a MCFA producing microbiome and how this might relate to other systems.

Our data suggest that the contribution of *Lactobacillus* in this microbiome is in extracellular carbohydrate degradation and subsequent metabolism of pentose- and hexose-containing carbohydrates, while Coriobacteriaceae are predicted to metabolize hexose-containing carbohydrates. The combined metabolic activities of these two MAGs would produce oligosaccharides and monomeric sugars that would become available to these and other members of the microbiome. Metabolic reconstruction combined with microbiome transcript levels also suggest that the *Lactobacillus* and Coriobacteriaceae MAGs produce fermentation end products, primarily lactate and acetate, from these carbohydrates. Coriobacteriaceae, however, are also predicted to produce $H_2$. In addition, microbiome gene expression patterns indicate that two MAGs, EUB1 and LCO1, produce MCFA via reverse β-oxidation. LCO1 is predicted to consume xylose based on gene expression analysis, whereas RNA abundance measurements indicate that EUB1 consumes lactate.

We used thermodynamics to analyze hypothetical scenarios of MCFA production by EUB1 and LCO1. Although the comparison of these hypothetical scenarios did not provide an unequivocal answer to how chain elongation occurs in LCO1 and EUB1, it is helpful to generate hypotheses that could eventually be tested in future research. Our thermodynamic analysis predicts that the most energetically advantageous metabolism for LCO1 (based on ATP production per mol xylose consumed) is the consumption of xylose, $H_2$ and carboxylates to produce C4, C6, and C8 while utilizing CoAT as a terminal enzyme. While xylose is a major component of conversion residue (CR, FIGS. 6A-6C), $H_2$ is expected to be produced by Coriobacteriaceae MAGs and EUB1. For EUB1, which is expected to utilize lactate, our analysis predicts that production of MCFA produces higher amounts of ATP, with C6 resulting in a 2-fold increase in ATP production versus producing C4 when consuming lactate as a sole substrate.

Predictions from our thermodynamic modeling indicate that C8 production from lactate is energetically advantageous. However, this is at odds with C6 being produced from conversion residue at higher concentrations than C8 (FIGS. 6A-6C). It is known that C8 is a biocide, so it may be that C8 accumulation is limited by the level of tolerance community members have for this product.[12] It is also possible that higher C6 production indicates a more important role of C6 production by LCO1 without lactate being an intermediate metabolite. It has also been shown that removal of C8 allows for higher productivities of carboxylate platform systems.[1]

$H_2$ production and interspecies $H_2$ transfer are known to have significant impacts on the metabolism of microbial communities.[36] Our analysis predicts a role of $H_2$ in supporting chain elongation in a carboxylate platform microbiome. While high $H_2$ partial pressures are proposed to inhibit production of acetate and other carboxylic acids,[37,38] organisms that use the phosphoketolase pathway (the *Lactobacillus* and LCO1 MAGs identified in this example) can produce C2, C4 and C8 without producing $H_2$ (see Scarborough and Lawson et al. 2018, which is incorporated herein by reference, at Table 3.1, Eqs. 2, 3 and 5). While conversion of lactate to MCFA (see Scarborough and Lawson et al. 2018, which is incorporated herein by reference, at Table 3.2, Eqs. 19-24) is predicted to produce $H_2$, other processes such as co-utilization of xylose and a monocarboxylic acid for MCFA production (see Scarborough and Lawson et al. 2018, which is incorporated herein by reference, at Table 3.1, Eq. 9-18) would consume $H_2$. Therefore, $H_2$ accumulation is not expected to limit production of MCFA, although $H_2$ partial pressures may influence the metabolic routes utilized by the microbiome.

In considering how to further improve the production of MCFA with a microbiome, additional work is needed to characterize and engineer reverse β-oxidation proteins from the *Firmicutes* in order to improve production of organic acids longer than C4. Further, our data predict that the terminal enzyme of reverse β-oxidation can influence production of MCFA. While a CoAT enzyme results in higher ATP production, a TE makes production of MCFA more energetically advantageous by increasing the ATP yield for production of C6 and C8 compared to C4 (see Scarborough and Lawson et al. 2018, which is incorporated herein by reference, at Tables 3.1-2). Therefore, engineering chain-elongating organisms to only have a TE rather than CoAT may improve production of MCFAs.

Our metabolic reconstructions predict that lactate was a key fermentation product that supports MCFA production. Therefore, strategies to enhance lactate production and minimize other fermentation products (fermentation of carbohydrates to lactate, rather than acetate in this example), could improve production of desired end products. Moreover, designing strategies to enrich a community that produces a critical intermediate like lactate by one pathway (e.g., homofermentative lactate-producing Lactobacilli, rather than hetero-fermenters producing both lactate and C2) could improve performance of the microbiome. However, the principles controlling the presence or dominance of heterofermentative versus homofermentative organisms in microbial communities remain largely unexplored. Alternatively, higher production of a desired product, C8, could be achieved by adjusting the abundance or establishing a defined co-culture containing a lactic acid bacterium capable of complex carbohydrate degradation, such as LAC1, and a lactate-elongating organism, such as EUB1. The ability to establish defined synthetic communities, to adjust the abundance of microbiome members or to regulate the metabolic routes within the microbiome may allow more control over the function of a microbiome for production of MCFA or to optimize other traits.

In summary, this example demonstrates that one can dissect and model the composition of microbiomes as a way to understand the contribution of different community members to its function. In the case of an anaerobic carboxylate platform microbiome fed lignocellulosic ethanol conversion residue, two Clostridia-related organisms (EUB1 and LCO1) are predicted to be responsible for production of MCFA via reverse β-oxidation. This provides a genome-centric rationale for the previously established correlation between Clostridia-related abundance and MCFA production noted in carboxylate platform systems.[4,12] This example further predicts that the terminal enzyme in product synthesis and the fermentation end products produced by other community members can play a role in determining predominant products of this microbiome. These approaches, concepts and insights should be useful in predicting and controlling MCFA production by reactor microbiomes and in analyzing the metabolic, genomic and thermodynamic factors influencing the function of other microbiomes of health, environmental, agronomic or biotechnological importance.

Methods

Production of conversion residue. Switchgrass used to generate conversion residue was treated by ammonia fiber expansion and enzymatically treated with Cellic CTec3® and Cellic HTec3® (Novozymes) to digest cellulose and hemicellulose (to glucose and xylose, primarily).[39] Hydrolysate was fermented with Saccharomyces cerevisiae Y128, a strain with improved xylose utilization.[40] Fermentation media was distilled to remove ethanol.[4]

Bioreactor operation. The bioreactor was seeded with acid digester sludge from the Nine Springs Wastewater treatment plant in Madison, Wis. The retention time of the semi-continuous reactor was maintained at six days by pumping conversion residue into the reactor, pumping reactor effluent from the reactor once per hour, and maintaining a liquid volume of 150 mL in the reactor. The reactor was mixed with a magnetic stir bar. The temperature of the reactor was controlled at 35° C. using a water bath, and the pH of the reactor was maintained at 5.5 by feeding 5M KOH through a pump connected to a pH controller. This reactor sustained MCFA production for 252 days.[4]

Metabolite analysis. Samples from the bioreactor and conversion residue were collected for metabolite analysis. All samples were filtered using 0.22 µm syringe filters (ThermoFisher Scientific SLGP033RS, Waltham, Mass., USA). Chemical oxygen demand (COD) analysis was performed using High Range COD Digestion Vials (Hach 2125915, Loveland, Colo., USA) per standard methods.[41] Soluble carbohydrates were measured with the anthrone method.[42] Glucose, xylose, acetic acid, formic acid, lactic acid, succinic acid, pyruvic acid, glycerol and xylitol were analyzed with high performance liquid chromatography and quantified with an Agilent 1260 Infinity refractive index detector (Agilent Technologies, Inc. Palo Alto, Calif.) using a 300×7.8 mm Bio-Rad Aminex HPX-87H column with Cation-H guard (BioRad, Inc., Hercules, Calif.). Acetamide, ethanol, n-propionic acid, n-butyric acid, iso-butyric acid, n-pentanoic acid, iso-pentanoic acid, n-hexanoic acid, iso-hexanoic acid, n-heptanoic acid, and n-octanoic acid were analyzed with tandem gas chromatography-mass spectrometry. An Agilent 7890A GC system (Agilent Technologies, Inc. Palo Alto, Calif.) with a 0.25 mm Restek Stabilwax DA 30 column (Restek 11008, Belefonte, Pa.) was used. The GC-MS system was equipped with a Gerstel MPS2 (Gerstel, Inc. Baltimore, Md.) auto sampler and a solid-phase microextraction gray hub fiber assembly (Supelco, Bellefonte, Pa.). The MS detector was a Pegasus 4D TOF-MS (Leco Corp., Saint Joseph, Mich.). Stable isotope labeled internal standards were used for each of the analytes measured with GC-MS.

DNA and RNA sequencing. Biomass samples, consisting of centrifuged and decanted 2 mL aliquots, were collected at Day 12, Day 48, Day 84, Day 96, and Day 120 of reactor operations from initial start-up. Samples were also taken at 96 days and flash-frozen in liquid nitrogen for RNA extraction. For DNA extraction, cells were lysed by incubating in a lysis solution (1.5M sodium chloride, 100 mM trisaminomethane, 100 mM ethylenediamine (EDTA), 75 mM sodium phosphate, 1% cetyltrimethylammonium bromide, and 2% sodium dodecyl sulfate(SDS)), lysozyme (Thermo Fisher Scientific, MA, USA), and proteinase K (New England Biolabs, MA, USA). We then added 500 µL of a 24:24:1 solution of phenol:chloroform:isoamyl alcohol and bead-beat samples for 2 minutes. After bead-beating, biomass was centrifuged at 5,000 rcf for 3 minutes and the entire supernatant was transferred to a 1.5 mL centrifuge tube. Samples were centrifuged again at 12,000 rcf for 10 minutes and the aqueous layer was then removed to a new centrifuge tube. A second phase separation was then performed using chloroform. After centrifuging again and separating the aqueous phase, 500 µL of isopropanol was added to each samples and samples were then incubated at −20 deg C. for 24 hours. Following this incubation, samples were centrifuged at 12,000 rcf for 30 minutes at 4 deg C., decanted, and washed with 70% ethanol. After air-drying the samples, pellets were resuspended in 100 µL of TE buffer and 2 µL of 10 mg/mL RNAse was added to each sample. Samples were incubated for 15 minutes at 37 deg C. We then added 100 µL of a 24:24:1 solution of phenol:chloroform:isoamyl alcohol to each sample and centrifuged at 12,000 rcf for 10 minutes. We separated the aqueous phase to a new centrifuge tube and added 100 Ul of chloroform. Again, samples were centrifuged at 12,000 rcf for 10 minutes and the aqueous phase was separated to a new centrifuge tube. We then added 10 μL of 3M sodium acetate and 250 μL of 95% ethanol to each sample and incubated for 24 hours at −20 deg C. Samples were centrifuged at 12,000 rcf for 30 minutes at 4 deg C. and the pellets were washed with 70% ethanol. After air-drying, pellets were resuspended in 50 uL of TE buffer. After re-suspending the DNA, quantity, purity, and quality were assessed with a Qubit 4 Fluorometer (Thermo Fisher Scientific, MA, USA), a Nanodrop 2000 spectrophotometer (Thermo Fisher Scientific, MA, USA), and gel electrophoresis.

For RNA extraction, cells were lysed by incubating in a lysis solution (20 mM sodium acetate, 1 mM EDTA, and 0.5% SDS prepared in diethylpyrocarbonate-treated water (Invitrogen, Calif., USA)) and TRIzol (Invitrogen, Calif., USA). The treated cells were subjected to 2 minutes of bead beating using Lysing Matrix A (MP Biomedicals, Calif., USA). After this step, successive phase separations with phenol:chloroform:isoamyl alcohol and chloroform were used to separate nucleic acids from additional cell material, as described above. RNA was further purified with an RNEasy Mini Kit (Qiagen, Hilden, Germany) and on-column DNAse 1 (Qiagen, Hilden, Germany) treatment. After re-suspending the RNA, quantity, purity, and quality were assessed with a Qubit 4 Fluorometer (Thermo Fisher Scientific, MA, USA), a Nanodrop 2000 spectrophotometer (Thermo Fisher Scientific, MA, USA), and gel electrophoresis. RNA samples were submitted to the University of Wisconsin Gene Expression Center for quality control with a Bioanalyzer (Agilent, Calif., USA), ribosomal RNA reduction with a RiboZero-Bacteria rRNA Removal Kit (Illumina, Calif., USA) with a 1 μg RNA input. Strand-specific cDNA libraries were prepared with a TruSeq RNA Library Prep Kit (Illumina, Calif., USA).

DNA and RNA were sequenced with the Illumina HiSeq 2500 platform (Illumina, Calif., USA). For DNA, an average insert size of 550 bp was used and 2×250 bp reads were generated. For RNA, 1×100 bp reads were generated. Raw DNA and cDNA reads can be found on the National Center for Biotechnology Information (NCBI) website under Bio-Project PRJNA418244.

Metagenomic assembly, binning, and quality control. DNA sequencing reads were filtered with Sickle using a minimum quality score of 20 and a minimum sequence length of 100.[43] Reads from all five samples were then co-assembled using metaspades and kmer values of 21, 33, 55, 77, 99, and 127.[44] Binning of assembled contigs was performed with MaxBin v2.2.1.[45] The quality, completeness, and contamination of each bin was analyzed with CheckM v1.0.3.[46] Read mapping was performed with BBMAP v35.92 (sourceforge.net/projects/bbmap) to estimate the relative abundance of each bin. Relative abundance was calculated by normalizing the number of mapped reads to the genome size.

Phylogenetic analysis. Phylogeny of the draft genomes was assessed using 37 universal single-copy marker genes with Phylosift v1.0.1.[47] In addition to the draft genomes, 62 publicly-available genomes of related organisms were used to construct a phylogenetic tree. Concatenated amino acid sequences of the marker genes were aligned with Phylosift, and a maximum likelihood phylogenetic tree was constructed with RAxML v8.2.4 with the PROTGAM-MAAUTO model and 100 bootstraps.[48] ANI calculations were performed using JSpecies.[49]

Genome annotations. Draft genomes were annotated with MetaPathways v2.5.[23] Open reading frames (ORFs) were predicted using Prodigal v2.0,[50] and the ORFs were annotated with the following databases: SEED (accessed March 2013), Clusters of Orthologous Groups (COG, accessed December 2013), RefSeq (accessed January 2017), Metacyc (accessed October 2011), and KEGG (accessed January 2017). The LAST algorithim was used for assigning functional annotations.[51] Functional annotations for each MAG are provided in Scarborough and Lawson et al. 2018, which is incorporated herein by reference, at Supplementary Data File 4. Draft genomes were further annotated with the CAZY database.[24] CELLO was used to determine the subcellular location of the CAZYs.[25] Transporters were identified using the Transporter Classification Database.

Transcript analysis. Analysis of transcript data was performed as described in Lawson, et al.[52] cDNA reads were quality filtered as described above for DNA. SortMeRNA was used to remove rRNA sequences using multiple databases for RNA sequences.[53] The remaining non-rRNA sequences were then mapped back to the draft genomes using BBMap v35.92 (sourceforge.net/projects/bbmap) with the minimum sequence identity set to 0.95. Ambiguous reads with multiple top-hit mapping locations were assigned to a random ORF. The number of RNA reads mapping to each ORF was calculated with htseq-count v0.6.1 with the "intersection-strict" parameter.[54] Relative gene expression (RPKM) was calculated for each ORF by normalizing the number of mapped RNA reads for each ORF to the ORF length and the total number of RNA reads mapping back to the genome. The relative RPKM (relPKM) was then calculated as the ratio of the RPKM for the ORF to the median RPKM across the draft genome. Finally, the $\log_2$(relRPKM) was calculated to determine the log-fold difference. As such, a positive number corresponds to greater than median expression levels and a negative number to expression below median levels.

REFERENCES

1. L. T. Angenent, H. Richter, W. Buckel, C. M. Spirito, K. J. J. Steinbusch, C. M. Plugge, D. Strik, T. I. M. Grootscholten, C. J. N. Buisman and H. V. M. Hamelers, Environ. Sci. Technol., 2016, 50, 2796-2810.
2. M. T. Holtzapple and C. B. Granda, Appl. Biochem. Biotechnol., 2009, 156, 95-106.
3. S. Sarria, N. S. Kruyer and P. Peralta-Yahya, Nat. Biotechnol., 2017, 35, 1158-1166.
4. M. J. Scarborough, G. Lynch, M. Dickson, M. McGee, T. J. Donohue and D. R. Noguera, Biotechnology for Biofuels, 2018, 11, 200.
5. M. T. Agler, C. M. Spirito, J. G. Usack, J. J. Werner and L. T. Angenent, Energy Environ. Sci., 2012, 5, 8189.
6. S. Ge, J. G. Usack, C. M. Spirito and L. T. Angenent, Environ Sci Technol, 2015, 49, 8012-8021.
7. T. I. M. Grootscholten, D. P. B. T. B. Strik, K. J. J. Steinbusch, C. J. N. Buisman and H. V. M. Hamelers, Applied Energy, 2014, 116, 223-229.
8. T. I. M. Grootscholten, F. K. dal Borgo, H. V. M. Hamelers and C. J. N. Buisman, Biomass & Bioenergy, 2013, 48, 10-16.
9. L. A. Kucek, J. J. Xu, M. Nguyen and L. T. Angenent, Front. Microbiol., 2016, 7.
10. S. J. Andersen, P. Candry, T. Basadre, W. C. Khor, H. Roume, E. Hernandez-Sanabria, M. Coma and K. Rabaey, Biotechnol Biofuels, 2015, 8.
11. B. Y. Xiong, T. L. Richard and M. Kumar, J. Membr. Sci., 2015, 489, 275-283.

12. S. J. Andersen, V. De Groof, W. C. Khor, H. Roume, R. Props, M. Coma and K. Rabaey, *Front Bioeng Biotechnol*, 2017, 5, 8.
13. W. R. Kenealy, Y. Cao and P. J. Weimer, *Appl. Microbiol. Biotechnol.*, 1995, 44, 507-513.
14. L. A. Kucek, M. Nguyen and L. T. Angenent, *Water Res.*, 2016, 93, 163-171.
15. X. Zhu, Y. Tao, C. Liang, X. Li, N. Wei, W. Zhang, Y. Zhou, Y. Yang and T. Bo, *Sci. Rep.*, 2015, 5, 14360.
16. W. Han, P. He, L. Shao and F. Lu, *Appl. Environ. Microbiol.*, 2018, DOI: 10.1128/AEM.01614-18.
17. W. Buckel and R. K. Thauer, *Biochim. Biophys. Acta*, 2013, 1827, 94-113.
18. C. M. Spirito, H. Richter, K. Rabaey, A. J. Stams and L. T. Angenent, *Curr. Opin. Biotechnol.*, 2014, 27, 115-122.
19. X. Zhu, Y. Zhou, Y. Wang, T. Wu, X. Li, D. Li and Y. Tao, *Biotechnol Biofuels*, 2017, 10, 102.
20. R. Nelson, D. Peterson, E. Karp, G. Beckham and D. Salvachúa, *Fermentation*, 2017, 3, 10.
21. M. Kim, H. S. Oh, S. C. Park and J. Chun, *Int. J. Syst. Evol. Microbiol.*, 2014, 64, 1825-1825.
22. M. Kraatz, R. J. Wallace and L. Svensson, *Int. J. Syst. Evol. Microbiol.*, 2011, 61, 795-803.
23. K. M. Konwar, N. W. Hanson, M. P. Bhatia, D. Kim, S. J. Wu, A. S. Hahn, C. Morgan-Lang, H. K. Cheung and S. J. Hallam, Bioinformatics, 2015, 31, 3345-3347.
24. V. Lombard, H. Golaconda Ramulu, E. Drula, P. M. Coutinho and B. Henrissat, *Nucleic Acids Res.*, 2014, 42, D490-495.
25. C. S. Yu, Y. C. Chen, C. H. Lu and J. K. Hwang, *Proteins*, 2006, 64, 643-651.
26. J. V. Zurawski, P. A. Khatibi, H. O. Akinosho, C. T. Straub, S. H. Compton, J. M. Conway, L. L. Lee, A. J. Ragauskas, B. H. Davison, M. W. W. Adams and R. M. Kelly, *Appl. Environ. Microbiol.*, 2017, 83.
27. T. Sakamoto and J. F. Thibault, *Appl. Environ. Microbiol.*, 2001, 67, 3319-3321.
28. M. Abdullah and D. French, *Arch. Biochem. Biophys.*, 1970, 137, 483-&.
29. R. S. Ronimus and H. W. Morgan, *Extremophiles*, 2001, 5, 357-373.
30. V. B. Lawlis, M. S. Dennis, E. Y. Chen, D. H. Smith and D. J. Henner, *Appl. Environ. Microbiol.*, 1984, 47, 15-21.
31. J. K. Demmer, N. Pal Chowdhury, T. Selmer, U. Ermler and W. Buckel, *Nat Commun*, 2017, 8, 1577.
32. F. Li, J. Hinderberger, H. Seedorf, J. Zhang, W. Buckel and R. K. Thauer, *J. Bacteriol.*, 2008, 190, 843-850.
33. E. H. Aboulnaga, O. Pinkenburg, J. Schiffels, A. El-Refai, W. Buckel and T. Selmer, *J. Bacteriol.*, 2013, 195, 3704-3713.
34. S. de Kok, J. Meijer, M. C. van Loosdrecht and R. Kleerebezem, *Appl. Microbiol. Biotechnol.*, 2013, 97, 2617-2625.
35. W. Buckel and R. K. Thauer, *Bba-Bioenergetics*, 2013, 1827, 94-113.
36. A. J. Stams and C. M. Plugge, *Nat. Rev. Microbiol.*, 2009, 7, 568-577.
37. F. Zhang, Y. Zhang, M. Chen, M. C. M. van Loosdrecht and R. J. Zeng, *Biotechnol. Bioeng.*, 2013, 110, 1884-1894.
38. J. Rodriguez, R. Kleerebezem, J. M. Lema and M. C. M. van Loosdrecht, *Biotechnol. Bioeng.*, 2006, 93, 592-606.
39. V. Balan, B. Bals, S. P. S. Chundawat, D. Marshall and B. E. Dale, *Biofuels: Methods and Protocols*, 2009, 581, 61-77.
40. L. S. Parreiras, R. J. Breuer, R. Avanasi Narasimhan, A. J. Higbee, A. La Reau, M. Tremaine, L. Qin, L. B. Willis, B. D. Bice, B. L. Bonfert, R. C. Pinhancos, A. J. Balloon, N. Uppugundla, T. Liu, C. Li, D. Tanjore, I. M. Ong, H. Li, E. L. Pohlmann, J. Serate, S. T. Withers, B. A. Simmons, D. B. Hodge, M. S. Westphall, J. J. Coon, B. E. Dale, V. Balan, D. H. Keating, Y. Zhang, R. Landick, A. P. Gasch and T. K. Sato, *PLoS One*, 2014, 9, e107499.
41. W. E. F. American Public Health Association, and American Water Works Association Standard Methods for the Examination of Water and Wastewater: 21st Edition, American Public Health Association, 2005.
42. E. W. Yemm and A. J. Willis, *Biochem. J.*, 1954, 57, 508-514.
43. Joshi, N. A., & Fass, J. N. (2011). Sickle: A sliding-window, adaptive, quality-based trimming tool for FastQ files (Version 1.33).
44. S. Nurk, D. Meleshko, A. Korobeynikov and P. A. Pevzner, *Genome Res.*, 2017, 27, 824-834.
45. Y. W. Wu, B. A. Simmons and S. W. Singer, *Bioinformatics*, 2016, 32, 605-607.
46. D. H. Parks, M. Imelfort, C. T. Skennerton, P. Hugenholtz and G. W. Tyson, *Genome Res.*, 2015, 25, 1043-1055.
47. A. E. Darling, G. Jospin, E. Lowe, F. A. t. Matsen, H. M. Bik and J. A. Eisen, *PeerJ*, 2014, 2, e243.
48. A. Stamatakis, *Bioinformatics*, 2014, 30, 1312-1313.
49. M. Richter, R. Rossello-Mora, F. Oliver Glockner and J. Peplies, *Bioinformatics*, 2016, 32, 929-931.
50. D. Hyatt, G. L. Chen, P. F. Locascio, M. L. Land, F. W. Larimer and L. J. Hauser, *BMC Bioinformatics*, 2010, 11, 119.
51. S. M. Kielbasa, R. Wan, K. Sato, P. Horton and M. C. Frith, *Genome Res.*, 2011, 21, 487-493.
52. C. E. Lawson, S. Wu, A. S. Bhattacharjee, J. J. Hamilton, K. D. McMahon, R. Goel and D. R. Noguera, *Nat Commun*, 2017, 8, 15416.
53. E. Kopylova, L. Noe and H. Touzet, *Bioinformatics*, 2012, 28, 3211-3217.
54. S. Anders, P. T. Pyl and W. Huber, *Bioinformatics*, 2015, 31, 166-169.

Example 3. Refinement of Metagenomes

Background and Results

Figure 10:
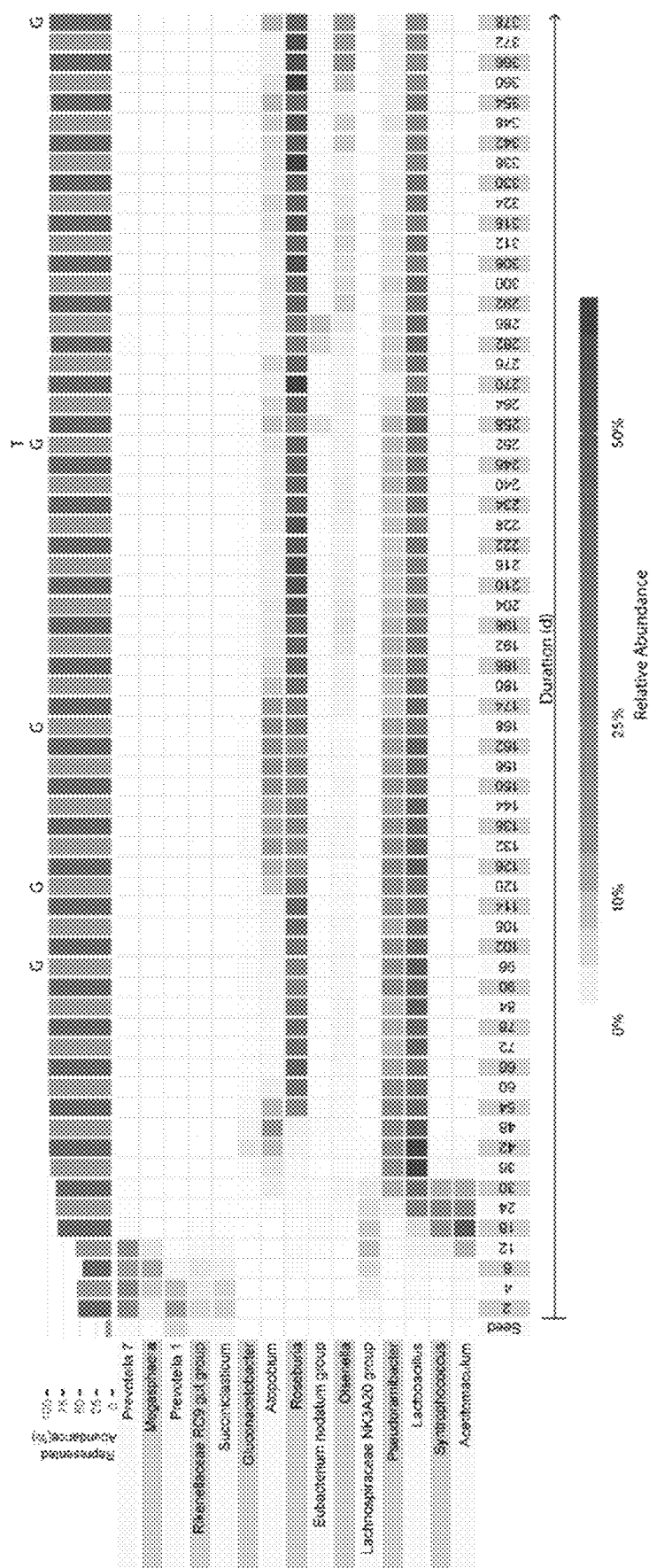
FIG. 10. Relative abundance of bacteria in the bioreactor based on 16S rRNA gene amplicon sequencing. The first column shows results from the acid digester sludge ("seed") used for reactor inoculum. The duration after starting the bioreactor is shown on the x-axis and genera names are provided on the y-axis. The bar plot above the heatmap shows the sum of abundance represented in the heatmap. Colors in the heatmap indicate relative abundance with higher abundance indicated by red color intensity. Samples corresponding to metagenomic and metatranscriptomic samples analyzed in this study are shown with "G" indicating a metagenomic sample and "T" indicating the time point used for the time-series metatranscriptomic analysis.
Figure 11:
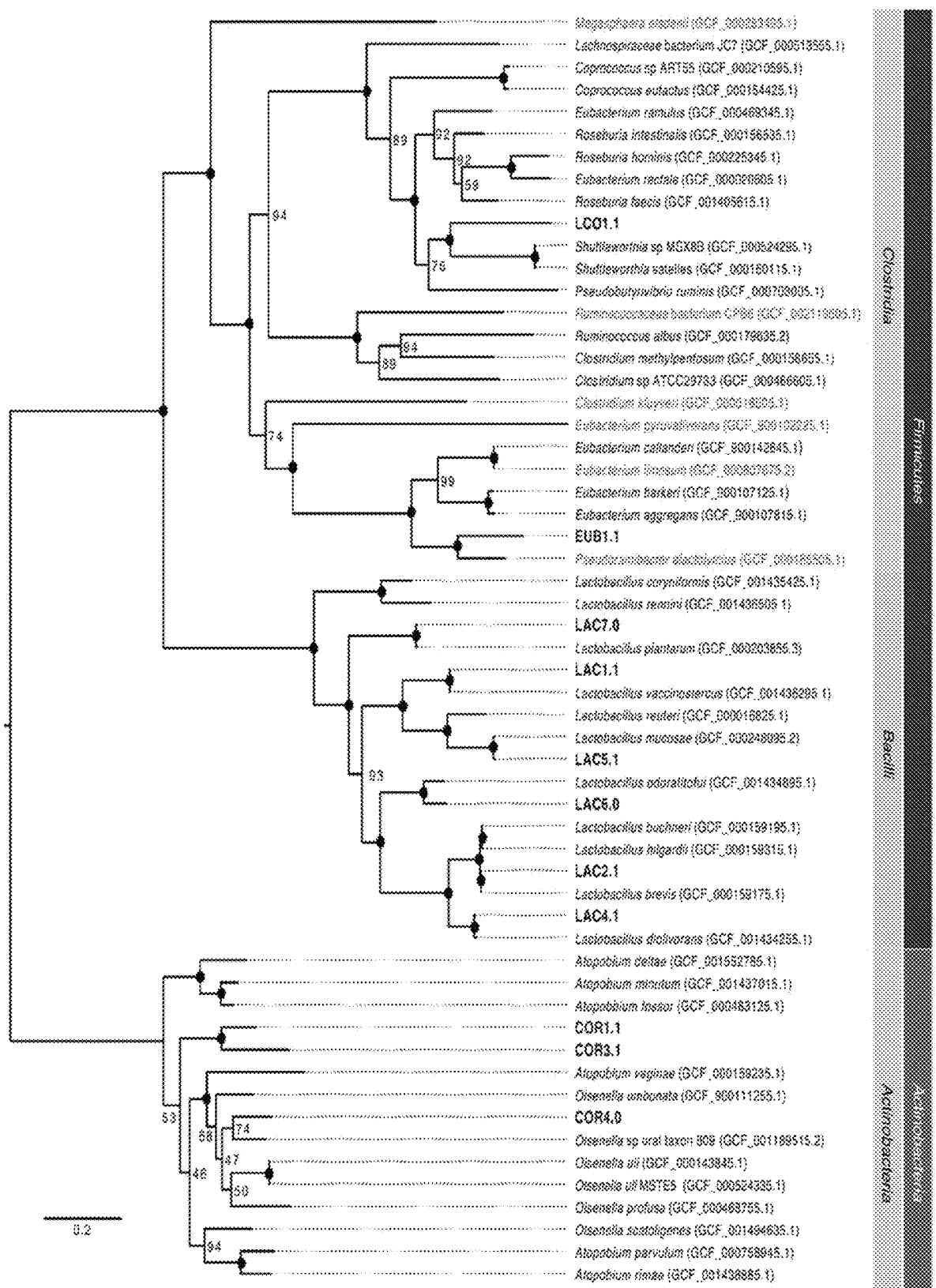
FIG. 11. Phylogenetic tree of the 11 MAGs in the bioreactor at 252 days. Reactor MAGs are shown in bold text. Known hexanoic and octanoic acid producers are shown in red. Bootstrap support values based on 100 bootstraps are shown at tree nodes with filled circle indicating support values of 100.

The examples above report the construction of metagenome-assembled genomes (MAGs) from a MCFA producing microbiome receiving lignocellulosic biorefinery residues, in which LCO1 and EUB1 were the abundant chain elongating MAGs.+ These MAGs were constructed using DNA samples from the first 120 days of reactor operation. To improve the quality of these MAGs, we used additional Illumina and PacBio sequencing reads obtained from the same reactor microbiome at different times during a 378-day operational period. Using metaSpades,[2] we co-assembled 244 million Illumina Hi-seq (2×250) reads from five time points (Days 96, 120, 168, 252, and 378; FIG. 10) into 24,000 contigs. Contigs were binned into 27 draft MAGs with Anvi'o.[3] Bins were gap-filled with the PacBio reads from the 378 d sample using PBJelly.[4] We estimated the quality and phylogeny of the bins with CheckM.[5] This analysis resulted in an improvement in MAG quality with respect to completeness, contamination, and number of contigs (Table 5). Based on DNA read mapping normalized to genome size for Day 252 (the day we conducted our gene expression analysis), eleven MAGs were more than 1% abundant. Similar to our prior study, the bins were named according to a phylogenetic analysis (FIG. 11) that showed that MAGs were related to *Lachnospiraceae* (LCO), *Eubacteriaceae* (EUB), *Coriobacteriaceae* (COR), and *Lactobacillus* (LAC).

TABLE 5

Summary of metagenome-assembled genomes and the relative abundance in the reactor at day 252. Number in brackets indicate values for previously developed MAGs.[1]

| Name | Relative Abundance (%) | Completeness (%) | Contamination (%) | Genome size (Mbp) | No. scaffolds |
|---|---|---|---|---|---|
| LCO1.1 | 75.3 | 96.9 [95.4] | 0.5 [0.0] | 2.39 [2.10] | 10 [44] |
| EUB1.1 | 4.7 | 99.2 [97.8] | 0.2 [0.2] | 2.29 [2.00] | 29 [35] |
| COR1.1 | 2.4 | 95.0 [99.2] | 6.7 [0.8] | 2.41 [2.51] | 82 [225] |
| COR3.1 | 2.8 | 98.4 [98.4] | 2.4 [7.4] | 3.02 [3.65] | 134 [533] |
| COR4.1 | 1.1 | 100 [NA][1] | 0.7 [NA][1] | 2.45 [NA][1] | 8 [NA][1] |
| LAC1.1 | 3.8 | 99.5 [99.5] | 1.1 [1.1] | 2.77 [2.63] | 9 [18] |
| LAC2.1 | 2.0 | 99.4 [99.4] | 1.6 [1.6] | 3.18 [3.18] | 37 [79] |
| LAC4.1 | 1.6 | 97.7 [98.9] | 0.6 [1.3] | 3.14 [3.35] | 53 [95] |
| LAC5.1 | 2.5 | 99.2 [80.1] | 0.0 [0.8] | 2.11 [1.48] | 6 [181] |
| LAC6.1 | 1.9 | 99.1 [NA][1] | 1.1 [NA][1] | 2.80 [NA][1] | 12 [NA][1] |
| LAC7.1 | 2.0 | 99.1 [NA][1] | 2.8 [NA][1] | 3.41 [NA][1] | 33 [NA][1] |

The LC01.1, EUB1.1, COR1.1, COR3.1, LAC1.1, LAC2.1, LAC4.1, and LAC5.1 MAGs, represented the same organisms that were represented with the LCO1, EUB1, COR1, COR3, LAC1, LAC2, LAC4, and LAC5 MAGS at the 96-day timepoint. The COR4.1, LAC6.1, and LAC7.1 MAGs represented new Coriobacteriaceae (COR4.1) and *Lactobacillus* (LAC6.1 and LAC7.1) organisms now abundant at >1% at the 252-day timepoint. The COR2 and LAC3 MAGs, which were abundant at >1% at the 96-day timepoint, were no longer abundant at greater than 1% at the 252-day timepoint.

REFERENCES

1. M. J. Scarborough, C. E. Lawson, J. J. Hamilton, T. J. Donohue and D. R. Noguera, *mSystems,* 2018, DOI: 0.1128/msystems.00221-18.

2. S. Nurk, D. Meleshko, A. Korobeynikov and P. A. Pevzner, *Genome Res.,* 2017, 27, 824-834.

3. A. M. Eren, O. C. Esen, C. Quince, J. H. Vineis, H. G. Morrison, M. L. Sogin and T. O. Delmont, *PeerJ,* 2015, 3, e1319.

4. A. C. English, S. Richards, Y. Han, M. Wang, V. Vee, J. Qu, X. Qin, D. M. Muzny, J. G. Reid, K. C. Worley and R. A. Gibbs, *PLoS One,* 2012, 7, e47768.

5. D. H. Parks, M. Imelfort, C. T. Skennerton, P. Hugenholtz and G. W. Tyson, *Genome Res.,* 2015, 25, 1043-1055.

SEQUENCE LISTING (745 sequences)

SEQ ID NO: 1 - DNA, 41746 bp, Unknown
  Metagenome-assembled genome
agaactgactcacctcctcttgctccgtcctctctacctttgttactcgcccatccaatttggaagcttcctccgcgcgtttcccgattcttcgtctgtgcatacccatcatcccctgaagcaccgttggggtggttttctttctctgctcttgctttctgattctgcccccttcggtgacccaattgaccatattctggataggctttcttgtacgtccgtgagggatttcattttctttaaatcattaggtcttgaaacggtaacctgtgacccttcaccttgatatccatctcctgcgaagagtcttctcaagtgttgcccttaggacctttttaccggtcacatattattttcttggcaacattgaccgtaactccgctggtatttgtcgattggtcattcttccaattcgtgacatgcccggacctccattaaaaggttgttacttaaagttattaaaattaccaaacaaatgcgagaactttcaaccgccgccttctccttacgagcctgcttgtctgtgatgattcccttgtttgtagaaagcatatgcgatttccaagtccgccagaacgctgggattcttccttaccatcgtaaatacgaagaccttgcttagatattctcttgatgcctgagatgatacgatccttctttgctccagtgtacttcatggtaacaggatgtcttatatgaaccctcatcaacaagcctcatacttctcgatgtatccctcatcctacaaggatctgcaatagcgaccttcatcttggatgcaggacatctactgtatcgtgtttcgcagtgttcgcattacggattcttgtaagcatatctgcgataggatcagtcattgtcatgattattttccttccataataaatatctgtttcacaaacggcttaccagaatgccttgcggagcaccagggatttctcccttataagcgagctcacgaagcagactctgcagatgccgtacttacaagtactgagtgcggacggccgcagatcttgcaggtgtgtatgctctcgtagatactttggcttacgctgctgtttaactttcattgatttcttagccatataaatctccttattacttagcgaacggcattccgaaaaggcggagaagttctcttcttgcttcctcgtcagtctttgctgttgtaacaaaaatgacgtccattcctcttactttgtctaccttatcgtactcgatctctgggaaaatgatctgctctttgatcccaagtgcataatttcctctgccatcgaatgaatcaggtttgacgccatgaaatctcttactcgtggaagtgcgaggtttacaagtctgtcaaggaaatcatacatcttgtcgccacgaagtgttggtcttgcagccgagcccattccctcacggatcttgaagtttgcaacggatttcttggctcttgttattactgcatgctgacctgtgatagcttccataatcagctactgcagactcgagaaccttctggttctcttttgcttcgccgacaccatgttttacgacaatctttacgagctttggaacttccataacgttcttgtagccgaacttgtcagtcatggctttggcgatttcattattaatactgttcttttaatctgctcacgaaactaacctcggtctagtcctattgtctcgccggtggccttagcgtagcggactttcttgtccccatccatcttgaagccaacgcgggttgctttaaccatttactaaaagcataacctttgagatatcgataggaggcttcttcctctacgatgccgcctgcctggtttgccatatttggcttaacatgcttctttaccatgtttacgccttcaacggtgactttacgattcttaggatctacagcctttacttttcccctctgcttcttgtcggcgccgaaaaacacgaactgtgtccacccttctttatcttcaaacttgccatcggtttcctccttaaagtgtctcagtagcagggaaacgatcttcatgaactgcttatcacgaagctctcttgctactgggtccaaatatacgggttcctttcggagtcttgtccctcattgatatgactgctgcattctcatcgaacttgatgtagctgccatccttagatgaacgcccttaactgttcgaacgataacacctttacaacgtcgccctttttcacaacgccgccgtgttgcatccttgactgaagcaactactatatctccgatatcggcatatctcctgtcgatccgccattgacacggattgtgaggagctctttggcaccggtgttgtcggcaaccctaagtctggtttcctgctgtaccataataattcctcgctttctttacttagcacgctcaattatatcgacgagtctccatctcttgttctttgacagaggtctggtctccatacgcggactctatcgccctcgtgagcgtcattattctcatcatgagccataagttttgtatgtcctcttaacgatcttttccataaagaggattccttacgttatctcttaccgcaacggtgatggtcttgtccatcttatcggataccacgattccggtagggtctttctaagatttcctctcttccattattaaagcctttctctaattcacccgtttactggttactcatctgtgtaagaaccgtctgaatacgagcaatgttacgacgaacatctttgattctagcgtattgtcaagctgattagtcgcattctggaatcttaagttaaaagttctttcttagcgtctgtaagctttgctgaaagctcatcggctgactggccttttaattcttcgatataatccttagttttcatctgcttcatcaccgccttctaagccttcacgggcaacgatcttgcacctgcatggaagttttatgtccggcaagtctgagtgcctcttttgctgattcttcagacacacctgtgatctcgaaaagaacacgggcccggcttaacaactgctacccagtaatcaagggcgcctttccggaacccattcgtgtctcagccgctttgctgtaaccggtgatctggaatactttgatgaaaacttttccgccacgcttcacataacgagtcatggctacacgggctgcctcaagctgattggccttgatccagcatgggtcaaggcttacgagaccgtaatcaccctgagtgaccttatttccacgtaatgcctttcctgcgagtgaaccgcggaactgcttacgatgcttaacctcttagggcattaacatatcagttttctaccctccttctggcctgggcttttctctttgctaggaaaacctcgcccttgtagatccatacctttacaccggactttaccataagtgggatctgcctctgcaaaaccatagtcgatatcagcacggatagtctgagtggaatagttttccttcgttatagctctctgttctggccgatatcagcaccaccaacacgtcctgagcagcttgtcttgataccctgaatgcctgtcttcattgaacggctgatgcagctcttcatagcacgacggaaagaaatacggttctcaagctgtgaagcgatgttctcggcaacaagctgtgcgtcacgatccgacgcttaacttctttacgtctactacaagcttcttgtttgtaagcttctgaagctctgcctaaccttctctatccagctccgccttttccgattacaacaccagctttgctgtgtaaaccacggccttaacacggtcgctggctctctcgatctcgatcttcgaaactcctctgaataaagcttcttcttaaggaattcacgatcttgtgatcttcaccgaataatctggcaaattctttgtcagcgtaccactttgagtcccagtcatcgatacgccgactcttaagccatgcggattaaccttctgtcccattgtattcctccttatttctcatccagtacaacagtaatgtgactcattctcttctcaatcctaaaagcgcgtccctgtgctctagctggatacgcttcatgataggtcccctgatttgcgtagccactctgctacgtaaaggttctcctcttctgagtccgttgttgttctctgcattggcaattgctgaacgcataattttctctaaacgctggatgcatatctcggattatactggacaatagcaagtgctgtatttacgtcctttccgcggatggcatctaatacaaagcaggccttctgtaccgacattcttgcaaagaaagctttgcagatggtcttaaatctttctgatcgttttctctcacgcttaaacctgggttctatgtcccttagccatgaagaatcctcctttcttatgcttaaaaattactgaacgccggtcttcttctcgtctttgccgtggccccgtattgtactgggtagcaacgaactcgccgagcttatgacctaccatatcttctgtgatgtaaccggaacatgctttctgccgtcatgacccgatcgtatgtcccacaaatgatgggaagatcgtcgaacggcgggaccatgtcttgataactgacttaatcaccgctggcgttcatagcatcgatcttctttaataaactctgatcggcaaatggtccttttttaagtgaacgtgccatagaatcctccttactttaatcccttaccgctttcttcttctgatgatcagcttgttcgaagccttatgcttatttctggtcttaagaccaagagccggcttaccccaaggagtgctcgggccaggacgtccaactggaccttaccttcaccaccaccatgtggatggtcgttagggttcatgactgatccacgaactgtaggacggattcccatgtgtctgatcttcgctttaccatattttaccagtgagtgatcaccgttttccatgatacctattgtagcacggcagttcagaagaacgagtctcatctcgcctggaaaaagacgaagtgtagcgtacttaccttccttagcccatcagctgtgctgcatttccagctgcacgaaccatctggccaccctttccaggataaagcctcgatgttgtgaaccatagtaccgataggaatctttgaaagaggaagtgagtttacctacacgaacctctgcgttctcaccgctcataacgtcatgccgtctgtgaggtccctcttggcgaggatgtatgacttcgttccatcagcatagctgacagagcgatgttttggctgtacggttttggatcatactcgatccaactactttgcagggatgtcatccttctgtctcttgaaccgatgattctgtatttctgacgattccggccgccgtgatgacgaaaccgtgatcttaccctggttgtttgacggcctggaattcttttttctttcaatccagtaatgacttctcaggtgtcttctttgtaatctctttgaagtctgagcttgtcatatttcttctggaaggtgtgatatgcgttgatgacttgatgcccattttttctcctttcgaaatgtttttgttatccctctttcctgagtataataggttttcttttcgtttaagctcacgctgcactgtccctttgcgttcgctaatctcaagaacggcccatcgcttcggattcaactgcgccttcggcttgtttcatcctcgaagctttcggtccaaagtcctgcgaataactcgtaccttttttgttttgatcagctgtaagctttacgatagccttctgttgtagctgctgggctttccaactgtagtcaccacggccgctgtgtcttgccctggttgttatcgggtgaacactagctaccttaaccgcatcgaacatcgtctcaacacatccgttatctggaacttgttagcttccgatgaactaagaaggtgtactttttgtgatctgtcgttgtctgacacagacttctcagtaacgactggtcttatgaacagcgtatatgacgcactgaagttttgacacagtaatccttactcagatgcagctgtggggaggggggatcaaagaagagaggagttacgcataatgagcgacagtgaattactcatgacccttgatcataagccctttattcttacttagaagtctatgttaaaacgacagattaaaagacacttattagttcatccgaagcaacaagtgtccatataaaggattctgtgaagaagatgttcgatggcgttaggtagctagttgttcacacgatcaacaaccaggggtcaagaacaagccgccgtggtgctatcagttttgggaaagacagcaagctacaaataggctatcgttaaaggcttacagctgattcacaggataatcgagttattcgcaggactttgatgaacgaaagcttcgatatgaaaacaagccgaaggtcgcagtttgaatcgaagcgaggccgttctttgagattatcgaacgcagaagacagtgcagcgtggagcctttaccgaaagactacatattatactcagtgaaagagtgataaacaaaacatttcgaaaggaagaaaaaatggtaatcagtcatttcaacgccatatacaccttccagaaagaaatatgaacaagctcagacttcaagagaattacaacggacacctgagaagtcattactcctggatgtacagaaaaagaattcccggccgtaacaacaggtcagatcacggttcgtcatcactgcggcggcaatcgtcataaatacagaaatcaatcgatttcaagagacagaaggatgaactcctgcaaaggtagtgtggaatcagtagaaactccaaaccgtacatcaaacatcgctctgtaagcttatgctgatggaccggggaaaaatcatacatcctcgcccagacggcactcacagacgaacttaccgtcatgagcggtgaaacgccgaggttcggtgtaggtaactcacttcctctttcaaaattcctacgttacatggttcacaccatcgagctttaatccgggaaagggtggccagatggttcgggcagctggaaatgcagcaccgctgatgctaaggaaggtaagtacgcctacctacttcgtcttccttcatgcgagatgaactcgttctcgaactctgccgtgctacaataggtatcatcggaaacggtgatcactcacttgtaaaatatggtaaagctggaaagaatcagacacttggaccgtcctacagttcgtggatcagtcatgacccctaacgaccatccacatgggggtgtgaaggtaaggctccagtggacggtcctggcccgagcactcttggggtaaagcccggcctcttggtttaagaccagaaataagcataaggcttcgaacaatctgatcatcagaagaataaacggtaagggattaacgtaaggaggatctatggggccgttcccttaaaaaaggaccatttgccgatcagagtttattaaaaaaaaagatcgtgctatgaactccatccgtggataagtcaggtgatcacgacaggtccccgccgcgttcgacgatcttcccatcatttgtgggacatacgatcgctgtcatgacggccgaaagcaatgtttcggtttacatcacagaagatatgtaggtcataagctcggctagttcgttgctacccgtacatacaggggccacggcaagacgagaagaagactgcgttcagtaaaatttttaagcatagaaaggaggattttctatcatgctaggacatagaacccaggttcagcgtgatagacacgatcgaagatttcagaccatctgcaaagctttcttttgcaagaatttcggtaacagaatcctgcctttgtagtagaatccatccgcgaaagactaaatacagcactccagcacttgctatgtccagtataatccgagatatgcatccagcgtttatagagaaacttctgcgttcattcaattgcaatgcagaaacaacacggactagaataagaaacctttacgtagcagagtggcacgcaaatcagggacctatcatgaacgtatccttccagcctagagcacagggactcgcattacaggattgagagagatgagtccacattactgttgtactggaggagaataatgcggtacaaggggacagaaggtttaatccgcatgcttaagagtcgggcgtctcgatgtactgggactcaagtggtacgctgacaacgaattgcagattatcttcgttgacgatcacacgattgcgtgaattccttaagaagaagctttattcagcaggagtttttcgaaatcgagatcgagagagccagcgccgtgtaaggcgttgtttacacaacaaagcctggtgttgtaatcggaaaagcggagctgagatgaggaaggttaaggcagagctcagaagcttacaaccacagaagcttgtagtagacgtaaggcagtttaagcgtcgtccggatcgtgacgcacagccttgtttgccgagaacatcgcgtcacgcttgagaccgtattgtctttcgcgttccgttcgttgctaatgaagagctgcatcagccgtttcaatgaagacggcattcagggtatcaagacaagctctcagacgtcttggtggtgctgatatcgccagaactagagctataaacgaaggaactattcacttcagactatccgtgctgatatcgactatgttttcagaggccagtcaccattatggtaaaagtcggtgtaaaggtatggactacagggcgaggttctcctagcaagagaaagctccaggcagaagaggtagaactgctatgttaatgcctaagagagttaagcatcgtaagcagttccgcggttcactcgcagtgaaagcattacgtggaaataaggtcactcagggtgatcggtctcgtaagccgtgacccatgctgatcatcaaggccaatcagcttgaggcagcccagcccgtgtagcccatgactcgttaatttaacgtgcgaaagttttcatcaaatacttcccagatcacccgtttttttacagcaagcggctgagacacgatgggtttcctaaaaggcgcgcccttgcttactggtagcagttgtttaaagcgggccgtgttcttttcgtatcacaggtgtgtctgaaaatcacaaagggcactcagacttgccggacataaacttccatgcagggtggcaagatcgtatgccggaagctttagaaggcggtgaagcatatgaaaactaaggattatatcgaagaattaaaggccagtccgcccgatgagctttcagcaaagcttacagacgctaagaaagacttttttgaacttaagattccagaatgcgacatcagcttgacaatcagctagaatcaaagagttcgcgtcgtaaccttgctcgtattcagactgttcttacacagggagtaacccgtaacggtgattagagaaaggctttaataatggaagagagaaatcttagaaagacccgtaccggaatcgtgtatccgatagatggacagaccatcacgttggctggtaatagataacgtccgacaacctctttatgaaagatcgttaagagtgagaaggccttccctacaacttatttcttcatgatgcataaatattgacgctcactaagggcgatagatccgcgtaatggaagaccagacctctgtcaagaacaagagatggagactcgtcgatataattgatcggtgctaagtaacgaagcgaggaattttttggtacagcaggaaaccagcttgggtggccgacaacacaggtccaagatctcctcacaatccgtgtcatgggcggatcgaccaggagatatgccgatatcgagatataaagtagttgcttcagtcaggatgcaacacccggtgtgggcggcgcgttgtgaaaagggcgacgttgtaaaggctgttatcgtttcgaacagttaagggcgttcatcgtaagtatggcatctacatcaagttcgatgagaagcagcagtcattatcaactgatgacaagactccgaaatgacccgtatatttggaccagtagcaagaggcttcgtgataaagcagttcatgaagatcgtttcccttgctcctgagacactttaaggaggaaaccgatggcaagtttgaagataaagaagggtgacaacagttcgtgttatttccggcgcccgacaagaacgcagatggaaaagtaaaggctgtagatcctaagaatcgtaaaagtcaccgttgaagcgtaaacatggtaaagaaagaagcatgtaagccaatatgcaaccaggcaggcgcatcgtaagaggaagaagctcctatcgaatctcaagttatgcttttaagtaaatggtaagcacccgcgttggcttcacgatggatggggacaagcacgtccgctacgctaaaggccccaccggcgagacaatagactagacccggaggttagtttcgtgagcagattacaagaacagtataataagaaatcgccaagccatgatgacgaagttcggctaccataacgttatggaaggttctgccaaagctcgtaaagattgtcgacacatgggtggtcggcgaagcaaaagagaaccagaaggttctcgagtctggcagtagctgtatggaagctagcacaggttaaagcatgcagtaataacaagagccaagaacttccgttgcaaacttcaagatatccgtgagggatgggcatctggctgcaagacaacactttcgttgcgacaagatgtatgatttttccttgacaacgttaaaccctcgcacttccacgattaagcgagatttccatggcgtcaacctgattcattcgatggcagaggaaattatgcacttggtatcaagagcagatcctttttcccagagatcgagtacgataaggtttaacaaagtcaagagggaatgggacgtcattgttgggttacaaacagcaaagatgacgaggaacaagagaacgtctccgccttttcggatgccgttcccccctaagtaatagggctttataaagatggctaagaaattaatgaaagttttaaacagcacgtacagccaaagtattctacgagagcatacaccctgcagatctctgcggcccagtccgcacatcagtacttcgtaagttacggcatctggccgagtcgcttccgtgagctcgcttatacgggagaaatccctggtgtccgcaaggcatcatggtaagccgtttgtgaaacatattttattatggaggcaataaatcatgacaatgactgatcctatcgcagatatgccttacaagaatccgtcaatcgaaccctgcgaaacaacgatacagtaatacccgcatccaaagataatggtcgctatggcagatatccggtgtagatgagggatacatcgagacgtatagcttgttgattagggtttcatataagaagaacatccatttaccatgaagtacactggatgcaaagaaggatcgtatcctcatcaggcctcaagagaatctcctaagcccaggtcttgtatttacgcttggtaaggaagacatcccagcgttcttggcggacttgaatgcgctattctttcttcctagcaaacaagggaatcatcacagacaagccagtctcgtaaggagaaggtcgcggtgaagttctcgcatttgtttgttaattttatataacttaagctaacaacttttaatggaggtacgggatttccgaattggaagatgccaatcgcataccagccgtatttacggtcaatgtgcaaaataatcatgtgacgggtaaaggtcctaagaagggcaacacttgagaagactctttcctcatgaatggatatcaaggtttgaagggtcacagtttaccgtttccagacctaatattaaagaaaatgaaagcccttcacggacttacaagaagccttatccagactaatgtgtaattggcgtccacagaagttctagaagaagctcgagatcaacggtgtcggtatcgtgctgagagaagggcaaggttcttactcttcaccttggcttctctccccggtaaaacgctaactccatctggatcagtcatctctaccggtgagagaaccaaggtgaagagtagaaccttgccctcttctcagcacgataactaccgttgatctcgcgcttcttctcgaaaccttctgtgacgccaattaccatttctggatcaaggcttcttgtaagtccgtgaaggatttccttttctttaatcattagggctgaaacggtaactgtgacccttcaaccttgatatccatctcctgggaagagtcttctcagtggtgcccttaggaccttttaccgtcacatgcttttttcctgcacattgaccgtaactccggctggtattgcgttggcattcggccaattcgtgacatgccctacctccattaaaagtgttagcttaagttatataaattaccaaacaatgcagataaaacttcaccgccgaccttctccttacgagcctgcttttgtctgtgatgattcccttgtttgtataaagatagcgattccaagtccgccaagaacgcttgggaatgtcttccttacatcgtaaatacgaagacctggcttagctattctcgtgatgcctgagatgatacgatccttctttgctccagtggtactatgggaacatggatgttcttatatgacccctcataacaagctcatacttctcgatttatccctcatcacaaggataatctgcaatagcgcccttcattcttggatgcagggatatctactggatcgtgttttcgcagtgtcgcattacggatcttgtaagcatatctcgatagatcagtcattgtcatgatttatttcctccataatcaaatctgtttcacaaacggcttaccaatgatgccttggcgtacaccagtgatttctccttataatcgagctcacggaacagactcggcatgccgtacttacgagtattttggctgagtgcggacgcccgcagatcttgcagcgtgtgtatgctctcgtaaaatactttggcttacgctgctgtttcaactttcttgatttccttccatatcactccttattaacttatcgaacggcattccgaaaagggcggagagttctcttgcttcctcgtcagtctttgctgttgtaacacaaattacgtccattcctcttactttgtctaccttatcgtactcgatctctgggaaatgatctgctctttgataccaagttgcataatttcctctgccatcgaatgaatcagggtgacgccatgaaaactcttactcgtgagtgcgaggtttacaagtctgtcaaggaaatcatacatcttgtgcgcacgaaagtgtttgtcttgcagccgatgcccattcctcccggatcttgaagtttgcaacggattttggctcttgttattacctgctgacctgtgatagcttccaatattcagctactgcagatcgagaccttctggttctcttttgcttcgccgacacccaggtttactgacatctttacgaagcttttggaacttccataacgttcgttgtagccgaacttgtcattcatggcttggcgattttcattcttaataatttgctgtttcttttaatctgctcacgaaactaaccctccgtctagtcctattgtctcgccggtggccttagcgtagcggactttctgtccccatcactttaagccaacgcgggttgggctttaccatttactaacataccctttgagatatcgataggagtctttcttcctcgacgatgccgcctgcctggtttgccatatttggctctaacatgcttctttaccatgttacgccttcaacggtgactttacgattcttaggatctacagcctttacttttccctctgcgttctgtcggcgccggaaataacacgaactgtgtcacccttctttatcttcaaacttgccatcggtttcctccttaagtgtctcaggagcaagggaaacgatcttcatgaactgcttcacgaagctctcttgctactggtccaaatatacgggttcctttcggagtcttgtcctcattgataatgactgctgcattctcatcgaacttgatgtagctgccatccttacgatgaacgcccttaactgttcgaacgataacagcctttacaacgtcgccctttttcacaacgccgccggggtgttgcatccttgactgaagcaactactatatctccgatatcggcatatctcctggtcgatccgccatgacacggattgtgaggagctctttggcaccggtgttgtcggcaaccctaagtctggtttcctgctgtaccataataattcctcgctttctttacttagcacgctcaattatatcgacgagtctccatctcttgttctttgacagaggttggtctccattacgcggactctatcgccctcgtgagcgtcattattctcatcatgagccataagtttgtatgtctcttaacgatctttccataaagaggatgtcttacgttatctttaccgcaacggtgatggtcttgtccatcttatcggataccacgattcggtacgggtctttctaagatttctctcttccattattaaagcctttctctaatcaccgttactggttactcatctgtgtaagaaccgtctgaatacgagcaatgttacgacgaacatctttgattctagctgtattgtcaagctgattagtcgcattctggaatcttaagttaaaaagttctcttagcgtctgtaagctttgctggaagctcctggctgactggccttttaattcttcgatataatccttagttttcatctgcttcaccgccttctaagccttcacgggcaacgatcttgccactgcataggaagtttatgtccggcaagtctgagtgcctcttttgtgattcttcagacacacctgtgatctcgaaaagaacacggcccggttaacaactgctacccagtaatcaagggcgccttttccggaacccattgtgtctcagccggctttgctgtaaccgggtgatctgggaatactttgatgaaaacttttccgccacgctcacataacgagtcatggctacacgggctgcctcaagctgattggccttgatccagcatgggtcaaggcttacgagaccgtaatcacctgagtgaccttatttccacgtaatgcctttcctgcgtgaaccgcggaactgcttacgatgcttaactctcttaggcattaacatatcagtttctacctccttctgcctgggctttcttcttgctaggaagaacctcgcccttgtagatccatacctttacaccgactttaccataagtggtatctgcctcgcaaaaccatagtcgatatcagcacggatagtctgaagtggaatagttccttcgttatagctctctgttctggcgatatcagcaccaccaagacgtcctgagcagcttgtcttgatacctgaatgcctgtcttcattgaaaggctgatgcagctcttcatagcacgacggaagaaaatacggttctcaagctgtgaagcgatgttctcggcaacaagctgtgcgtcacgatcggacgcttaacttcctttacgtctactacaagcttcttgtttgtaagcttctgaagctctgccttaaccttctctatctcagctccgccttttccgatacaaaaccaggcttgctgtgtaaacaacggccttaacacggtcgctggctctctcgatctcgatcttcgaaactcctgctgaataaagcttcttcttaaggaattcacgaatcttgtgatcttcaacgagataatctgcaaattctttgtcagcgtaccactttgagtcccagtcatcgataacgccgactcttaagcatgcggattaaccttctgtcccattgtattcctcctttttctcatccagtacaacagtaatgtgactcattctcttctcaatcctgtaagcgcgtccctgtgctctaggctggatacgcttcatgataggtccctgatttgcgtagcactctgtgtaaaggttctctcttctgagtccgttgttgttctctgcattggcaattgctgaacgcagaagtttctctataacgcggatgcatatctcggattattggacaatagcaagtgctgtatttacgtcctttccgcggatggcatctaatacaaagcaggccttctgtaccgacattcttgcaaaagaaagctttgcagatggtcttaaatctttctgatcgtttctctcacgcttaacctgggttctatgtcccttagccatgatagaaatcctcctttcttatgttaaaaattactgaacgccggtcttctctcgtctttgccgtggcccctgtatgtacgggtagcaacgaactcgccgagcttatgacctacatatcttctgtgatgtaaaccggaacatgctttctgccgtcatgaacagcgatcgtatgtcccacaaatgatgggaagatcgtcgaacggcgggaccatgtcttgataactgacttatcaccgtgggttcatagcctcgatcttctttaataaactctgatcggcaaatggtccttttttaagtgaacgtgccatagaatcctccttactttaatcccttaccgtttcttcttctgatgatcagcttgttcgaagccttatgcttatttctggtcttaagaccaagagccggctaccccaaggagtgctcgggccaggacgtccaactggagccttaccttcaccaccaccatgtggatggtcgttagggttcatgactgatccacgaactgtaggacggattcccatgtgtctgattcttccagctttaccatattttacaaggagtgatcaccgtttccgatgatacctattgtagcacggcagttcagaagaacgagtctcatctcgcctgaaggaagacgaagtgtagcgtacttaccttccttagccatcagctgtgctgcatttccagctgcacgaaccatctggccaccctttccaggataaagctcgatgttgtgaaccatagtaccgataggaatctttgaaagaggaagtgagttacctacacgaacctctgcgttctcaccgctcataagcgtcatgccgtctgtgagtccctctggtgcgaggatgtatgacttcgttccatcagcatagctaacagagcgatgtttgctgtacggtttggatcatactcgattccaactacttgcagggatgtcatccttctgtctcttgaaatcgatgattctgtattctgacgattgcgccgccgtgatgaccatccctgcaaaggtagttggaatcgagtatgatccaaaccgtacagcaaacatcgctctgttaagctatgctgatggaacgaagtcatacatcctcgcaccagagggactcacagacggcatgaccgttatgagcggtgagaacgcagaggttcgtgtaggtaactcacttcctctttcaaagattcctatcggtactatggttcacaacatcgagctttatcctggaaagggtggccagatggttcgtgcagctggaaatgcagcacagctgatggctaaggaaggtaagtacgctacacttcgtcttccttcaggcgagatgagactcgttcttctgaactgccgtgctacaataggtatcatcggaaacggtgatcactcacttgtaaaatatggtaaagctggaagaatcagacacatgggaatccgtcctacagttcgtggatcagtcatgaaccctaacgaccatccacatggtggtggtgaaggtaaggctccagttggacgtcctggcccgagcactccttggggtaagccggctcttggtcttaagaccagaaataagcctaggcttcgaacaagctgatcatcagaagaagaaacggtaagggattaaaaagtaaggaggattctatggcacgttcacttaaaaaaggaccatttgccgatcagagtttattaaagaagatcgatgctatgaacgccagcggtgataagtcagttatcaagacatggtcccgccgttcgacgatcttcccatcatttgtgggacatacgatcgctgttcatgacggcgcagaaagcatgttccggtttacatcacagaagatatggtaggtcataagctcggcgagttcgttgctacccgtacatacaggggccacggcaaagacgagaagaagaccggcgttcagtaattttaagcataagaaaggaggatttctatcatggctaagggacaagaacccaggttaagcgtgagagagaaacgatcagaaagatttaagaccatctgcaaagctttcttttgcaagaatgtcggtacagaaggcctgctttgtattagatgccatccgcggaaaggacgtaaatacagcacttgctattgtccagtataatccgagatatgcatccagcgttatagagaaacttctgcgttcagcaattgccaatgcagagaacaacaacggactcagaagagagaacctttacgtagcagagtgctacgcaaatcagggacctatcatgaagcgtatccagcctagagcacagggacgcgcttacaggattgagaagagaatgagtcacattactgttgtactggatgagaaataaggaggaatacaatgggacagaaggttaatccgcatggcttaagagtcggcgttatcgatgactgggactcaaagtggtacgctgacaaagaatttgcagattatctcgttgaagatcacaagattcgtgaattccttaagaagaagctttattcagcaggagtttcgaagatcgagatcgagagagccagcgaccgtgttaaggccgttgtttacacagcaaagcctggtgttgtaatcggaaaaggcggagctgagatagagaaggttaaggcagagcttcagaagcttacaaacaagaagcttgtagtagacgtaaaggaagttaagcgtccggatcgtgacgcacagcttgttgccgagaacatcgcttcacagcttgagaaccgtatttctttccgtcgtgctatgaagagctgcatcagccgttcaatgaagacaggcattcagggtatcaagacaagctgctcaggacgtcttggtggtgctgatatcgccagaacagagagctataacgaaggaactattccacttcagactatccgtgctgatatcgactatggttttgcagaggcagataccacttatggtaaagtcggtgtaaaggtatggatctacaagggcgaggttcttcctagcaagaagaaagcccaggcagaaggaggtagaaactgatatgttaatgcctaagagagttaagcatcgtaagcagttccgcggttcactcgcaggaaaggcattacgtggaaataaggtcactcagggtgattacggtctcgtaagccttgacccatgctggatcaaggccaatcagcttgaggcagcccgtgtagccatgactcgttatgtgaagcgtggcggaaaagttttcatcaaagtattcccagatcacccggttacagcaaagccggctgagacacgaatgggttccggaaaaggcgcccttgattactgggtagcagttgttaagccgggccgtgttcttttcgagatcacaggtgtgtctgaagaatcagcaaaagaggcactcagacttgccggacataaacttccatgcaggtgcaagatcgttgcccgtgaaggcttagaaggcggtgaagcagatgaaaactaaggattatatcgaagaattaaaaggccagtcagccgatgagctttcagcaaagcttacagacgctaagaaagaactttttaacttaagattccagaatgcgactaatcagcttgacaatacagctagaatcaaagatgttcgtcgtaacattgctcgtattcagacggttcttacacagatgagtaaccagtaacggtgaattagagaaaggctttaataatggaagagagaaatcttagaaagacccgtaccggaatcgtggtatccgataagatggacaagaccatcaccgttgcggtaagagataacgtaagacatcctctttatggaaagatcgttaagaggacatacaaacttatggctcatgatgagaataatgacgctcacgagggcgatagagtccgcgtaatggagaccagacctctgtcaaagaacaagagatggagactcgtcgatataattgagcgtgctaagtaaagaaagcgaggaattattatggtacagcaggaaaccagacttagggttgccgacaacaccggtgccaaagagctcctcacaatccgtgtcatgggcggatcgaccaggagatatgccgatatcggagatatagtagttgcttcagtcaaggatgcaacacccggcggcgttgtgaaaaagggcgacgttgtaaaggctgttatcgttcgaacagttaagggcgttcatcgtaaggatggcagctacatcaagttcgatgagaatgcagcagtcattatcaatgaggacaagactccgaaaggaacccgtatatttggaccagtagcaagagagcttcgtgataagcagttcatgaagatcgtttcccttgctcctgagacactttaaggaggaaaccgatggcaagtttgaagataaagaagggtgacacagttcgtgttatttccggcgccgacaagaacgcagagggaaaagtaaaggctgtagatcctaagaatcgtaaagtcaccgttgaaggcgtaaacatggtaaagaagcatgttaagccaaatatggcaaaccaggcaggcggcatcgtagaggaagaagctcctatcgatatctcaaaggttatgcttttagtaaatggtaaagcaacccgcgttggcttcaagatggatggggacaagaaagtccgctacgctaaggccaccggcgagacaatagactaagaccggaggttagtttcgtgagcagattaaaagaacagtataataatgaaatcgccaaagccatgactgacaagttcggctacaagaacgttatggaagttccaaagctcgtaaagattgtcgtaaacatgggtgtcggcgaagcaaaagagaaccagaaggttctcgagtctgcagtagctgatatggaagctatcacaggtcagcatgcagtaataacaagagccaagaactccgttgcaaacttcaagatccgtgagggaatgggcatcggctgcaagacaacacttcgtggcgacaagatgtatgatttccttgacagacttgtaaacctcgcacttccacgagtaagagatttccatggcgtcaaccctgattcattcgatggcagaggaaattatgcacttggtatcaaagagcagatcattttcccagagatcgagtacgataaggtagacaaagtaagaggaatggacgtcatttttgttacaacagcaaagactgacgaggaagcaagagaacttctccgccttttcggaatgccgttcgctaagtaataaggagatttatatggctaagaaatcaatgaaagttaaacagcagcgtaagccaaagtattctacgagagcatacacacgctgcaagatctgcggccgtccgcactcagtacttcgtaagtacggcatctgcagagtctgcttccgtgagctcgcttataagggagaaatccctggtgtccgcaaggcatcatggtaagccgtttgtgaaacagattttattatggaggaaataaatcatgacaatgactgatcctatcgcagatatgcttacaagaatccgtaatgcgaacactgcgaaacacgatacagtagatatccctgcatccaagatgaaggtcgctattgcagatatccttgtagatgagggatacatcgagaagtatgagcttgttgatgagggttcatataagaacatccatgttaccatgaagtacactggagcaaagaaggatcgtatcatctcaggcatcaagagaatatctaagccaggtcttcgtatttacgctggtaaggaagacatcccaagcgttcttggcggacttggaatcgctattctttctacaaacaagggaatcatcacagacaagcaggctcgtaaggagaaggtcggcggtgaagttctcgcatttgtttggtaattttatataacttaagctaacaacttttaatggaggtacgggcatgtcacgaattggaagaatgccaatcgcaataccagccggagttacggtcaatgttgcagaaaataatcatgtgacggtaaaaggtcctaagggcacacttgagaagactcttccgcaggagatggatatcaaggttgaagggtcacaggttaccgtttcaagacctaatgatttaaagaaaatgaaatcccttcacggacttacaagaagccttatccagaatatggtaattggcgtcacagaaggtttcgagaagaagctcgagatcaacggtgtaggttatcgtgctgagaagaagggcaaggttcttactcttcaccttggcttctctcacccggtagagatgactgatccagatggagttgagtcagttctcgacggaaacaacatcaccgtaaagggtttagataaagaaaaagtaggtcagtacgcagctgagatcagagacagaaagagacctgagccatataagggcaagggtatcaagtatgctgatgaggttatccgccgtaaggcaggaaagaccggtaagaaataagtaaaggagtaaagctatgatagcaaagaaatcaagagcacttgtccgtgagacaaagcacagaagacttcgccacactctttccggtactgcagatagaccgcgtatgtgtgtgttcagaagtaacaatcacatgtatgttcagattataaacgatgaagtcggcaagactttagtatcagcttccacccttgataaggaagtaagcgatggccttgagaagacaaatgatgttgaggctgcaaagaagctcggaagcgttatcgcaaagagagctactgatgctggtatcaagaccgttgtttttgacagaggcggatatatttacgctggaaaagttgcagctctcgctgatgcagcaagagaagcaggactggatttttaaggaggaagcgatagatgagacgtgataacagagacgcccgtcaggacgaatacgaggataacgttgtctccatcaagcgtgtcacaaaggttgtaaagggtggtaaaaacatgcgctttacagcactcgtagtagtcggcgataaggccggccacgttggcgctggacttggtaaagcagccgagatccctgaggctatcagaaaaggccgtgaggcagccgttaaggccatggtttctgtagcccttgatgagaaccacagtatttctcatgatatgattggtaagcacactggtgcatcagttctcttaaagaaggctccagaaggtactggaatcatcgccggaggtccggcacgtagtgtctgcgagctcgcaggtattcagaatatccgtaccaagtcactcggatcttcaaacaagcagaacgtagtactcgctactatcgatgcattaagcaaacttaagtcccctgaagaagtagcaaaacttcgcggcaagtccgtagaggaagtactggcataaggaggataacatggcagataaagtaaaggtaacactggttaagtccacgatcggtgccgttccaaagaacaagaggatcgttgaggcattaggccttcgtaagccgggccagtctgttgagcttccgaacaacgcagctacacagggtgcagttcgtaaagtagctcatttagttaaagtagaagaaatctgataggaggtgccaggaatggatttatccaacttaaagccagccgagggttctaagcagagtaataacttcagagtaggccgcggaggcggttcaggaaacggaaaaaccgctggtaaaggccagaagggtcagaaatcacgttctggcggcggtgtaagactcggattcgaaggtggtcagatgcctcttttccgtagacttccaaagcgcggattcacagatatcaattcaaagaatatcgtggcaatcaatgtctcagcacttgagagatttgaggatggctctgatgttacagttgatactctgttagagagcggagttatcaagaagacaggagacggagtaaagatccttggtaatggtgagcttacaaagaagctcaatgttaaagttaacgcatattcaaagagcgctaaggagaagatcgaagctttaggtggaaaagcagaggtgatctgatgtttcagacaatccgtgacgcgttcaagataaaggagatcaggaagagacttatcttcacattccttatgctgattgtagtacgtatcggttctcagctcccattaccgggagttgatccggacgttttcaagcagttatttggaaatacaggtgattccctgaatttctttaacgctattacaggtggttctttcgaacagatgtcagtatttgcgctgagcatcacaccttacatcacatcgaccattatcattcagctcctcacgatttcatttcctaagcttgaggaaatgcagcgtgatggcgaggaaggcagaaagaagctcagccgtatcactcgttatgtgactatcggacttgcagtaatggaagcactcgctatggccatagggttcggccgcagcggatatctttctcactacaacttcccgttcgtgctgatgatggttacggtacttactgcaggtgcctcagctcttatgtggatcggtgatgaaatcaccaggaatggtgtaggaaatggtatttctatcattcttgtaataaatatcgtatcgagattcccgcaggatgcaacaactctgtacaaccagttcattaaaggacagacgattgccagaggaatccttatcggagttatcattgctgcgatcatagttggtcttgtagttatggttgtagtactgcagtgtgcagagagacgtatcccggtccagtattcgagaagactgcagggcgttggaagaaatacatactcagccgcaaacagtacctttattccattgaaggtaaacacaggcggagttatgccggtcatatttgcgcagtcactgatgcaggcacctgtcatcattgcagcactcgcaggtaagtcaagcggaaaaggcgtaggttacactatcctttacatgctttcagagagccactggtttacaccaagtaactggttctatacgatcggtgctgcggtatatgtgcttctgctcattgcatttgcatatttctatacatcgatcacatttaacccgcttgagatagctgacaacatgaagaagagcggcggctttgtaccaggtatcagacctggaaagcctaccagcgattatctccagagggttttgaactccataatcttcatcggagctattggacttactatagtaagtatccttccaattatgctgaatggccttactggagcgaatgtttcgttcggcggcacatcgatcatcattgtcgttggtgttgtagtagagaccgtaaagcagatcgaaggccagatgatggttagaaactacaagggatttttgacagattaacctgagtaatagttggaagttcaaagttcatatcaggaaccaaggactttcaacttttttttcagataaagctgtcagatgctttaatcggagggtttattatgaaaataataatgttaggtgcgccgggtgcaggcaagggaacccaggcgataaagatatcagagaagtacggcttaccacatatcagtactggtgacatcttccgtgcaaatatcaagggtggtacagagttaggaaagaaagccaaagagtacatagataagggagcacttgttccggatgagctgacctgcgacctcgtagtcgacagaattcatcaggatgactgtgccaacggtttcgtactcgatggtttcccgagaactattccacaggcggaggcacttgagagagcattatcgaaggaaaatgagtcgatagatttcgcgctcgatatcgaggtgccggatgaagccatcatcaagagaatgagcggacgccgtgtctgcccgaagtgcggagcttcataccatgtcgagagtgttcctccaaagaaagagggcatttgtgataagtgtggtgccgagcttatcatccgtgcagacgatgagccggagactgtaaagaacaggctgtcagtttaccatgagcagactcagccgcttatcgacttctacaagaagacaggagtcttccacgaagtagatggaacaaagcctcttgacgatgtgtttgcagatgtcgtaagtatccttggagagcattcatgacaattacgatggcgaagtccatagcaggtcacgataagactgaagtatatgttgtgatagatgaagaggacgattcggtgctgctggcaaatggtaagaaccggactgtagcttctccaaagagaaaaaaattaaagcacgttcagctgataaaaaatataccagatgaagtcagtgccatctcagaagtggaaaatgattttaaagatctttggatcaaacgagtaatcaggatatatacaggtcttatgaccaaggagtaatgaaatgtcaaaagcagatgcaatcgaagttgaaggaaaagtaattgagaagcttcctaatgcaatgttttcagtagagctggagaatggtcatcagattctggctcacatcagtggaaagcttcggatgaactacattcgtattcttccgggagataaggtcacaatcgagatgagtccgtatgacctgacaaagggcaggatcatctggagagacaagtgatatttcttcctttttacgatattgtattttaaaaagaacataaaaaatattgagtatttgaaagcgtccgagtataatattacacggacgttttttcgacgggtaaaatacgccctttaagaaacgccacagttcgttgaacagacggacatattactatattttaaagaaaggagtcgttatatgaaggtcagatcttctgttaaacctatttgcgagaagtgcaaggttatcaagaggaagggtaagatcagaattatctgcgagaaccctaagcacaaacagagacagggctgatgcaccccgtctcctgatgtattctatggcggctgatagatgagggatttttccttcattagtacataaatacattcaaatggccctgtattaaaggcacaagcatcgctcccaaacataccggggagcttgatccttccatattatatagagaagggtcgatgtcatttgaaggctgacacacatttcaggccgggacaccggagctgtcagttggattttttagaaaccagatccggagatgtccggaaagaatttttacagaaataaaggagtaaatacacatggctcgaatcgcaggtgtagatttacctagagaaaagagaatcgagataggccttacctatatttatggtattggaaaggttacagcagaccgccttctcgaggagtcaggcgttaatcctgataccagagttaaggacctcacagatgacgaggtaaagcagatttcagaagctatcgctaaagagggaatccttgtagaaggtgaccttcgtcgtgacacagcattaaacatcaagcgtcttcaggaaattggatgctacagaggcatcagacacagaaaaggacttccagtacgtggtcagaagactaagaccaatgcacgtacacgcaagggcccgaagagaactgtagcaaataagaagaagtgaggttgatataaatggcaaaggtaaatagtaaggcctcaaaaaggcgtgaaaaaagaaatgttgagcatggccaggtacatattcaggcatcttttaataacacgatcgttactataacagacgcagcaggaaacgcattaagctgggcatcagcaggcggccttggtttcagaggctcacgtaagtccactccgtacgctgcacaggtagcagctgagacagcagctaaggcagcacttccgcacggacttaagaacgtagatgtatttgttaaaggaccaggatcaggcagagaagcagctatccgtgctatcgcagcatgtggtatcgacgttgtttctatccgcgacgttacaccggttcctcataacggatgccgtccaccaaagcgcagaagagtctgattgaaaggaaggtagaagacagatggcagttaataagacaccaattcttaaaagatgcagatctttaggtttagagccggcatacctcggagttgacaagaagagcagacgtacagagcttcatcgtggcagaaagccttcagagtacaaacttcagctcagagagaagcagaaggctaagttcatttacggagtacttgagaagccgttcagaaattactataagaaggcagccaacatgaagggcatgacaggtgagaaccttatgcgtatgctcgagagccgtctcgacaatgtagttttccgtatgggtcttgcccgtacacgtcgtgaggcacgtcaggttgttgaccacaagttcatccttgtgaatggaaagaaagttaatttaccttcatactctgtaaaggctggagatgttatcacagttacagagaagggtaagagcagccagagatttaaggatatcacagaggctacaggcggacgtatcatggtagactggattgattacaatgcagatactatgacaggtactatcaaagctcttccgaacagggatcagatcgatgttcctgtaaatgagatgcttatcgtcgagctgtattcgaagtaataagttgggagtcctgagtcagtattcattgcggttctctatatacagagcggctttgaagctggcttgtaactataagtgtcaacaaatacggaggacaaaaattgttcgaatttgaaaaaccgaatatcagaattgacgaaatcagtgaagatgacagatatggcagatttatcgtagagcctctggagcgtggctatggtactacacttggcaattcgctgagacgtatcatgctttcgtcccttccaggaactgcagtaagtcaggtgaagatagacggaattcagcatgagttctcatccatccctggagttaaagaggatgttccggagatcatcctgaatatcaaggaactcgcactgaagaattccaatatgacagaagaggcgaagacagcttaccttgattttgaaggtgagggaacagttcacgcttcagatattcactttgatgaggatattacggtctgtaatcctgatcttgagatagctcacctgaatggtgggtctgactcgagactttccatggagctgaccattacatctggcagaggctgggtaagctcagataagaataagaatgacgacacccctatcggtgttattgctgtcgattcgatctacacgcctatcgatcgtgtaaatatgcatgtcgagaatacacgtgttggacaggtcactgactatgataagctgacacttgaggtctggacgaacggaaccattgctccggatgatgcagtatcactcgcagccaaggttcttaccgatcatctgaatctctttgttaacctttcagaagcaggcaaagaggttacagttatcgacaacacgaagtatgataagcctacgatcggcgaggatatgcctatcgatgaccttgagcttactgtaaggtcattcaactgcctgaagagggcaggagttagcactgtaaaggagctctgcgatatgactccggaccagctgcagaaggttagaaatcttggccgcaagtcgttagacgagatcatggataagttaaatgaactccacctttcactcagaaaggaagaagagtaatttatgacagtgtctgctgtgtaaatccggagtggtaacggcagacttcccaaattttacggggcctgtaagtccataagagttaggctccgcaagccacaggaggttagaaagatggctacacattacagaaaattatcaagaacaagttcacagcgtaaggcacttctccgcagccaggtaacacagctcatctggcacggccgcatcactacaaccgaggctaaggctaaggaagttcagaagatcgctgagaagcttattgcccttgctatcaaagagaaggataacttcgatgaagttaccgttcaggcaaaggttcctaagaaggacgctgatggacacagagtaaaggtcgagaaggacggcaagaaggtaactgagtatgttaccgaggagaagaagatcaagaaggatcagccttcacgtcttcacgctcgccgtcagatcctttcagttctctacgatgttacagagaacggaaagaagaaggctgacacaaagaaggtcgaccttgctgcaaagcttttcgatgagatagctccaaagtatgctggcaggaacggtggctacacacgtatcatcaaagttggtcagcgtaagggcgatggtgctctcgaagttgttctcgagctcgtttaataataaggctttttagaccgtaaaaagggccgcacggcactacgaaagtgccggcggctctttttttgtggccagaccggattgaatagacggccgcgacatacagcttcaagaggacataaatgatatctggccgagagaccttatttttttacaaaaaatatatagaggccgaagcgtttttattatataatgatctggtgttcaaaaggttgaccaccaaatcatttcataaatctaatcatattccgaaagaggagctggtccatggaaaatattctggaactgaagcatatcacaaaaagctacgaagatggcatcaatgtcattgaagatttgaacctgacagtcaagaaaggtgaacttataacgcttttggggccgtctggctgcgggaagacgacgctcctcaggatgataggcgggtttgatctgccgaattccggcgagatattactgcatggcgaggacatcggccagctgccgccagagaagcggccgataaacactgtatttcagaagtacgcactttttccatttttaaatatatatgacaatatcgctttcggtctgaagcagagaaaggtcgacaagaacctgatcaggcagaaggtaaagcacgccctctcggtcgttgacctcgagggctttgagaagagaaatgtcgattccctctcaggcggacagcagcagcgtgtggcagtcgcaagagctattgtgaatgaaccggaaatcctgcttctggatgagccgctctcggcgttagaccacaagatgcgtctcgagatgcaggcagagataagaaatatgcacgacaaccttggaatgacttttatctatgtcacccacgatcaggaggaggcaatgaacctctcagatcggatagtcgtaatggcaaacggtgtgatccagcaggagggtgctccggaagaaatatacgaccggccggcaaatattttcgtagctgatttcatcggtgtcagcaatattttcacaggtgatgtgacagataaaaaacgtgcgaggttcgcggggaagatttttaagacggactcggatcttccggtaggaaccaggatcgaggccatgataaggccggaaaatgtagagattaccggggccggagagggcgctatagacgcggtcgtgacgagcgatatttacaagggatctcaccatgagataaccgcagaattcggcaaatacgaggtaacggtttatgggaagagcagagtcgagacagggagcactattggaattgatttcccgagagagtacatccacctgatgcggcacgatatggatatgaacgtattcgacggcgtgataaatcaggatggaagcgcggattttacctattttacacttgcaccagatgcagagtttatgagagataaggcaccgggaagtaaagtccaggtggtgtttgagtctaaggatgcggacctttcggatgatccggaggcaggcttcgtgaccggaaatattgacgcgattatgtacatcggtgaccactacacctacatagtccgtggtgacaatgacgaggactactacgcggatgacgactggctctggaatatgggcgaccgcgtcagtatcgtggtgcctcaggacaagttcagatacagggagcttatatgaagaaaaaaagagtgctgccggtcgtgtggctgataatagtatatacttttttgtatctgccgatcgctgtactggcgttttatagctttacagatgcttcgatgataggtcaggcgggtcatttctctgtgaaaaatttccggacgctttttacgacgcctgaacttctgaatatgatattcggaactatcgtgctggcgcttgtcgttggagtgctgtcgacggtcctcgggacatttggagctatcggggctttttacagcaaaaaaaggaacaggaatctgatagaggcgatgaatcaggtgccggtggtaaatgccgatgttgtgactggattttcagtctgtattctgctggtcgtagtgcttggaattaacaaagatacctatatacctctggtagccggtcagatggcgctctgcacgccgtttgtctatctgcaggtgattccggcgctctctcagatggaccacaggatttacgaggcggcgcttgacctgtactgcacgccgggccaggctgtttttaaagtggtactgcgccagctcgcaccggcgataggctcggggtttttcacggccgtgacgctttcgatggacgactattttgtcacgacatacacgaagccggccgtattcgatacgataagcacatacacagtaaacgcgacgaaaggtgcccagacagagataaaaacggcactctgggcgctgtcagccctgatatttttcatagcggtcgcagtggtcattgccgcgaatgtcaggagcaggagggtggaaaatccatgaaaaaagttgcaatgcttttaacttttgtaatgctttttctctgcggctgcggcggaaaagcatccggcacaactcctgtcacggacgatgtcgtgactcttcggatagcaaattcagaggagtatatagacgaaggcggctgggacgcgtcggagaccatcacgctttcggacggacagaagatccgtggcgtcgactcgctggtaaacgactttgaaaagtggtatcaggaaaagtacgggaaaaaagtccgcgtcctctattctacctacgggaccaacgaggacctctacaatcagatgacacttggcaactccttcgacctcgtctgtccttcggaatacatgatcatgaagcttatcagggaaaataagctcgagccgctttctaaagacttttacaataaggaaagcgcttacaattactacgcaaagggcgtctctccgtatatttttaaaaggatgaaaggcttgaaggagggcggcaaaccgcttacagactatgcggcaggctatatgtggggcacgctggggacggtctacaacccttcgaaagtcgataagaaagacgcttcgagctttcgtatttacctgaataaaaaatactacaagcgccttacgataaaggactctgttcgcgatacatattttgcggggcttgccattgcgaaggaaaaagagctcgcaaaaaacggcgcagatatttcaaaaatccttaacgatacatcgcagaaaactgtagaccaggtcgaggatgtgatcacagacatgagagagaatgcctactcgatggagactgactcggcaaaacaggaccttgtcactcgaaaagctgacgcgagcctgcagtggtcgggcgacggcgtattctctataaatcaggctgaaaaggacgggctcaggctctgctacgcagtgcccgaagagggctcgaacctctggtttgacggctgggttatgctcagcgacggagtaaaggacgacaaagataaaaagcaggctgccgaggcatttatcaattatatttcccgtccggaatctgcgataagaaacatgtactacatcggctacacttccgcgataaccggcggggatgacccgatggtggaggagtacgtaaattacgtttacggctccgaagagaaaaatgccatggactacgacctgagctatctctttggaaaaaaatgtgtgataaaggccgatccggaccagcttgacaggcagctcttcgcgcagtatccgacggaggatatcctgaagagatgtgcggttatgaaatgtttttcaaatcaggcgaaccgcagggtatcaaagatgtggacgaacgtcagatgctacaggtttccatgggaaaagaggaggtgaagagacatgcggtttaaaagaagtatgctcggcataccttatgtgatttttcttataattttcgtaatggcgccactcgcagtcgtatttgtctacaccttcacgaacggcagcggacagtttacacttgaaaattttctcggatttttcaaaagttcaaggactatagcgactctggtctacagcctctttgtcgcactcgttacaactgtcttctgtctgcttatcgcgtatccgacagcctatgcgctcgcccgcagcggctttaagaagaaaaatatcctgctgcttctggcagtgatcccgatgtggataaacttcacattgagagttactgcactgaaagaggtccttgacttagtcgagggaaacctcgcatattatccgttttttaatacgataatagggcagatctatgactttctgccgtttatgatcctgccgatttttaatgttttcgatgaaatggataagtccctgctcgaggcgggcagagacctcggagccgacaggaagagcctgtttttatcggtgatcctgcctctgtctatgcccggcatagcgagcggtatcacgatggtctttctcccggcgatgacaaactatgtagttttggatatgctctacaattcgacttacatcatgggaagcctgatcggaagctatttcaatgcctacgactggcataacggctcgatggtttcgacaatactgctgcttataatcatactgttttctcttattggaaaaaataaaactcagaatgcatgaaaaaaagaggctgatcaagcctcttttttaaaattcgactatagttactccggtgtctccttctccatacgcggccagatggtagtctttgatatctttctgctttgcaaggtagctgtggactgctttgcggagaattccggaccctttgccatggactatgcggacctgcgaaaggtgggagagcctggcgtcgtcaagatatttgtcgagagtgcgaatagcttcgtctgaattcattccgataagcataagctccggagaaatagtggaggctttgctcatagagtgcctggacccgccgcttctcttctttgaagaggaagacggctcgtctacaagggcgatgtcatttatatttaccttcgactgcaggatgcccatctgaacggtcagatttcctctggcgtcgggaagggtatggactgtgccacgcagattcatagagagtacgattacatcgtcgccgatacgaagtttcttcgcgtcggcttttttgcccttcagggcggtggtcttcttaggctttacggcggctttgccctggtgggcctttatggattcgccgagagcggaacgctgtctctccatctctgccatgtctggagtggcagttccgtatttgttgaagttcctgataactgtgtcggcctggtccttcgcacgctgcaggatctcggcggcttcggcgttggctttggcgagtatcgcgtcggatctgtcggagagcgaggcgtccttctgcttcgcacggttcaaaagtgcttctgcctctgcggcagctttcgaggccttatcctgcgcctttaaaacagcggactgcttctgctcgagacctgttaccagatcttcaaaattctggtcttcacgcttcatacgcgaagcggcgtcttctataatctctttggatagaccgagtttctggcttatctcaaaagcgttcgactttcccgggactccgatcagaagcctgtaagtaggggaaagtgtctctactgaaaattcaaggctcgcattctcgactctcggagtcgtaagggcgtaggctttgagctccgggtagtgggtcgtggccattgtcctgattctctcgcggtgcagctcgtcgaggattgactcagcgagcgcggcgccttctgccggatcagttcccgcacagagttcatcaaaaagcacgagagccgtgcgctctgccttctgcggcatatgcacctgacgcaaaatacttacgatatttgtcatgtgtgagctgaacgtcgagagcgactgctcgatagactgctcgtctccaatgtcggcatatacatcgttaaagactgcaatctcagatctgtccgctgccgggataaacaggcccgcacaggccatcagagtgaggaggccgacagtctttaaggatacggtctttccgcctgtattagggcctgtaactacgagcacatcgaaatcttttccgaggtttacatcgatcggcacgaccttcttcggatcgagcagcggatggcgcgctttccttaagtcaattcgtccgtcggtatttaaaagcggctccatcgcattctcgctctgcgccagttttcccttggcaaaaatgaaatccagctccgccaatattttaaaatcctgaactatcgtaccgatatattcgtagactttttctgaaagctccttgaggattttcttgatctcctcctgctcactgagctgaagttcgcggagctcgttatttagtgacacgacggcagcaggctctatgaaaagagtagcaccggatccagactggtcgtgaaccatgcccggaaccgagctcttgtgctcggatttgaccggcaggcagtaccttccgtcacgcatcgtgatcacggagtcagacagataatctctctgggaattgagcagctctgtcattttggaatggatgcggtcacccatcagcccgatctggcgccttatagcccgaagcgccggagacgcgtccgaggcgatctcgtcctctgaaacaatgcagcggctgatctcatttctgagtgtctctatgtcatcgagctcattgaaatagtgagtcagcgaatctgctttagtctctgttctgcctggctcgccgtatttttttattcgcgaggcgacagtgaggaggctcaccacagagagaagctcagccgtattcatcgagcttccaatctcaaggcgcttcttgtaaatatacggatcgtggattccagaaaatgacacgtcgccctttttaaagagcctctgcagtgcatctccggtctctttctgtctgacgcggatcttgtcaatgtcgctgatcgggtttaaaagcctgcagtattcccgtcccttgtccgaggtcgcaaatgcggcaagcctttcaattatcttgtcaaattccagtgtgtgtagtacttttttattcatgggaaaaattataacaccggaaggggtggaccgcaagaaagaacgtgggagggataaggcagaaaatatcagactggccactgttatttaagcgactttgccgtttcacagagcttttccataagtgggattttcttatgatcatagggatatttcgagttggagactccagcgtcgtctaagagagacgattcgtcttcggatgaatcaatgaactccctgtattcgttttcaatgatctcaaaattggcaagaaatgtatccttgtcagccgaagaaacataattcttaaaatccgctgtgagtttgtcaccagctgattcaggtgttgagtacagaaaatcgcagaaggcggctgttgttgccgctgtttttaacgagcttccggctgttccaacttcgagattatttatatcattcagaaggttattaaaagcttttttatcgacctcatcagatttatcactgctgtcagaagcgttctgatcatctgtatattcttttgtctcggattctgaattttcttcagtatctgtcacagatgtttcaggcttttcttccgattcattattctctgtttcatcttcagtttctgccttagttgtcttctcggcagaaacatctccagaagcactttttgatgctccacatccaaagcaggatgcagctataacggcagaaagtataaggcttaacatttttcttttcataataacatctcctatatgtagattaaaaaatatacgctgatttttcatcgcgccgaataagtgtatcgcatttcccatgtaaaagaaaggagtgtggctttattttgtgtttgaaattttatcaatccccctttaatatcttttaattgtaattgaaactttaatcagtgagttttcatatgttcagatttttttacatattcttgtgaccttggctctacgatgtcagcaattccagtaaccgtattttttattaatatggtccctggaccgaaaatgtaaaataagaagatgtcggggtcgaaactcgataattaaatcgggccagacctctggtgcaccttgaaaatttcatattttgtagtgattgtacagctttaatgtctgaatctgtctatccgggcatggtatccatcctgtttttatgcatacagcggattctgggcacacttaatccagcccttccgataattgaagagcttcctgatattcaatgcacctattttggaaccaaagaagaatttacctcgttgctttccctcggaagtgtttccaaatgaaaattccttctgagatttgatggcagtgtctctactccgttccttagccgacagtagtctttgaaaactcttcctccattttccgctgacattttgccggtttcttcccttaagggaaatgttcaggcttgccgtctgcttatgaaaatgaggattacattcattacgatgaggacaattctcgcatgttgacctgggaaatgaaatacggcattttccgtttgaattcctatagcaacagcttcccggaacgtgcccggccggacagcttgtgacgttctttccgtcttcgctgaattcaaaatcagcaaaaatgtccggagtggcaattcctgtaagagctgttgtgatcagatcgacattttttcttttgcgagtttgttgttttcatcgctgtaataagcaccgtccgttacaatggttgttgtttcatctgatttttttcgggcttccagattctctttcaggaaagcactgtcgctgtgagtatttacatcatactggtaatccgttaccacggatccggtttcgccgacggattcttcaagattagctgcgtatcctcggtgtccttttcctgcctttatacggaaagttgcgtccgggtcagagggattctgaagcattgctgaatccatcctgccatcactcttttcacgaaccggcgtttcccatcttcaatgatggtctgctcggaaaggcaccgcacaaggagttcatatgtctgcagcgtgtcatattttccggaagaaataaggaggattgtgtctgcatctttcaggatagtttgcaggcgttcatcggtatccgtacttctctgatgatacataacccgattgaaatcattcggatctgcgtagtgcttcagttccgcagggaggaaagtttcgtcctgctttgctatcacggcggcaagccttgaaatacaggtatacagcagttccacccggctgagcttccttatgttggattcaatcatcatggaatccatcctccggatgcgcccgttaattttcatcagcttttgattttttcgctgaggtcattgatacagtcatggtacaaatcgacattatacagggattcgtatcatagcagcgtttccggaacctgctgagagtcttgtcactcaatggttgttccttgaagctggtggtatgaagcgcatactgaaggtgaagatcaagcatcagattttcaaccatctcatcgtcagagtagtcgaaaagctctttgatcaggagtgcgccaataatgacattgactggcgtgttgggtctggaagctttgtcgctatataaaacggaaaaacggctttcatcaatcgagggaaaaatttcctcggcgaaagttccggcccatgagttctccaggcttttttctctcgttcggtaagcccccagaaactgtcgtgagcgtcatttgctggctggaattttctttaaatgccattgtctgattcctcccataaagtatatttttattataccatggttggctcaaatattggcagtatcactacgacaatatatgaaattttcaaggtgcacaggggctttcgaccccgacatcataatgattacagtaattgcagccggagaaataagtcccaatactgctacgtaacagagtattgcaccagcatgtggagtaatccctcaagaaagcccttgtgaagaatcctcccagcaagtataataatcccatgaagaaaaatgatgtatttgaagtagaataactggtttaggcaaggatggagagggaatcgccacctcgaggggatgacattttttgtggtcggagcactgccgggtgacgttgtcatggcacatgttaccaagctgaaaaagacttacggctacgctaaagtcgttaaaattttaaaccatcgaaagacagagttgagctccgtgcccgtttctgaccgctgcggtggctgcagcctgatgaatttttcttatagggcgcagcttcggatgaagaggagatagtagaggacgatctcgtccgcatcggtggctttgaccgcgattttattagaaaaatccaggagccggtcattggcatgagcgacccgctgcactatcgaaacaaagctcagatcccggtcgggatgcagcctgatggcggtattgtcatggggttttatgcgcaccattcgcaccggataatagagccggatcagtcagtcggctgccttattggcgcacctgaaaaccagaatattacagatgccatcaagtcctgatgtatgaaaacaaagtccgtgcatacgacgaaactacgcataagggcttgatccgccacatcctgattcgtcacggcgtccacacgggacaggtcatggtctgccttgttataaatggaaagtctattccggcaatcgacaatctcgtcgagcggctcacggtcgcctgccctgatatcacaagcatctgtgtaaatataaataaaaacaccggaaatgtaatccttggcgaccgcaccgagtgcatctggggcgagccggtgatcacggacaaggtaggagatattacatttgatatttcagcgaagtcatttttccaggtgaaccctgtccagatggaaaagctctattcacgtgcactcgaatacgcggacctgaagggctctgagaacgtctacgacctttactcaggcatcggtacgatctcactttttcttgcaaaaaaagccggccatgtgaccggcgtcgaggtcgttccagacgccgtaaagacgctgtcaggaatgcgaaactaaacgttttttcaaatacaaacttctacaccggaagaccgaggatgtcctgccgaaactcgttgcacagggacgtccggcagacgtcatagtcctcgaccccccgcaaaggagctgagaagtcagtcctcgagacgatcctctctgtagctccatcccgcatcgtatacgtctcatgtgacccggcgacgctcgcccgcgacctcgccatcctttgtc

SEQ ID NO: 2 - DNA, 797967 bp, Unknown
  Metagenome-assembled genome
ctctctactacgtctttatcctttgccatttgaagccacaaatgcactgtcgcagcatctagtcaacaatttccgctatttttttctcagacatattcatctgatacagtttaactgctacttccttctgttctccacctcccggtttctttgcctttttttatgcccttgctattccctttgctatcccttttccattcctttagctattcctctgttttctacttcatcaagcacttcacacatatttgtcggacctcctttcttcgtttcgctattgcaggcctcttcaaatctgttatcgttggtaagcacactcatgagattaagaatttctcgaacatgagtgatagtttctttactcggcttatacttcttgttctttcttatctgcacgaaatattcagctatgattttaaagtcacttcggaacatgctcacctgctcatcagtaagccaggcaatctcaaacagatttatccggtaatcggaacgtatctgtctaattcatctggaatctcaagacactgctttagattgacaggagtctccacctgtgatcatgtccgaaatacagtaccagagtaacaaccggatatctgggaatttcttttctgatataacagtatgaaccagagcgtcagcattcatttcattgcggtatgatgcagcatcgtagcttattacccgaaacggcatatccggatcatcaacagtctgattctcgaatcctataaccgaaagccttatttctccattctgccagtatttaacggtatctctctcctgaccatgaatcttcgaatcgccttgtaaatagaatcacatcacatccttgacatcactctcgcagataacctctctgccctcaaaaagcagcccattcactatatctgcgaatacatccgaatatccctcaagcgtcttctctattttgtctttttctgccatcatctcttcccttcatcagttgtctgacaattagattatactatctgtctccaataatttcaatcttaaggaaccttgtattcccaaatgtaacatatctggagaactaatgaaagagattcagacaatatttaataactaaaacttcccacactcaaaaggtgtgttgaaccttgaaaactcaataatgtaggcaattaaaaaggcatagacgctgtgcctttggtataattgagttgactagaaacaaccatacaaagagactatctatgccaatcaattctaccacaggataaagacggacaggaactttatgctatcgacatttttctcaactttcagaatcggtaacctcctccataaatgcaatgctcagaaggagaagggcgttccggtaatcgatatttcaaatataagcctgcaatgttttcgccgaccgcagcatgtatatgcagcagaagacaggctccttcaaagagtcgttttcaaagaatacgttttttcggttcctgaacagcccgaagacaaactggcttcgctttactacccttctgtctaagaaggttgctgatgctgttgagccgcttacttcggaagaccgtgtaaacgcgtttgtgtttgacgacagcctttttgaacgacgagctgcaagcaaacggagcttggctcccgtgtgtttgaccatacctccatgaaatactgcaaaggattccgtctgatgacacttggatggactgacgggaatacatttcttcctgtaaacagctgcctatatcctctccaaagagaaaaatcttatcggtccggtcgatcagtcgatggccgttcccttgcagcaaagcgtagaaagcttgcacaaacaaagggcacagaagtcatgatcgggctgcttaagactgcacaaacgcgggtcatcatgcggattacgtcctgtttgacacatggttctccagtcccgcacagctgatcgctgtgaaaaaacttggtctagattccattgctatgctcaagaagagctctcacatctactacgagtatgaaggaaagcagctttccatcaaaaagattttcggcatctgcaagaagcgccggggccgcagcaagtaccttctttccgtgaatgtcatggttgtaaagacgagaagattcctgccaaaatcgtctgcgttcggaataagaaacaacgaaaactggattgctttcatctgtacaaatcccgaactgtccgaagaagagatcatccggatctacggaaagcggtggcagattgaggtatctttaagacatgcaagtcctatctgcaactgatatcggaatgccacagcctttcatacgatgccctgaccgcgcatgtggcgatcgtttttactcgatatctgatgatctccatggaacagcggcggagcaaggacacagaacgctggagagatcttctactttttcacggacgagctggcggatatcacctttgcgatctttccaatcatcataactgccatgatagaaagtatttctgcatttttcagccaaccgaagaacaacttgcaatgttcatagagatgtttgtcggtcacttccggagtatatccgtaattcgctggcaaaggcgggtttagcggcataaagatcctatctgattgcctgtattattgagttttcaaggtgcgaagcccatttttgctatggagttttagtttaataagcttttaatattcagtttttaaagtttagaatttggtaatttattgtttaaaaaatttataatttctttacatttacgctggaaataatcccagctcatctcgtgttctacaatgatgagccaggatactcggaattataagtatttgtaccgacatttactccgacattactcaaaacaaatccagcgtatttgtcagatatatctcttctcgtactttaagctggtacttaggctttgtcaggtagtagagaagaaactcaagtatcagcgcactcccgaggctgcgtccttcgatcttgaagttcgaaaatccaatcggaagatatttgtgaactatgtcttctatactgataaatcctggattttccatagcccttgaaaaagtatacccctctgctgcccgaggtgatggacaggtgtgatgctcttcttctcccagcgccaaatggctaaccgcttcatagcattctcttcgcttactgcagccgaaatcacagcactcattgcagagaaactcactcttgttcttctcttcctgggaaagctcagccagcttattgaattttttgttcagcctgaaatcagccaccacatacttaaactctgtcctgtcgagctcattcttgaagtcatcaaaatccgtcagagtcttcgtagtcgatgataccagataaagttctggatatttctctttcagatatgatgtcaaaagctcagagtgaactataacgccttttttatttttcccggaaagcgcaaacattctgcataaatcgttacagcgcttatccgaaagatgcttttccgtaagcaggctgttgctgaatgtgagtcttgcgctgatcccatactcctctgtaagtgcaagtacgtcctcaggagcagcatctgattcacttattcttccgccaccccatatacagtctgaaggcgcgccgtatatagagccaatcctacaccacgggtaaaaatactccctgtgatcaaaaaacagcggcagaaagagcttgtacagctcataaaattcaaaaagtcccggcagatgatacacagccgtcagtttttcagatttcgtcctattcatcgtctaattcacatttataaagaggtttttgcttctgaactctactcacaaaactatatcatgatttggtggtcaaccttttgacaaccaaatcataatatgattctttaatcaatctcatcattctggaatctcgacagatgctcgtacggaagaatctgcctgccacggtaaaggccacagccgtcatttatcaggaagttgctggccgccgtgaacatgtttacatctacctttgacaggtcaaggttctgaagatttaccacccgctcataagcttcgtcaaaataaacacactgcccttccggaacagcctgtctcctggccctttctttttcctgggcagcttcataggccttatgattcgcaatacctatttccgcgaaatcatccatcgacttggtccgaagctgcacctcggtatagaacctggacatattatcatacagcgcgatgtgaagcgacttgtagcccacatcctttgcgtttgcgatgtagtccttgtaatacggcctgacattctcatccatcaactcagactggttaggaagctccttatccgataattctggtgtgaaaccaagttcctccagaaaatcaggaagcttgtttgctatctcataaagtagatggagctccacctcatcctgatcatcccccggcttcaaatggcatttcggcatggaaatgactatcctgtaagcgatcaggtccctgaacctgttgacctgatttttgatggctgatagcggcggaaacttgccgtgctcctgataaaactcatagataaagcttgagatatagccgttgtatttttcctcggccctgatcagagattttatccttccgtgaaaagtaaacgccagatacggatactgctgagccatatacttataaaactctctgattcgctgagactgcgatgtgaggaaatcgttgtgctcgagcatatctatcatctgaaaaagaaaattcgcgtgggcaaaatccacctgatttcccgtctttttagcactcttctgaaggtctgccgaaaacaaatgcagaattttcagaaccgtatctcccgaatataaataatctgtcagctgaaccataatcgtatccttttaagcatctaaatgttaatctataggagcgattatacatcttttctgcataaatataaagtctccctcatctgaccaggatgagagagacggctctatcaaatattacgctaccgtattatatctcgtatagacatattcataaatctcctgcctgtaatgcgagatgctcacctcgtcatagctttcaggaagttctttccacaatgtatcacgaatcagattgtcaacagctgcttttgtctcctgcttgtctgtccagtgatccagctctgctatctttgccttgaccttccgaagcaggtcaactgctactttttttagctgctgaatatctttcttactcaggtcatccctaaaaagcatatcgtagagtgacaattcctcatcacttgaaaaaccctcgcggacatagcgcttcgtttcctgggacatactgtttgcgagattcatcagatcaatgaacgtcttctcgatagtagcccgatcctgctcctgattataagcatcgataattttctgatatttctcgtaaaaatcaacacggtccggattggtaaacatcatgccttttaatctctcttgaatcaaatcgtccagatctttaagcatgaggttcttattttttgcccgggcaaattccttctgaagcagatcaaaatcaatagcgctgatatcccatctctttggatcgtcctgaagctttttcggtacatcatctattgagacataagagctgattatcccatttacctgaaccatcagatcagttgtgtctacatgcctgcgttttttcataagctgtctgtggatggctgtaacagcatcatactctttccatgtagacttactaaggttatcatgatttgcatatttaaccatccgctccaattcagaagcacaggtcgtaaacgtctttctatcttccagtgaaccactgacagcatcagcagcatcctgcaggcactgaattttatcaaaagcatctgcatcgatcagatcctgtagattaaaattcttctctgcaaggaattgctttgccctctcaatggtttcaaggattttttcgattaatttttccttgtctatcgtaggatcagttccatttgttccgccgacatttgcagtataatcagcaagagcctttctaagtgcttttacaattcctatgtaatcaataataagaccattgctcttgccctctgctacacgattagctctggcaatagtctgcatcagagtgtgcgccttcaacggcttatctaagtacaggcaggacagacatttcacatcaaaaccagtcagccacatagcacagacgaaaacaacacgaagtggattttccggatccttgaactctttatccaactcgcgattttccatctttctgcgatgataggctatatcaagattccatttcttgaatgtctgaacctcattctgctcctgactgatgacaacagccatttcagtctgcttcatccattcaagcttgtgagatagttccatcgcctcctgttgtgaggcactcttgatctgtaccttcagatcctcgattgcttttttccagtattcctgcacataattatacatcctgacacaggtaaccttattgaggcagacaaacatggcttttccgctggtccaaagatctgaataatgctgcacaaaatccttagcaatagaacgaagcctcggctctgctgtaagcaaatgaatctccttagccacttcatgctcaatcttatcctgctgatcaggattcagatcagcctgctctacagcatcgagaatcttatccgttatctccgggttgtgaagatctgcgattttctcaccgcggttctcgtagtagagaggcacagtcgcaccgtcttctacagcacggcggaaatcatatacagacacatagccaccgaaggtccgagcagtaatattatcactggtcaaaagaggtgttccagtgaaaccgattctcgatgcgcctggcaggagcttcatcatattacctgcaaaaataccgtattggcttctgtgtgcttcgtccgacatgatcagaatatcatgatcaggaatgataggcgtgacatctgatttgttgaacttttgaatcaatgtaaaaataaaacttgggttgccctttagcttctgaatcaggtcttctccactcgttgcaataaactgtgaagcctttgcttttcctaaaaggccacaattctcaaaggtatcacttatctgtttattcaactcttctctatctgtaagaatcacgatggtcggtgaaccttcaaacttacgccggattttctgcgcaagaaataccatggaataacttttacctgaaccctgtgtgtgccagaaaacaccaagctttccattattcagctttctcgaagcatatgcctttactgcttcattaacaccgagatactgatgattccgggcaagaatctttgtcgtacgtccacctgaatggtcaaacaggataaagttttcaaacagatcgaggaaattttctttcttacagatacctctcagcatggtggcgagcgcaacgctgccctgatccgattcctcaagtctcttccattcattgaaaaattcatacttactgccaagtgttccaacctttgcctctaccccattagacaggataaggaacgcattgtaatagaataaatgcggtatcgtatccaggtaatccgtatagttgtccacatacgcattgtaaacatctacatcagttcttttaagctcaatgaacatcagtgggatgccatttacgaaaccgactatatctgtgcggcgacgatacagatcaccgtaaatcttcatctcttttacagctaaaaaatagttgttctccggatgctcgaaatcaatgaccatagcacgtctgacatctgtctgtccatctggcttttttactgtcacagggattccatccctgataagaaagtacttttcttcatttatctgtagaagagaagaagtagacagtctctgctccatgagcctgactgcctctgatatctggctgctgtccatccaaggattgaactgtttaagtgccttgcaaaaataccgcttcagaaaaatctcacgataagattcccgtccaagtgtcccatccttgcccagcacttctgtattatatgcataaaccacatcccagccgagttcatcatgcagcagattcccggcactgttctgcactagaatgttttcggaataatcataactcatataaggataccccccttatacctcaatttctccactcataagcttcggaagcaggcggtcgcgagcttcggaaagcatataaatatttttctggcagttctcgatttttaaaaacagtgatttcactttatcatgaaacttagttaatgtttcattatcgggtaatacaattggcattgattttacaattttagaatttatagcttttgatatagaagaggtacttcccaaaacatcaaaattaaaatttgaaagatagcaaaatagatactcccgaatagtatcatcaacatagaaatgagcaattgcttcattagttgccatctttttttccgcaatagctacccttccaacagtcagcttaaaactcaataatattgttcctcttggaacaacttttacagagttcctttttattgcttctccagttaattgttcttttgtattaaaaagaaaaacagcatcattcatgtcagaaatagatacccatgggattccacctttatcagtaaaccaatatgattcagatcgaggcggcgttttaccaattgttattttacaaagctccattgcctgaatagttttccaagtatttggcattccattttctatctctgtattttcatgtcctggaaaccgcaaatccacaaaccattccttataaatccgctgcgccgcctcttcaagaagctttatctgcttctggttattttcaataaggttatcaaataaaatcaaaaaattagatattgtattctgcgttgacatatctggcaaaacaacatctatttccttcaatgagctcgattttattccttttacatttaccccatttaccaacgatgaaatttgttcttttccagaatgtgaacgaaaccaataataataaaataaaggattgcatattttttcatttaatctaactctaattagtgaagattcaaaaacagaaggttcagaaagatttcttactattgaacattttccagcaccagactcaaccaatgatcttctagcaaataataaatcgccttcttttagtccgaatgcttgtctttctttatctgagacaactattcttctcatttcttgatttcctatgaagccatatgaaaataattctcccatatttacaatctttgttccatatccatgaaatttagatgacttataaatgccgtttttagaatcttcttcgtataaatccttaaattttacttttttccaactcatacccccatctcctccatattctttgagatggtctccatcagctcatcattctccttttgaagcgcaagcagttcatgatggatttctttcattctctcgttgaaatccactccatcgtcttcctcaggtgcgacaccgacataagctcctggtgttaaggagcagcctttttcttcaattatggttttgcggtcagctattttgcaaaggcctggaatatctgcataggttccatcaccaaacttctcatatagccagactgcttccttcgcgatcgtcagagtattattgagctcgtttattttttcatcaaaatcagactgtacggatttcctatccttctttacagtggcttctactgcttcttttgcctctcttcgtttatcctcgattttcttttccagagctttcttaatgaaatcaaacgattcagctgaaccgagcgctttgtgatattcagatatgagtgctttgtatttttccacgtcaccgcgatacagccagactatcgcgttcagattcttaagctgccaatccgaccactcatttaaggtgcggtcgacaactgtatagtagtttctggcgtcgatgaaaagcaccttatcctgcagtgcctctggctttcctttatcaaagaaccacagcgtacaaggcagacttttggtatagaaaaaattatttgcgacagaaatcatgacatccacatgacctgtctgaatcagcgattcacggatatttttatccttgcctgaagaatctgttgctgatgaagccatgacaaaacctgctctgccatgctcattcagataactgtaaaaataggaaatccagagataatttgcattgctgacttctttcttcttattcactgatggcatgccaaacggaaggcggtccgcggcacttgctgactcagccttgaccttatcgacattgaatggtggattcgccatcacatagtcgcacttcccattcaagttgtgcgcgtcatggtaaaaagtattcgcctcatccccggatttgataacacctgtgagtccatgaactgccatattcattagacagagctgggcgttgtattcgaccttctcctgtccaaagaaagtcatcgtgtcatttgcctgcattccagcatgatttacaaaatcaccggtctgcacgaacattccacccgaaccgcaggcaggatctaacaagactctatctttgatacaatgtgcttttcccgaatatgtacttcgctgcccgtagaaagccttattctgcgggcttttctgcatttcaaaaggcacaaaccggcctgcgaatcgcggctgatatgcccttgctgtcgctgtactcattccggctgtgcctcctttccgaaacccctaaatggcaatccttaaaaagtataggtatccttaaattgtgtaggaaaacttaaaaggtttaccaagccttctccaaatcagactctgggaaggaatcaactgttcggccatcatccaacgagaccatatacaggccgccgttgatatcgataatcgttccttcctgaccgcgccaacgcacacgcacatggtcaccgatacggaaacgcggcgtgcttttcttggagccaagctctgatgccattccagcgaaagcaaacaagccgaacagtttacccggctttttctgccttggcgattcatcgacaggctcctcaaattcctcgtcttcctcgccgtaatgacagtaacgcttctccaagtcagcataaatgtcatcgtccatgctgaacacgagctcctcgacctgctcctgtgtgaaatcaccaagagccgaagtcaccatctggttcatacattctttactgacaaagccctgcatttccacaatctcatccggagtaaaccggacgcctgcggccattgctttctttgccagacgtgaagcagctttctcgtcggaatacatttggatgatttctgcgacctgttcatggcagccaaacgaggtcagctgtgaaatacgactgacctgcgtgctatctgcccattcataaaatttgtcgtagaaatcttcccatgtcatagcttcttcattcctcacggataatcagttctttaatgaaaccgacagttctcctccgaagttcgtcgttacaaaagcctcgtcctgcaggatcgcttcttttgccagacgatattcaaatgggaacaagaacgggaactctgccaacgcagagaaagtgtaataactgcttcctccgaggtacatagctacctttgtcatgaaggttacgatttcaggatttgtcacgctgatctttactcgtttctgttttccgaccgcaggtgattccactccgccaagctcacgcatggtcgagatgatctttgtggtggaataatcgaccgtgcctctctctccatattcatcaaaggtctttttacgaatctgcgtggtggtaatcgtatcctcaaactcgaacatcttacccatcagcctgctaatatccaagaatacaggataggccagtggcatcatgcaccagccgatttcagtcaggttatccgggtatttctgtatcagcctccgaccttcttcctgaagctgctctacgccttctgaattcaaataccagatgcgcattaaaatctcacgagccttgcgtcggttcgtgggactatctatttcataggaaagatgctcctccagctgctttctatattcagcctctgggagattatcctccagcaaggccacggcttttctcatccagccttgcttcactactaaacttaatccaaccatcttagccattattctgcaccgcctttattttgataaaaggtaccactacctcgtcgagcgacatcccgccatgcgtcataacggcctcgcctttaacatcaagtgattctcctacattacaaatcaaatagtcatattcctttggaaggtaatactttggatactcaatcaatccgtatttctggatgagcgactccttgtctgcaaaatccttcagcaccaccatcttgtgactctttgtctcgacctctactccagagcccatgatcctgccaagtcctacgcaggccgtgtttccgtgatctgccgagatgtaaacatcaaagccatctgcaaggaaccgccgtaccatattgctcagtttcttttgcccagtcaacaatttaatatcgtgatacattccgatgcgtccctgcgtctgggcatgtaccatatcatcgacatcgttgatgataactgcaccgcagcgtacaaaggaaccaaagctcgcatcgtagccgcgctcgtatccgatctgtgcatctgtatagccgagcttcttggcgcagtcaataaactcggttttctccttgctctgtttccacggttccaccagctggcttggatatttattggaaagcaagcattgacgtgagattgaggtggttgacgggatcatggcaaaggccgcagcctgctcatacttgatcccatcgaaggacgtggagaagattctccaatcaaactccgacatgccgtccatcacgataatcacaaacttctcgctgtgctcatgcatataatccatcgccttgctgacgagcaccggcgtgtctttgtctatagaggacgatagctttccaaattgctcaagcgcgtagttctgaaaaataccattgatttcagtcgtatccagctctatttcactttgaatcgccaacagatctaatctggacttttcctccgcgattgcaaaccagtccttatagttcttcgcctcgaccacccggctcatcagctcggacagcttctgctgcaaataccactgtacgttcgccttggcatagaccttcatacgcagaaactgcgcagtcgcttgccgggagcgcaggtcgtcgaaatttgtcgaatagacattacagagcaggtcaaaatcagtctctgttttgcccttcagctcctccggattcaattttgggaagagatgctgcaaggacacctcataagcgcggagtcgcctgtgcatatcatagggaatatagctgtccgtatgtgccagcactaccagcttggcatcattggagtacagcttctcctgatagtttatccggaatttcaggtcatcctcgtaaacgacaatctcaaagccatgtgccgagaacgcagacgtataatcaacctgctggtacagatcgtcgttgtccacgagcagaactttcttcgagtatggcgcagacgatttctcgtacacatagtctccgaacatcagttacgcctccaatctgatcattatcatcatgcggaagtccgggtagacctgacttccttttttatattctgcctcaatggtagccttctcgcgctccagctttgccagtctggaacgacggatattttcaattccaatatgctcagcggcctctgttctgagctgcagagcgtacatatacttggtgtagctttccttcttcgtctggatctgcttatccttcagctcgacgaatgtgtcataggcaaaatccatgcacatcgcttcgagcttcttatattcttcctctgaaatgttcggtgccgactttaccgtcagcttgctattcccatcaaggaatacgtccatcagacgctttccggccatcggacgcaggataaaattctcgtttacaaagataggaatgatcctcttaccgctttcttcatcggaaatagagagctcccatagcatgaagtaacctgcctcattcggaaagtccttgatgcctatggagaggagctgggagtcatgatcctgaatgatgctcgtccgcaggtgctttgtgatctccacatcgtttatgctgatgcggtcaatgagccgaagatcgtggcctttccagctttcgtagtaagccatcatctggcgcagggcaccatctacatcaaagtctgactctgttccgacaaggctccgcaaatctttttcttcgcggataatgtccttatacttctgggcattggcgacctgctgcttcacttccgactcaaccggatacaagtttttctctacagagcgtggcttgccgatggagttcatgtagacctcggtgaaatcaacttcggccacctcgctgtcgagaacgtcggaatacttgtccacacccatctccttgaggatgacggagagcttttcttccagcacctcccggacacggcactcaaccgtatccgtaatgataaaattgtagatatgaacatcccgctgttggccaatacggtctgcacgaccacatcgctgttcaatcttcatcggattccacggcaggtcatagttgatgatgatattggagaactgtaggttcaggccttcaccaccggcatccgtggaaataaatatgttgctcttagtcttaaattcaagcagcgcctcattacgctcctcaatattcatgccgccattcaggatcgtaaccgtgaagccacgattctccagcagctttttcaaatagccctgtgtggccacaaactcagtaaagacgatgatcttctggtcgcggtcttcgctcaaaatctcgtcaatggtatcgactagcttttccaccttgacatccggatactgaaactccgcctgcttggcaacggcgatgatgcgttccagttcctcgatttccgtatctatatccaaggacatagcctcgattgcttcctcaacaccgtcttcaatatccagctcggccagatcctcttcggtcaaagaaccaatccgtgtgctctgcgttttcaacacttgcaggcggcgctccaagctctgccggacggctgccgtactgctggtcaccatgcgctgcataataatcagcaggaagattaagcacatgttcttcttccggttccggcgtgccttgtcataggtcttggaaacataagtgctgaccagctgatacaactcgcgctgaagcgtatgcctctcgtcccaattcagctccaccagatgcgtgatccggttcttgaagagccgatttccgttgttgtcgattgcctcgcgtttctctgtacgaatgaggtatggtgcgacctgctccttcacaatcgactttgcattcgggaaggcttcttcatccagaagccgcaccaaacgcaggaaaggttccgtcttgccgttatgcggcgtggccgaaagcaaaagcagatatgggcttgcctgcgaaagaagatagcccaacttatagcgagccacctcgccggaggagcctgcgacacggtgcgcctcatcgatgatgatcaagtcccagccgctgttgataatcgagtaaattcgctcttcgttatatttttctacgcgctcatccgtccaaccggcgtgcttctcgataggcttgatggagtccatcggagagatgacctgatcgaactgaccgtaaacatcatccgcatctgtgagacggcggatcgtgtcataatcagacggcaggatcacttgaaacttctcgtggaacttctcctgcatttcagacgcccactgcgtaacaagaccggtcggacaaacgaccagaactcgctgcacgaggccacggctttgcaattccttaatgatcatcccggcctcgatagttttaccaagaccgacctcatccgccagaatatatcggatgttgtttgtctccattgcgcggttcagcacatggagctgatgcggcagcggaataatcccgctcgaaagtgcggaaaggaaaccaccggcggtctcgttcttgatcttggccagcagagtgacatagcgcagatagttctcatcgtactgagctgcactgccgcctttattcagttgttcttcggtcgctttgtaaacctgacctgtggcagaatcgaaaaccttgtaggacgtgtatccccacatctcgattctttccagcacctgagcattggcaccggctacagaatcaaaaacgaaatcaccggtattaaacattacatcgctcctttattacacgcggctcaaactgatgtcgtagtacatgagcagattcgggtcttcctgaatggtctgctccggcaaacgctcggccactgccacgatggcagcgtaatccttgtccttccagagcttcgagaatccagcacgaatagcttccgagcggaacaccttcagcttgcccttggactccagataagtctggaattccttcagcagattcttctcacgcagtttggcaagatcaccactcttggtaaggtcaggaatgtaccacttaccgtcgtcatccttcaggaagttctcttcgagaatttccagcagttcaggcatcttttctctcttatctactgcttgaagttccttcataaatttcggctgaagctccgcataagtcatgcgaccgtttccactattttcatcgagttgctggtacagccagccaatagctgacttctcatctgacacaaataaagagaactgaatgttctctacttccatcgtagagcgagccatatcatattcgttgacctgatcaggcaggaaatacatcccatcgcgcttaaggaaccgttcatcaagacctttataaaattctgctgagtcaagtggaacagcatagccgcgcataatgtggtaagaaaccatccggtcgaacagcaaaaatgcctgacgctcagccaaaatgtcaatttttccatcattatcagagtcaacaacaaccggcaaattagaaagatgctgcctaacgaactcccatgcagcctcatcagtccctgctttaacagtaaagttcttcaggaaagacgaagtcggcttgtaagctgatattactaaatcctgcttaacagcagcacctgaagttatctgtttaaaactgctttgcttcttgtcgagtgtgcgcacatctgcaatgataaaccccgctcttgctaaggcttcctgaatggcattccatacagcattctttgaattgtgaaattcaacagtcatccagtgattcggttttagtacacgataatactcagagaagcaagacgtcatcaattgctgatattctggtaagtatttattttgctctggattgacgattgcttcttcttcattgttggtcactacacgcagccacgattcccacatgaagctaagctctgaatagttcaaattcccgccaaaaggaggatcagtaaaaatatagtcgaccgtgttatcatccaatccactcatcgatgtaagagaatttgtactaattagcgtggacatatcaaaatcataaatcttatccttcagctttcgaatggatttgtatttcccttgaatccagtccagcacattccactctcttatcatcgaaccaacataaagtgttcctgaaaggatcatgttgggaaagcctgaattcaaacggaatcgctgaagtttgctcacgccctgcattactccggtaacaatcgacttaagtgcaatttttacattatcgctctcttccgaatttgttatctcatcccataaaaccgccaagcaatacaagtttcgcttagtaaagaaatgatgagcatgtgtgataccatatttatcgtttcttctactttcaccgcccactggcattctatcggtcggaacccaataaggaatcttcagggcttcgattttatcaatcagctccagatcggttttatcagggctcttatagcattcctgccgaccgttttgataagcaatcaaaactggtacctgttttgtcgtatttacaatttccccgatataatcatcgagaaaactctttactgctcgctcacaacttttctttgtaatttcagcattacatgaagggcagaggaatttatcttttacgcttccagtttccttatcaacagcggcatcccagaaaaccacttccttgccacagtgcgggcaaataaatacgtccgaccacacagtataatttacatggtgttctgctccggtttcgtccttcgtcatatacatccatgcgcattctttatcagcgcgtgcagacattttcaaaaaggctcgctcaaaaatctgcacatctactggttggttataaactgcagaaatatatgtcgcagcaggcgaaaggtcactaataattgactttcttgtaccccactgcttactctcaaattcaccggtcatctcgaattcaagagaatgatctgaactaccgcacatttgagcagccactgcagtcatccccgtcccgcagaatccatcaaaaacaacatctccgggctttgtatagtggaggatatatcgcattatggccttataaggaaccttcgtgtgatagctatgagcattatagactggatcttttttcccttcgcttacatctgctgcaaaaggctcacacctatatgaatctgacgtttcgtcataaggaaccccgttttctttgacgaattctccaataaacggattcggacaagccgtatagtaaggtgcattcgaaagctcgataatatcctcatcggagccttgcggaaacccttctgtgccacgcaccttgtcaatatcagccttggtaagtattcttcgttccataggttactcctcgctttcctttctcttcacaacgatgcggagcttgcttgcatccttgcctttcgtataggaaccgaccagctctgcaatcttgttcttgaagctcgtctcgtccatcggcggcagctgctccaactttgccaccagctcatccgtatcgatcaccaccggctcgaagcccttcaacaaagcattgatggctttcacaaagaaatcgtccacacgcttcggcaacgcaccggtctcgatgaaggtgtcgattgccttttgctgttcttccgggaggaaggtcttctggctggaaacaatcggatcggagatcgtattcagcagcgtctgcgtccactcatcaagcaggctgtcaatcctgatttcgatgttatcaagctgaccgaacacattctttgccttatcatccagatggaaacggcaatgcgggcaaatatgcgtcgttttcaattcctccggagtcagctcatagcaaacaacaaggccggacatatcggtctcaatgtcggtgagctttgcagccgagagaatctcgatggagcggagctttcggaggcttgccagcgctttgccttcctgaatctttccgcgacgctgtgcatcggtgatgtcgagtctctttttcttgtgcgcatcaaagtaaatatcgatgtactttgctttgaccttgccaagtgctgcatcaaccttctgggcggcagcttcgccggattcaccgtccatgatgctgtcgcggatggtacggaagctgcccttggcctgctcgatctccgctttgaatgcctcaccaagatcgatgtactcgatattctgaatgtaggagactacatctccacatccattcttgaaatccataaactgaggaataagcatcgccagcttaatctgctcctgcagcgtatcgacctgctccatagacaagctgaaattattcagctttgccggagtattgaacttcgcagaatagttgctgaactcgttcctgacagcattgcaggcatcacgcaagcgattcatgtctgtgctgctgaccagaggctctccccagaggtcaaagccgttattcagcttgtttgccgccatgactgcggaattactcatttcctgtgccttggaaagaagctgcgctacaccggtctcgcggtcgttcggattatccagcagcgccggattcagaccgagcacatcaaacagtcgcttcaactctgccatagatgcctgcgcaggcttggagagatacttgaactcgtacaaatccatcacgccaatcttcggaatctggtcaagatttgaggccgtgattgtggtcttgccgtccttcaaggtgataaccgcatagccgccataaaccatcgacaggaaaatgatcggcgtgaagataaattcaatctggaaacgcttgtccacatacatttccatgaagcgctgctcaaacatatcggagtagtttaacactccctgcggcggcagcttcttcacaagatcaatgtaataggccgcatacttggagccctccggacggattttttctccatcgaggattccaaagctctgcagcatggccgttgactgctgcgtcttcctgccagcgaaatgatcgaaggccgcacgagcgcagtcagccatgttccggcgggtgatctttgtcttcataaccgggaagtccggatacttggtattgaaatattcgtcaaaggtcagagaggcagccagatcaatcgtgtccttaaaagtgaggtcagtcttgtatctgcctttcagcacttcaatcatctgacgtttctgcttcttataaaccacatcaaagcaggtgttcttgttctcgctcagatacttgatcaggcgcttgcggagcatattcgccttattcaggtaggcatccttgtccttgccttcgctgatctgggcgaggctgtttgccgctgcgtaaagtcccatgacctctcggaactcatctgtggacttgaagtacagatacacctcgtcctgcagattctgaaccgtagtgcccgcagcatcatacggcggcatgatgtggatatagaaatcacgctccggctgtgccgtgcttctttctcccggcagacccataaacagatatccttcgcggaacatgttatgggaatcccagttcaaatcgtactcgtaaatattgaaattcgtgacatactgcttggcgtcccattcgaggcagcgatataccacgtcgtagaaatagcgattcagctcaccgtcggccataatggaagccttctgcttgatcttctcatcgtagtcaacgatcttatctacatcgatgtaatactggttattgccatcgttatagatgatgaactgaccggaaaccgtcgtcatgatatccttcagcgtagtcttgatcagcgaaagaaggaaatcggcatcctcctccggcatcggcagatacaggcaaaggtcatctttcaggttttctgctgtcaggccgaactgcacatcaagtccattcgtggtcaggcgatggacgctgagtgcatagatgatcttgatggccagcggcttatagactggcttcgggaaagcgcgattgatgatgtcctccagctgctggctggcattcacaacgcggctgatggttacatcgctcttcaacaggccgttagacttgatcgcaggccagtaatcatcaaaggagatgatgcccggctcgttctccggaacatcgttattgaaaatccccttgatggtcacggagatattcttcaggatgtgcctgttttcaatcagataaatcttattgaagacatcgatgtaggaaggatggatcgggaacagatccacaaactcctccaagcgagatgacatgccggtataaaggccgcagaacttttccagatgcttgcggatcaatgctttctgctccggtgtcttcttgagaatacgctcggaaacaacgtaggaggtggcctccttcgtgataatcagctgggtgaagcggtcgctgacgtgcttcaatgtatccgcaacaaagctgaaacgaggattgtcgaagatcttctcctgcataccgaagatcacacgcagctttgactttgagcacatttcaccaagcgcacggaaaaactcaagatcaaggacaatctcgcgctcgttacgagaggacagataggaaaggaactcatccactactatcagataacccttatccggatattttgcagaaaaggccatcatcatatcctgaattacggtcttgatgcttttgacgctgctgtactcaggagcctcgaagctgattccgcgccggtcaaagtcatcctgaacatagcccataatgacatcataaagaggcatcacgacaccgccgatctcaatccggagcacttcaaactttccggcaatcggctgtacctgctgcttgaacttctcgttctggagatactgcacattgtcagcatccgtagctactgccgagatcacggacatcaggtgggatttaccggtaccatagttaccgacaacaagcacacctttattatcaacgacctcgtccatctgcagctgatcaatcatcggtgcctgcagagcctctgccatagaatctgacatgacataagtctttacatattcacgcgctttgtctttgttctcagccgtcacaagctggatgacgtcctctatcggattaaagctgattaattgagagtatttcatgtgaccttcctcctaaatgacgcatgtcacgtcgtaattattgatgtcaaacatcttgtagtccgggtatccttcctccgcatagaatagtttcccatcctcatattttcccggccagacaacgctaaacggtttccgcttgcacgatgcgaccagtatcttcaagacatctaccttgtaggccggattaaacatgacgtcaaaatcttttatcaccacattatccggcaggctatccagcacacgattgaagcaggcttccagctgcatcgttcttcgattcgggcggagtgtttccagttcttttgccagctctaaattgattgatttcacttctcctttagcaaaatcgccacaataaataactggcttcataagaccattccgctgggcatctgcgaaggagaccctgcttattaccttacccatccttggcctcctctatgttttccttgtttctcattccgcttcctccatcatgtgtctgaaatgctgtccctgattcatcacatcaaagatggaatagaacacacttctatattgatcacaatcgatgctctcatccacgaaatggagtccgtcattaaaggagtccgaacgatttatgtaagagagcatagcctgagccagatggtatttcgtgtaatcaggaactccaccggcggcctcatccatgatctgtttctttagtgcttcaagcactgtgttactgagcacgctgctttcaaacccgcaaagctgcaagaaatagtattcaaggattctccggatcacgttcatcagcggaatcggtgcatccagtttttcgtattcccgccagagcgcagcataagaattctgaaccggattgaaattcctgtctttttccgaaacctttgtggcctcaataacacacttctcgatggacgagatgttgttcttcttgtttaccttaaagaaagtgacataccggtaatggctcacctgattgtatgttatctccctgtggaagaaggcattgtgcgtcaggataaatatctgctggatgtactttcccttgtattcgtgatcttcgagccggacattattgctgcatacgcccagcatttcccgtaccaaagcactgacgataaacaatgcgctggagtccatgctggaaaccggatcgtcgatgaccacgatcttgtctttgccggaatccgtctcggtttggctgccgcgtaccaaatgatagaaatacaggaacgcgataaaattcctctcaccctcgctgagtttgtcggcaaccttgccatcctcgcggatgacttcgtaggtgcccttgactccctctttctcccggagacggaagccttcaaagccggaatccttcaagtgcgcattgatgctatctaccgtcgcagctgtattgataacgctggcattgagcttgttgatctccgaggtcagcgtcttgtatttttcctgcagtgcttttacctgaccatccagtcgcttcgcttcggcttcaatatccttcttgctcttgttataggccgctaccttatctttcaagatgaaggcgattttctcccagaccatattgaagcattcaagttgcttatcaggcttcgtatctacgatatcgttgttttcctgaatcagtttattgatacccgtaatggtgtcatcaatatcagaaataatggtatccgtatctttgagtgtcaccggctcgcccggagtcgctcttttctgcgcgataagctgctcattttctgtaatgagagtttcaagctgcgccaccagcttttcatattccgctgtctttaccttcggaaacacatcggtcaggttttttttcaacagctcaagcagcgctgccatcttcctcgtgtattcagtctcgaaagtttccagcgcatcaagcgctttctgatatccttcgtcaaacgcctccgcaatgtccttctcgaaatcgtccggcagctttctctgacagaacggacacttgccttcatcgtgaccaaccacataatcggcatggccttgcttcacccattccgtagcattgagagccttcataaacttagcgaattgcgtctcgctccggctggtcacttcttctccaagatgactcgcgccggtcagatcatattccccttccagttcagaagagaacttgaacaacggatacctgcgagcttttggatcgtaggcgatatcatacagtttctggatatcctctttcttgtgatcgacggcagagtgtttccctgacagcacttcgtctgtaaactgcagcttctttttctttccgttctgtgtctggtcgaaactctttctgatatcctctgtatcatcccagcaggtggtttcaaaagcatcacgcagaggcttgagctcaccgctctttttatcgcggtcttcagcagcctgtttaccatcagcaacgacgtcttttctttcctcggtcttttcgtcgatctgttttctcgtctcagcattttcctcactaagcgtaaatacgcctttaaggtcaccgtagttagccagattgcgatctatgaattcctgattataaacaaggatcgtgtaatcagccgaattaacacctgtttgccattcaaggcactccggatgctcgaaagcatatgctaccgtgctcttaccggctccattctttccgaaaaagaagtttatatatgtagggtctaccgtctcaccatgaaaagtggcagcatccagttttatatttgtaataagggacttcattttgtcctgcataagcattctcccttctgccacatatctacgtgcgacaattaatccgtgatcttcccatcacgcagccattcatcaacctcggatattttgaatttatagcgtttgcctgctcgataaaatggtagctttccgtcttttatccagttccttacggtatctgtgctaacactgaggtgctccgctatatcttcaagatttacccacttttccggtgatgtttctgatgttgatgtgatattttcgatttcgttactcatgtgacttcctccattacttaaacgtggttcaacccatgttaaacaccgggacttgaaccccggcctcaagaagctcctgtattagatcgcacctcttgattgaccagtgagtcctattcagttcattgaatctattatccccgacgagtccgagctcttcgagacattcattgagtcgttgctgcggaatatctatcttgtatccgcaataataaattttcacatcattgtcatagattttcaaatcagatacaaaaccataaatgaccatctggtcgtcgtctgcctttccgtaattccggttctcggccataaagagcgacggcatggtttttatttcatccttattttcctgtgtcataggagcgaatcttgccatagtctcttctgacatcaagtgcgtcagcgcccgatcacgcggaaccttaaaatacggcttatcaaattcctctccaccgatcacgaatatattgtagtattcccgattcactctgaccggcacatagaagttcccgccgaaagcaggcatagcagcgaactgttgctgaatggtcatattgatggtgccgtagtttggaatcgcaacactatcgttcccgtgctgtacaatctgcgtccgtcctgttgcaggaagcccggttgcagatattactttgacttcattactcattcgagccacctccgtgtttgccaagcgtcagattcattgttccgtaatttgggataacattactgttggctccggtctgcgatatgaacagcggattgttcattaccgtatgagccggaggaggtgtacccgttttgctgtcctcatctccaaagtcaaaatcatattcttgccctgattgacttccagactgatccgcgtcttcatcgccgaaatcgtatatatcgacttcctccggcacatcaggcatacgcacgtctatttttgtcgtgatccgcttgcccatattcccggagtaagttcttggagctccaccgttttcagggcaccagtcatcataagtcgctttgccgacactgttgtccttccggtttacaacaacatagtgccagactccaagtaggaatgccggaaggcagacatcattgagaccgccaagcgcggtcttttttattttcccgccattctcctcgatatagaactcctcattcggctggatactgtcgtcctgctcaatcaggtcgattagtgccttcacaagacgcacatctttttgtactgccgtacctgtctcaagaaacatcgcggcgaactccgtcatggcacccagagcagcctgatagtctgttctgacccgttcatcgaaggcctcgacctctggtttgtcgccaaacggcagatactgaccggtcgaagtcttacaggacttgaagtcatttgttttccctttcagggcaccttccttgggctcctgatagtcgggattgatgaccttgatcaatccaatcaagacttcgggatcagagaggccgtctcgttctcccttatagtgctgtcttgctttgacgcgctgccttagcgcctgcaataccaacacgaagaatataccgccacaaagtcgcggtttgtcatttattgtcactattttactctccaattttcatagtcgaacctaaagaaccttacgaactatagcagccgacctaccgaacgattggatagctcttgtgagtagtcacaagggcaattttgcgttcagggataggtggagctggcaggttcagtggttcgtggttgttccgattgtttcccaccaattcctattatatcaaagtgatgcacagatttcaatacactgcgatgaatatctgatgaacgcgccatgaatttccccactgtgattgctcaccaaaaagcaaatcacaggaggaaatcttatgacaacagaagaaaagacctatttcatctacatccgcagtaccggtgagaaggtgccagtctccaaggcgcagcacgactccttctatagagaggcgtcccgcatccgcaacaaggaacagaaccacggtcgctgcatgtgtccataccgttatatatggaagtgcgacggcgactgcatcggctgcgagtaccacgctacgggcgacacatcttctctggatcagcctctccctgacggcaacggtaccatcggcgattatatccctgatacccgcaagcctatggacgaggtcatcgcagaccgcatgctgctggagcagctcttttcccgtctgcgcgagcttgacccagaggccgataccatcattcagctttggaaggatcatccggagggcatctccgaccgtgccatcgccagagagctcggtcgcccgcagaagactttcgctgatcagatgaagaagtaccgcaccgaccttcgcaggattaccggcgacaagtaatacccagaccacgaaccacggctttccggtcactgtcccacttcgggatggtggccggaaaactttttataaattcttccgctcaaatcgacagctcatctccagtggaaggtgaaggacagagacaaagccttcagaaagcgaggtgaacacgatgtaccgcagttacgcagacaccggcggcaacgtggccgaggagatcaagctcctaaataccatcagccacgtatccgccagactggcaaggaacctctctatccttgccgcaagcaaatccgaggaaggaggaaaaacgaatgtcaaagatggcagaaatggcacagaccatcgaagaactcagaagcgctgctgcttctattaatgccgcagccgactggctctaccagcagttttccggcgacgacgctcccgtgcagaaggctcccgccaagaaggaaaatccgaagcctgaaatcaagctggaggacgtaagagccgtccttgccgagaagtcccgcgccggtcataccgcagaggtacgcacccttctccagaagtacggtgccgaaaagctctcggctgttgacccggcaaactacgaagccttgatgaaggacgcggaggtgatcggcaatggcagctaaagcacacgcgatcctgtcggcttcaagctctgaccgctggctccactgcccgccgtccgcaaggctctgtgagtcctacgaggataaaggaagcgactacgcagcagaaggaaccgacgcccacgcacttggcgagttcaagctaaagaccgcgctgggactgcctgcagaagacccgaccgaaagcctcaagtggtattccgaggagatggaggactgcaccagcggctatgccgaatatgtgctggagcaggttgaagccgccaaggaaacctgcgctgacccggtcgtcctgatcgagcagcgtgtggacttctctcgctgggtagaacagggcttcggcaccgccgactgcatcatcatcgcagacggcacgctccgagtgatcgactacaagcacggccttggcgttctggtctccgcagaggaaaatccgcagatgcagtgttacagccttggcgctttggaacttttcgatgcgctttacgacatcgacaaggtttccatgaccatctatcagccgagacgccagaacgtcagcacctacgagatcagcaaggaagatttgtaccgctgggcggatgaagtcttaaagcccaccgcagagcttgcctttgccggtgacggaaatttcctgtgcggcgaatggtgcggattctgcaaagccaagaacgagtgccgtgccagagccgaagcaaacttaaagctcgcacagcacgacttcaaactcccgcctctgcttacagatacggagattgaggtcattctcggaaaagtggacgagctggtcagctgggcttccgacatcaaggaatatgctctccagcaggcactctccgggaaggaatggtctggcttcaagctcgtcgagggcagagccaaccgcagatacagcaacgaggccgcagttatcgatgcggtcgagaaagcgggctttgacccgtatgagaagaagctgctcggcatcaccgccatgcagaagctcctcggcaagtcccgttttgatgaactcctgacggcctacatcgaaaagccgcagggcaaacccactcttgtgccggagtccgataagcgcccggccatgaatacagcaaaaaatgattttatggaggaaaacgacaatgagtaagaatgtaaaaatcagcaatcccatgaaggttatcaccggtgtcgacacccgctggagctacgcaaacgtctgggagcccaagtccgtgaacggcggcacacccaagtacagcgtgagcctcatcatcccgaagtccgataccaagaccatcgccaagatcaaggacgccatcgaagctgcctacaaggagggcgaggccaagctcaagggcaacggcaagtctgtaccggctctttccgttctgaagactcctcttcgtgacggagacgcagagcgcccggacgacgaggcttacaagaactcctacttcgtcaatgccaacgccacctctgctcccggcatcgtggacgcagatctgaacccgatcctgacacgctccgaggtgtactccggagtgtacggcagagccagcatcaccttctacgccttcaacagctctggcaacaagggtatcgcctgcgggctcaacaacctgcagaagatccgtgacggtgagcctctcggcggcaaggccagcgcagagtctgacttcgctaccgatgacgacgaagatttcctgaactgatggaggtgcgactatgaacgaagtaatgatctccacagtcctctgcaacattctcgtcggctgcttctgcgtgctcatccttgtatgggcggcagtcgcagtccagaccctcttcaatgatcgcaaacgcgacaagcgagaggcagaacgtgaacagcgtgaaaaagaacaggccgcccgcgacctcgaataccacgaaaagcgcatgcaagccttagacaaataactgacggcaggcggcttaggagcgatcttaggccgcctgtttgaattgaggtgatccgattgaaaaacatcagtatagatatagaaaccttctccgacatcgacctgaataagtgcggcgtttacaaatacgcggagtctccgaactttgaaattctgcttttcggttatgcggtcgatggcggcaaggtgcaggtcattgaccttgcacagggagaacatatcccgcaggaaatcatcgatgccctgacagacgatgaggtgacaaaatgggctttcaatgcgaactttgaacgagtctgcctgtcccggtatctttccgatcttggcgtgagccttgatcccttccatgataaccaccctctctccacggagtgcgcccggtttctgaatccggaaggctggcgctgctctatggtctgggcagccacgatgggactgccgctttcattaaaaggcgtcggtcaggtgttaaagctcgaagatcaaaagatggacgagggcaaggcgctcatcaaatacttctccgtgccttgcgctcctaccaaagccaacggaggccgcacccggaacatgcccttccatgatcctgaaaagtgggaaaccttcaaagcatataacaagcgggacgtcgaggtcgagatggcgattcagcagcgccttacgaatttcccggtaccggacttcgtctgggatgaataccacatcgatcaggaaatcaacgaccgtggcgtgcgccttgatatggatctggtggcaaaggcaatcgagatggacacccgctcccggacagaactgaccacggccatgaaggatattacggagctcgacaatcccaactccgtccagcaaatgaagcagtggctctctgacaacggcctcgaaaccgacagtcttggaaagaaggtcgtggccgaactcataaagaccgctccctctgaacttcagactgttctggagctccgccagcagcttgccaaatcctccgtcaagaaatatcagacgatggaacgggcggtctgcgatgatggccgggctcgcggcatgttcatgttttacggagccaaccgcaccggtcgatgggcaggcaggctgatccaattgcaaaacctccctcagaaccatctggaggatctggccgatgcccgcgcccttgttaaatccggagacttcgatgccgtgaagctcctgtacgaagatgtgccggacacgctctcgcagcttatccggacagcatttattccgaaggacggcacgcagctttatgtttcggacttttctgccatcgaagcccgcgtgatcgcttggtatgccggtgagatgtggcggcagaaggtctttgcagacggcggcgacatatactgcgccagcgcgtcccagatgtttcatgtcccggttgagaagcacggcgtcaacggccacctgcggcaaaaaggtaagatcgcagaactcgcgctcggctacggcggctcggtcggtgcattaaaggcgatgggtgctatcgagatgggcttgtccgaagacgagcttcctccgctggtggatgcttggcggcagaccaatccgcacatcgtaaaattctggtgggatgtcgaccgggcggtcatggaggccgtaaagcataagcacacgacctcgtcctacgggctgaccttttcctgccgctccgggatgctctttatcacgctgccatccggcagaaacctcgcctatgtaaagcccaaggtcggcacaaacaagttcggcggcgagtgtatcacctatgaaggcgtcggagccacgaaaaagtgggaacggctcgactcatacggcccgaaatttgtggaaaacatcgtgcaggcgaccagccgtgacattctctgctatgccatgaagacgcttaggaactgcgaaatcgtcatgcatatccacgacgagctggtcattgaggctgatcctcacatgtcccttgatgttctctgtgagcagatgggcaggacaccgccgtgggctcgcggcttgcagcttagggcagacgggtacaccacgcccttctacaaaaaagattaaatatcgtccgctcaaatcaggcgttcatctccagtggaaattagaggtggacgccttttaagtctgcccggaaaggaggactcaaggtttgagtaacgattatcgaaacagcgaaggctatcctgacccgactgccggtgaggcgatctgtcggattgccgccaatgagaagcagttcctgcgtgcctttaggcctatcgtctacatctgctctccctattccggagatgtggagggaaacgtggctgcggcgagacgctactgccgctttgccgtggacaagggcttcattcccatcgctccgcaccttttgtacccgcagttcctgaacgacgatgacccatcggagcgcgagctcggtctcttcttcgggaatgcgcttatgagcaagtgcgcagaggtctgggtgttcggaagccgcatctcatccgggatggaaacagaaatcaaacgtgccaagtggaaaggctaccacttgcgctatttcacagaagaatgtcaggaggtctaacaccatgtatgaagtaacagaaagacgtagaaaactcgaagacggcaccgaaatcacaacttacacccgtgaggttatcagctgcaacatcctgcaggtcgaagccggtacgaacggttttcagggaggtgactccggccacggcagccgcacctatttccgcatcaaggatctggccagcacagatataaatatccgttctcacaccgacagctatggcggcagcgagtttgaggttaccctcggcggcgactgtgagctggaaaccatgatccgggcgctgaagttcatcacgaaggtgctcgaagatgaatcgcaggaggtgtacgactgatgaaatacgccaccgccaatagccgcaaggctatcaaatggaaaaacggcgacacttcgatggatgccttaaaggccagattccagaacaccgtccgcaccacggagaccattgaggaataccgcaagatgtccaaagcccagcaggcagacatcaaagacatcggcggtttcgtgggcgggcatcttcggaacggtcgccgtaaaaagggatatgtgctttgccgctccatgctgactctcgacatggactacggcgagccggatgtgtgggataccaccatcagcaaaatcccgtaccagtgcctgtgccactcgacgcataagcatacaccggaaaatccgaggctccgtctggtaatcccgctcacccgcgagatcagcgagcccgaatatgagccagtcgccagaatgttcgccaaggaagtcggcattgatatgttcgacgacagcacctatgaggccaaccgcctcatgtactggccttccacttccgtcaacggcgagtatgtattcaaggaaaaggacggcgacgccttagacccggatgcctaccttgccaaatacgatgactggcaggactccagcacatggccggtatcctcccgtgagtcctgcgtggaagatcacggtgccagcaagcaggctgatcctcttgccaagccgggaatcatcggtgcgttctgccgggcttatccgatctcggaggtaatcccggagttcctctccgatgtatatgctccgaccgatgacgagaaccgctacgactatatccctgcggacagtcccgccggtgccgtttcctacggagataagtttttgtattcgcatcactcctcagaccctgcctgcaaaaagctcctgaatgcttttgaccttgtccgcgtccaccgcttcagcgatctggacaaggatgtgctggatgagtcaacctcgtcgaagatgccgtcctataaggccatgatggactttgcctccggctgcgacaaggtgaaaatcctgctgctttcggagaagcaggcgcaggccggtgaggagtttgccgctacagacgacggctccgatgatgactggaaagccaagctccaatatcagtcccgcagcaccgtccttcagaacagcgtctggaacgagatgctgatcttgaataacgatccggattgtcagggctttgcctataacgagatggccaaccgcatacaggtgatcggcgatgttccttgggatcgtcccgctgacaataagttctggcgcgatgccgatacggcgcagctgaaagccctgatcgacatccgctatgtctgcttctctgacagaaaccacaatgtcagctttacgaaagtggcagacgaccgccggttccatcccgtgaggaactacttaaacgacctgccgaaatgggatcaggtgcctcgcgtggacgagctctttatccgctgcctgcaggcagatgacacgaagtatgtccgggcagtcaccagaaaaaccttagtggccgccgtgacccgcatctaccatcccggcaccaagttcgataccgttcccgtccttgacggcgcacagggtatcggcaagagcaccatgtggaagtctcttgccggtgatgaatatttctccgacgccctttcgcttactgacatggacgacaagtccggtgcggaaaagctgcagggcttctggatcattgaaatcggcgaactggccggaatgaaaaaggccgacatcgagaaggtcaagtccttcctctccacttcagatgataagtaccgtcccagctacggcaaggtggtcgaaagtcatccgaggcagtgtgttgtggtcgctacggtcaacggcgagcatggatacctccgtgatatcaccggaaaccggcgcttctggattgtgaaatgtcgccagacggaaaatgccgtgcgctggaaaatcacgcccgaagaacgtgaccagatatgggcggaggccaagtattactacgagcaaggcgaaaagctgtatctcgaaggtgaccttcttgcggaagctgaagaagcccagagaagcgctatggaaacagacgagcgccaaggcctcgtggaacagtacctgtcaaagctcctgccggaaaactggtctgagatggatctctaccagcgtcggaatttccttgacggtgatgacatcacatctgattccggcaccgtggaacgcaccgaggtcagcaatgcggaaatctggtgtgaatgcttcggaaggaatatcgctgacttaaagcccaccgactcttatgccatcgcggcacttatgacacaggtggacggctggaagcgtaccaatcgcagggcttcccagcctctttacggacgtcagcgcctgtatgagaaaacaaagtaatcgggacaacctctgggacaaggacaacttttaccctttatttaattcagagaagaagaaatagaaggccactcaggcacccgcgtacacgcgcgtaggtaaatatagggaaaagctgtccatttgtccctacttgtccacttcaaggaggacgaatgagatgcagatagatgaaaagacaatcgagaaaaagctcgtaaatacagtgaaatcgaggggcggcatagctccaaagtttgtctctcccggctttgacggtatgccggacaggcttgtccttcttccaggaggagtcattgcctttgccgagcttaaggctccggaaaagaagccgcgcccgctacaactggcaaggcaccggctcctgcggaagctgggattcaaggtttacgttatcgacgatatttcgcagattggagggatgcttgatgaaattacaagtgacctgtgactggtgtggcagttcttttgaacgagaagccgcagccctgaaaggcaaaaagcatcacttctgctgtagaaggtgcctcgcggatttcagtaataaagaaaagaatcctgacggctatgtagccctcaaggattacaccaacatgagcagccacatggctcagatgaatgaggatttgaatcatacaagaatgacgcccgaaacccggaagaagctgagagcgtctcgcttaggaaaaggccgctgtgacggatattccaagatatacaacaaagccgcacatcgtgtgatcgcagaacaaattatcggtcgaccactgaaggctggcgaagttgtccatcaccgtgacgagaacaaatacaacaacgatccggataatctggtcgtattcccgtcccagtcggcacatgcgaaatatcactatgagacgagatggttcatttcagaaataaagcgaattgagggaggaggtgatgccgaatgaagttcataccgcacgattatcagaaatacgcgatttcttacatcgagaaaaatcccgtagctgccgtcctgcttgatatgggcttaggttgagggcaagacagtgattactctttcagcagtaaacgacctcttatttgacagctttgaggtacgacgcgtgctggtggtcgctcccttacgagtcgcccgtgatacatggcctgcggagatccagaaatggagccaccttgccggtctgaccttttcggtcgcagtcgggactgccaaggagcgccgggcggcacttatgcaaggcgcggatatcacgattatcaaccgtgaaaacctgcagtggctgatcgacgagtctggctttccctttgactacgatatggtgatcatcgacgagctctcgtccttcaaaaaccacaagtcaaagcgcttcaagtccctgatgaaggttagacccagactccatcgcattatcggcctcaccggcacaccatcctccaacggtctcatggatctgtgggcagagttcaaggtgctggatatgggtgagcgcctcggacgcttcatcacgcagtaccggacaaattacttcatgccggacaagcgaaacggcgagatcatctactcctacaagccgctgccttatgcggaggacgccatctaccggagaatcgcggatatcacgatttccatgaagtccaccgaccacctgaagatgccggagctggtatccacggcctatgaggtgcagctttcggaatcggagcgtgaccgctatgaggatttgaagcaggagttcatcctgcagctcccggacggcgagattaccgctgccaatgcagcatcactcaccggaaagctctgtcagctggccaacggtgcgatttatgcagataccggagaaatcatcgagtttcacgaccggaagctggacgctttggaggatatcatcgaagccgccaatgaaaaaccgcttcttgtggcctactggttccggcacgacctatcccgcatcaagaaccgcttcaatgtccgggagatcaagacaagccgcgatatcgctgactggaatgcgggaaagattcctgtagcagtcatccaccccgcttctgccgggcacggcttaaaccttcaggcaggcggttctacccttgtctggttcgggcttacgtggtcgctggaattataccagcagacgaacgcaagactctggaggcagggacaaacctccggaaccgtggtgatccagcacatcatcacgaaaggtaccatcgacgagcgcatcttgaaagcgctgtccaagaaggaaatgacacaggccgctctgatcgatgcggtcaaagctgaggtggtgtaatgaccaccccgtatgaaaacctcgccaatgcaatcgtgcttcaggctgtcaaagattatcgggatgccctgaaacgcctgaagaagaaaccgcagaacaaagctgcaatggctgatgcgatggaatgcgagcgcttcttccgctccccctggtaccgggagctcacgagcgtggacggcgagtacttaatagaaaaattacgagaggaggcgaaacgcctatgactgttaaagaatatcttcatcaggcgtaccggctggatcagaggatcaagtccgatacgctggaagcccagaacctccgggagatggcaggcagcgtgtccggccttcgctacgacgttgaccgtgtgcagacttccaagaataccgacgcaccgttcgtccgtgcgctggaacgcctgtgggaactggagaataaagtagctgacgagctggctctgctctctgacctgaagaaacagatccgggaagtcatcgagacggttccggataccgacgagcgcatggtcttgaagtaccggtacattcataacatgacatgggagcagattggcaacgagctctttgccgaccgcaccactgtctaccgctggcacggctccgccctgcagcatgtccagatgccggagcacccgattgagatctgagcctgcacgttttaccacactttgcaacacaatgcacagtcccatacatgatagtattacaatagcgaaaagcgaaaatccaagaagccttgagggagcgatcctgcagggcttttgttatgcaaggaaggaggcggcggccatgccaaggaaacccaagaggccgtgccgctatcccggatgcccgaacctgactgacggtgtctactgcgaggagcacgccaagatcatggaacagcactacgagaagttccagcgcggctactctcccggcaagaggtacggcagggcttggaaacgaatccgtgatcggtacgtccacaagcatccgctgtgtgagcagtgcctgaaggaaggacgctacgtggcggtcgaggaagtccaccacatcattcctctctccgagggaggaacgaacgacgaaagtaatctcatgagtctatgtcgttcgtgtcatgaaaagatacatcgagatcgaggagaccgctgataaacttcgcggtcttttcttttgcgcgagaaattttgtgaccggtaggggcgggtcaaatctctacgggcgaatgccccggaaaacggcgccccctcttccgtgcaaaaaaagcgaaatcaaacgggtaataagggaggcggtgaaaaatcatgccaacaaaatcaaataacaccggcgggcgcggcggcagacgtcccggtgccggacgtaagaaaagccccgtccgtgagaaatatgaaaacggaaatccgggcggcagggatctcaccgtgctggacatcccggatgtcgaaggcgaggaaatgccgaccccgcacgacttcctatctgccaagcagcacgatggcaccacgctggaagccggtgaaatctacagagaaacatgggaatggctggacaagatcggcgtagccaaggcggtatctcctcagcttctggagcgatacgcgatgtgctctgcaagatggattcagtgtgaagatatgaccactcggctcggatacctgagcaaacatccgacgactgggaagcctatcccttctcccttcatcaatatcggcatcaattacatgaatcaggcaagccgcctgtggaacgagatcttccagatcgtaaaagagaactgcgctacggaatacagcggcctcaatccacaggacgacgtgatggagaggcttctaagagccagaaagggaatgtaaatgaatacacaaagattcgaacaggtacctatagataagctggtgccttatgcccggaatgcccggacacatagtaaagaacagattcttcagctgcgctcgtccctgcgcgagttcggttttgtgagccctgcggtcatcgatgcggattacaacatcctcgtcggccacggcagaattgaagctgcccgcgcagaaggctatgaaaccgtgccctgcgtctttgccgagaacctgacggacgctcagaagcgtgcatacatcctcgcggacaatcagctggcgctgaacgcaggctgggatgaggaaatgctgtcggtcgaattagccgacctgcaggatcagtccttcgaccttagccttctcggatttggaaccgatgagctggaaaagctgctcggcggcggtgaagaaaaggatatcaaagatgatgatttcgacctgaccgcagctctggagaaggcttccttcgtggagcccggcgatatctggacggtaggaaaacatcgtctcatgtgcggtgatgctacttctgccgaagatgtcgagaagctcatggacggcaagaaagcaaaccttgtcctgaccgaccctccctacggcgtttccttcaaagcctccgacggactgacgattcagaacgattccctcaagggtgaggagttctacaacttcctgctctctgctttcaaaaacatggccgaccacctcgagaaaggcggcgctgcctactgcttccatgcagacaccgaaggactcaccttcaggaaggcatttatcgacgcgggcttccaccttgccggtgtgtgtatctgggtaaagaacagcctcgtgctcggtcgctctgattatcagtggcagcatgaaccgatcctctatggatttttacagaacggcaagcacccctggtattccgaccgcaagcagacaaccatctggaattacgataagccaaagcgcaataaggatcatccgaccagcaagccgcttgaccttctgggctatccgattcagaactccacgcaggagaattccgtagtgatcgataccttcggcggctccggctccacgctcatggcctgcgaacagctcaaccgtatctgctgcatgatggagcttgatccgaaatacgcctctgtcatcctccggcgctatgtggaggatactggcgatacggaaaatgtgtatgtagtaagaaacggcgaaaagctctactactccgctctggcaaaagaggtcgagacctctccgacggcgggtgtatagtacacaatttctgccctgtatatttgtcgattatattcctttgaaatatcgagaaaacgcttgctatataaggctttcagagtgatgtatatacatgccaaaaggcacagccaaaaaccacatttgaaaaacggaggtacacacaatgaaagcaaactacaacgtaaccggaaaagaaagaaaagcactggtcgcagccatcgcagagctcaccggcgacaaggcagtctacaagttcatgcccacctgcgccttcgagatcggcgacatcacggtcgacaaggaaggcggcgtcacctgcgaggacgcggacaagctggagcgcctgatccacaacctcatcgcggacggcttcactccggctgaggaaatcgaaagcaccgacgaggaagccaccgcagaggaaccggaagcggacgaaggcaccggcctcacggtcagcctcccgctggagaaggctgcggtcggaaacctcaccaacctcctaaccgccaaggaaagcctcatcaagaaggcactcggcattgacgatctcggcatcgagatcacagaggataaggtcaccttcccttggttttccgaactgccggagccggaagcagtcaaggcttacacccacttcatcgcagccctttgcaagatgagtaaggacttaaagcgggtaagcgccaccgaaaaggaagtcgacaatgaaaaatacgccttccgctgcttcctcctgcggcttggcttcatcggaaacgagtacaaggccgagcgcaagattctccttcagaacctttccggcaactccagctggaagaacggcgcaccggaaaaggaggtggcggcatgcgaatgataaagcagcacgagcttgaggcactccgcctgcgctacccggcaggcacccgcgtggagcttcttcagatggacgatgtgcaggctccacccatcggcaccaagggaacggttacgggtgtcgatgataccggaagccttatggtgaactgggataacggctgcggcttgaacgtgatctacggcatcgaccttgtgcggaaggtggtggaatgagatggatgaaaaagtaagagaacaaatcctcgccatccgggacaccggcctaacaaacatgtttgatataaccgccgtccagcggctggcctacgagagagacttctacgagctggttctttaccttgaggatcaccggtctgaatacgtgaaattcatcatgtccggcgaggcataaactacacaattaggcctcaaatgttcccgcaggattgtcacatatattctccgaattaacttgctattacaggcgttcagagtgatatatgtacataccaaaaggaacacagaacaaggaggaaaccaccatgaagtacacaatcgaagccattgagaacgcaaagcccggaatgaaatgggacgagatcggatgccactggacactcggacaggcctacctttacagcaaggaagccggaaacgacctgccgaacttcgccgaggtcatttgggacgacgacatcgaggcgatcctttccgactgcaggaagctgggagtgaaggaattcacgataagctccaccttctccagcctgatcgagaccatcgcccgcttcgaggagcttggctgcaccttggacggcatcgtcagagtcaaggagcgctacacccacttcggaagcgacgaccgcgccctgatcccggctttcaagatgacggtgaaggaggcgtaaacgacatgacaatcaacgaagcaatgagaaccttaagacttccgaacccgaccacaccggaggatctggaatgccgctggagcaagacgctgcggttcggagacaaaatcctgatggcaggctacttttacaacggaatgaacaagccctgctacttcggagcaatctacgaattccttacagacgacaacagctgcgaaggaaccatcggactccactcggtaagcgaggtcgagttcgaagatgacggccacgccattgcatgggcgatgagccaagcagaataagaaacccctgagaatgaatattccgggagactgagccgcagggctctttctctcgtactgataccaaggatcgctacggcggtcttttattttgcccggaaggaggcggctttcatgccaatgcgaaaactgaaaaactacaagccgacccgattcatggccgagtcctctcactatagcaagcagatggcggattttgctgtgatgttcatcgagcagctctgccataccaaaggcacatgggcaggaaagcccttcgagcttatcgactggcaggaaagaatcatccgcgacctgttcggaacgctgaagccaaacggctaccggcagttcaataccgcctacatcgagataccaaagaagatgggcaagtccgagcttgccgctgcggtcgccctgctcctttgctgcggcgacggtgaggaacgcgccgaggtctacggctgcgctgctgaccgccagcaggccaccatcgtttttgatgtggctgcggatatggtcaggatgtgcccggccttaaaccggcgcgtgaagatactggcctcccagaagcggatcatatacgagccgacaaacagcttctatcaggtgctatccgcagaagcctactcaaaacacggctttaacatccacggcgtggtctttgacgagctgcacacccagcccaaccgtaagctctttgatgttatgaccaagggctccggcgatgccagaatgcagccgctttacttcctgattacgaccgccggaaacgatacgaataccatctgctatgaagtccaccagaaggcacaggacatccttgacggcagaaaagtcgacccgaccttctacccggtcatctacggagcggacgcttccgaggactggacagatccggaggtctggaaaaaggcaaacccgtcgctgggtatcacggtcggcatcgacaaggtggaagccgcctgcgaatccgccaagcagaatcccggcgaggagaactcctttagacagctaaggctcaatcaatgggtaaagcaggccatccgctggatgccaatggacaaatgggatgcctgcgcatttccggtcaatgaggacgacctcgaaggccgcgtctgctatggcggtcttgacctgtcttccaccacagatatcacttccttcgtgctggtcttcccgccaagggatgaggatgacaagtatgtgattctcccgtacttctgggtgccggaggatacgctggagcttcgtgtccggcgcgaccatgtgccttacgacacttgggaaaaggaaggatacctcgaaaccacagagggcaacgtcatccactacggctacatcgagaaattcatcgagcggctgggcgaccgcttcaacatccgcgagatcgccttcgaccgctggggagccgtccagatggtgcagaaccttgagggcatgggctttacggtcgttcccttcggtcagggctttaaggatatgagcccgcccacgaaagagctgatgaagctgacgcttgaaagaaagctcgcccacggaggccatccggtgctccgctggaatatggacaacatcttcatccgcactgatcctgccggaaacatcaaggctgataaggaaaagtccacggagaagatcgacggtgccatcgcaacgatcatggcactcgaccgggcgatccggtgcggcaacgacaacggtgcttctgtctatgacgacagaggcatccttttcatatgaacaaacagtaaacattcctgacatatgtcagaattgtgttgacattgctcgcgcatatgtctataattgacatatgtcagaaatggaggtgttcaattggcaggaagacaagaaaaaactcgaaaagtcgaaaccatgccagaatacattacgttcagtccagacggaataccaaatggtgaggaagtcactctaaccgtagacgagtttgaaaccatccgactcattgatctggaacacctgaatcagtcggaggcttcagagagaatgaatgtagcaagaacaaccgtgacagcaatttatgaaagagcacgagtaaaacttgcggatgcactcataaacggtaaaaaacttcagattgaaggcggtaatgttgagtttcgaccccagcacattcaggctgataagaaaatcaatgaaaaaggagtaaacactatgagaatcgcagtaacctatgacaatggagacgtttttcagcattttggaagaacctcacagtttaaaatctatgatacagaagatggtaaagtcacatcctctcaagttgttggtaccaatggtgcaggtcacggagcgcttgcaggctttttgaaaagtaacaatgtagatactttaatctgcggaggtatcggaggcggtgcccaagcagcaatgggtgaagccggaatcacgctttatggtggcgtgacagggaatactgatgaggctgttcaaaagttgcttgacggaagccttgattatgatcccaatgtggtatgctcgcatcatgaaggacatcatggtggcggagaatgcggacatcacgaacacggaagctgtggagaacacggctgtcacaactaaagattaatctcacatactgatattgaaaagcatctacctatattgggtaggtgctttctttatgccctgaaagaggtgtaagtaatgtttttgatttcactactcggctttctggtgatccgggaagcccttaacggattggagggatggctatgagtatattttcaggactatttcggagcagggataagcccaaggacgcgaccagcggaagctcctaccgcttcttcttcggcggcacgacctccggcaaagctgtaacggaacgctccgccatgcagatgacggcagtctactcctgcgttcggattctttccgaggcgattgctggcctgcccgttcacctgtaccggtacgacggcagcggcggcaaggaaaaagcgaccactcatccgctctacttcctgcttcatgatgagccaaacccggaaatgacatcctttgtctttcgggagacgctgatgacgcacctacttctgtggggaaacgcctacgcgcagatcatccgaaacggcaagggcgaggtcgtggctctgtatccgcttatgccaaaccgcatgacggttgaccgtgacgcagacggccatctctactacgaataccagacctcacaggatgaggcgcacacgatggatggcagccgcgtcaggctcctgccaagcgatgtgctgcacattcccggtcttggctttgacggcctgatgggctacagcccgattgcgatggcaaagaacgctatcggcatggcgattgcctgtgaggaatatggagctaagtttttcgctaacggcgcgacgcccggcggcatcttggagcatcccggtgtggtaaaagatccggagcgtgtcagggaaagctggaactcggccttcggcggcagtgccaatgcaaacaaggtggcggttcttgaggaaggcatgaaatacacgcctatctctatttcaccggagcaggcgcagttcttagagacgcggaagttccagattaatgagatcgctcgtatctttcgtatcccgcctcacatgatcggcgaccttgagaaatcgagcttttcaaacatcgagcagcagtcgctggagttcgtgaaatacacgctcgacccgtgggtctgccgctgggaacagtccatgcagcgggcgcttttgtctatggatgagaagaaggaatacttcttcaagttcaatgtggacggcctgcttcgcggcgactaccagagccgcatgaacggctatgcgaccggacgccagaacggctggatgagcgccaatgatatcagggagcttgaaaatctcgaccgcatcccggaggaggaaggcggcgacctgtatcttataaacggcaacatgaccaagctcaaggacgcaggcatttttgcagcctcgtctcagggacaggaggagccagatgaaacagaagaatcaaaacaagagccggaacagccacagcaaagtgagcgcacccggccacgaaagaaggaggcactatgaccagaaagttttggaactgggtgcgaaacgaggaaccggacagctttggctcagaccgaacgctctacctcgacggggaaatctccgatgagacatggttcggcgacgaggtcacaccacagttattcaaagatgaattaagcagcggagacggaaacatcaccctctggattaacagtccgggcggtgatgtttttgctgctgcacagatttacaacatgctgatggattacccgcatgacgtaacggtcaagattgacgcccttgctgcttcggcggcatccgtcatcgctatggccggtaccaaggtctgcatgagtcctgtggccatgatgatgatccacaaccctgcgaccatcgccatcggtgataccgaggagatgcagaaggccatcgacatgttaaacgaagtcaaggaatccatcatgaacgcctacgaaatcaagtccgggctttcccgccacaagatttcccagctgatggatgccgagacgtggatgaacgccaaggaggccgtgaagctcggcttcgctgacgagattctgttcaaggcgggcgaggaacctgcctctaatgatgaggccgatacggagatgcttttctcccgcaaggccgtcactgactcactgctatcgcggcttatccctaagaaaaagccggaagcaaataaacacatggtaccagtaaccgatcttgagaagcgcctttcgcttctcacacattaaaggaggatttttattatgactcagattatggaactcatggaaaagagagcgaaggcatgggaggctgcaaaggcttttcttaacacccactctcagaacggcggcatggtttctgcggaagatgccgcgacctacgacaagatggaaaaggaagtcactgaccttaccaaggatatcgagcgcctgcagcgtcaggacgagatcgagaagatgctcaatcagcccacttccgctcctatcaccaacatgcccggcaagaccggcgacaaagcagatgaaaagaccggcagggcttccgctgcttacaagaaggctttctgggacaacatccgtcatcccggcaatcctgtcatccgtgacgttctggaggaaggcaccgatggcaacggcggatatcttgttcccgtcgaattcgagcacacgcttgttcaggcactcaacgagaacaacatcatgcgtaccatcggctgcaagatcatcaccacgcagaacgagcgcaagattcctgtggcaaacggtcatacgcaggctgcatggacggctgagaacggtgcttacaccgaaagcaatcctaccttcggccagaccagcatcgacgccttcaagctgaccgaccttatcaaggtttcggatgagctgctttccgacagctttttcgatatcgagggctacatctccgaggaattcggtcgtgccttcggtgaagctgaggaggatgccttcatcaatggcgctattcaggttggcgcaacggcaattgacaggcctaccggtcttatgattgctgcggcttccggaggtgctccgtccggagttactactgctgcaaacaacaagatcgatgccgacgagctgatcagccttgtatattccctgaaagctccttacagaagcaaggcaaagttccttatgaacgacgccacggtcgctgtcatcagaaagctcaaggatggcaacggtgcctatatgtggcagccttccctgaccgctggtgagcctgacaggcttcttggcttcccgctctacacctctccgaaggtgcctactatgacagccggtgcaagagctatcgctttcggcgacttctcctgctactggatcgctgacagagctggcagaagcatcaagcgtctgaatgagctctacgctaccaacggtcaggtcggcttcacctgcacggagcgtgttgacggcaagctcatccttgctgaaggcatcaagattcttgacatgcacgcttgataaggagggactgctatgagctataacgcaaagaactacaccgaacagggtggcgatgtcactcatatcggcgggacactgatcatcgaggagggagcaaccgtagaagggctcccttcttcctttacacctgcagagaatcaggctgacagcgaagccgagacggttgacgctctcaaggaggaattcaacggccttcttgcaaagctcaaaacagccggtctcatggaggctgatgctgaaccagaaacagatgcaacatgattattatggctccggcggctggtgcttccggagccttttatcgaaaggaggcttgacgcatgtcgcttatcacacttgtagaagcaaaaaactatctgcggcttgatacagatgatgacgacactctcgtccagtcgcttctggatgctgcagagcgccttgcgattgatgtctcccgcctatccgatacagagtgggcacttctggatgatacgaccaagaccacagatccggacggtaatttaactggcagcgagatatcagcatttcgagctgtcctgaaggctgcattcttctatacccttggatacctttacgaacaccgtgaggaggcggatcacaaggcgcttaccatgacgcttagaagcattctcttttccatccgcgaagggaggccaagatcatgaatatagcagctatgcgggtgcgcgtcacttttcagaaaaacgcagtgattgttgacaagtacggaaaccacaagagcggctgggcagattacttctcctgctgggcgactgtcggtacaagctccggttcggagtcttccggcgtcgtgataaacccggaggaatcgctggattttacctgccgctactgctccgagcttgctgctgtggaatccacaaagtaccggatcatcgcggcgggcaagacctacaacatcacctatgtcaatccgatgggctacaagcataacagcctgaaattcaactgcaagctggagaaaaacgcatgagcaggaatgtatcaatcaacgaaatgggcgacgccattatggaggagctcgaaaaatatgcaggcctcgcttctgacgatttgaaggccgcagtcaaggaaaccgctgcctctgtccgcaaggatatacaggccggtgctcccgtggataccgggaagtacaagaaaagctggtcggttaagaatgtccacgaggattcggaaagcatcgatctggtggtgcattccagaaaccgctatcagctggcgcaccttttagagcatggccatgtgaagcgtggcggcggtcgcgtaccggcacagccgcatatcgcagcagccgaggaacgcgggaatgaaaagctcgtcgacaccatcaaacagaagctgggaggtggatcatgacatacgacgaagtaatcaccatattagaggaagccggactcccgctcgcctacgaccattttgccgaaggtgaatcaccagagccgccctacctcattttcttatatccgggcacggacaacatgtttgcagacgataccgtgtaccagaagatcaatgagctgaatattgagctttacacggacgccaaagacccggaaaccgaaacccggatcgaggacatcttaatcgcgcacgatctgccttatgaaaaatccgaggtgtggatcgagtcggagaagctgtacgaggtcttatatcaaacacagattataggaggttaatcgactatgcctaacacaagaaacaaggtcaagtttggcctgaagaattgctactacgccatcgctacgctggcggcagacggtaccgtcactttcggcacacccgtggcgatgcccggtgcagtctccctttcgctggatgcggagggcgacaacgacccgttctatgcggatgactccgtatattacatggtctccaacaacaacggctattccggcgacttcgagcttgcgctgattccggagagctttctcacggacgtcatgcatgagactgaggatgccaatggcgtcatggtggaaaacaaggatgtggagccggagcacttcgctctgctctttgagttttccggcgaccagagaaagatccgccactgcatgtattattgcagcgcgacccgtccttccgtcaccggcagcaccaaggaggactccacagaggtgcagaccgagacactgtcccttacggtttctccgctcccttccggcatcgtgaaggtcaagaccggcaccaataccacagacgcagtctacaacggctggtacagtgcggtctatgagccgagtgcagctgtttcaaacggtgagtaaggaggcgcgatatggcagttacaaaaaccatcgaggttgacggcaaggaggtgcagtttcgcgcctctgccgctatccctcgtctttacagaaacaaatttcacagggacatttacaaggacttgaacgagctgcaaaaaggcatcgacaaaagcgatgcggagagctccaatctggacaccttctcccttgagcttttcgagaacatcgcgtggctcatggcaaagcatcagaacccggatgtcccggatactccggaggactggctcgaccagttcaacaccttctcgatctacgaaattctccctcagatcattgagctctggggactgaatgtggaacagcaggtggcctctaaaaaaaacatcacaacacggagcgggaaatgacaaccccgctcttcttactccggtgcgtgcagatcgggcttcacatctcggagcttgatctgctcaccatcggatgtgtcaacgatatgtacgcagaaatgagtaacgacgactatccatacgcccagacagcatcgcaggcggatatggatcgattttaacaggaaggaggtcgtagcatggccgacaggatcaaaggcataaccgtggaaatcggcggcgatacgaccggcctttccaaagccctctccggcgtcaataaggaaatcaagaacacgcagtcgcagcttaaagatgtcaataagctcttaaagctcgacccaacgaataccacgctgctcgaacagaaacagaagctcctgaagcaggctgtctccgaaacgaaggaaaagctcacacagctgaagtccgtgcaagaccaaatggatgctggacttaaaaacggtaccgtcacccagcagcaatacgatgcatggcagcgtgagatcatagagacagaaaacgagctcaagaacctcgaacagcagtgcaaagaaaccgactctcatatctccgcaaccctcacggcgacgggaacgaagctgcaggaagtcggcggaaaaatctccgacgtcggaaccggccttacaactcatgtcacggctcccattgtagccctcggcgcggcttctcttgctgcattcaatgaggtagatgccgggcttgatatcgtagaacagaaaaccggcgcgaccggagaagcgctggaagaaatgaaccagattgtgaaagacctcgccacagaaattccgacagacttcgaaactgccggtgccgctgtcggcgaggtcaacactcgctttggcctgaccgggcaggcgctggacgatctttccgcgaaattcataaagtttgcccagctgaatgatactgacgtttcgacatccatcgacaacgtatcctcggtcatgaacgctttcggcatggacgcatccgaggcggactcccttctggatgcgctgaacgcaaccggtcaggccacaggtatcgggatggattcccttgcgagcctgctgtcctccaatgccgtacagctaaaggaaatgggactgaccgcccagcaggccgcaggatttatgggcatggtggagatgtccggtctggatacttcctccgctatgatgggtcttaagaccgccatgaagaatgcgacgaaggacggcaaaacgctggatcaggctctttccgatttctcccaaaccatgaagggcaacggctccgaaactgaaaagctgcaggcagcctatgacctgttcggaagcaaagccggtgcgtcaatctacaatgccgtgcagactggaaagctgaaccttgacgacctgtccggctcactttctgattttgaaggcagtgtagaaaacaccttcaatgcaactctcgacccgattgaccagttccagatgacgatgaactccctgaaggaaaccggtgccgaggtcggaaattctctgatgacggtgcttgcgcctgtcctgaagcagatctccgataagctgaaatccctcgccgagtggtggaacaatctcggagagccgatgcagcagatgatcataaagatcgctctcgtagccgctgcaatcgggccactccttgtggtgattggaaagattgtatcttcggtcgggacggtcatgacgatcatcccgaaggtgtctacggcgattacgacagtgaaaggcgcgatggccgggcttaatgctacgctggctgcaaacccgataggtcttgtgattgcggcgattgccgcgctggtggctgccttcatctacctttggaaaacaaacgaggacttccgaaataagattacagccatctggaacgggctcgtagagaagtttcaggctttcacgcagggcatcgtcgataagctcaatgagctgggctttaacttcaaggacatcggcgaagtcataaaggccgtatgggatggcctgtgctctgtcctcgctccgatgtttgaaggcgtattccagaacattgcaaacatcctgtcctacgcgatggatctgatcttgaatattttggatgtctttatcggcattttcaccggcgactgggatcaggctctctccggcataaaaggaatttttacatccacttgggacttcatcgtaaatacgctgtcgaatatcctgacgacgctcggaaacgtggtgaatgtattccttggctggttcggaacctcgtggcaggaaatctggcaaggcatcaaggacttcttcgtaaatatctggaacggcatcgtcagcttttttaccggcattgtgaccggaatccagaatacggtgacaacggttttcacagccatctccacgttctttacgaacatctggaatggaataaagaccttcttcgagacgatcctgaatggcatcaagacggcggtcaccacatatttcaatgcgtataaaaccgtcatctcgaccgtcctgacagccattcagaccgtaatcacaacggtatggaatgccataaagacagccataacgactgtagttaatgcaatcaagaccgccatcactacggcatggaacgccataaagacaacgacctccaccgtattcaatgccgtaaaaacgaccgtcagcaacatctggaacagcatcaaatcggcggtcatgaatgtaataaacaccatgaagtccgggatcagtaacggcttcaatgcgataaagagcacggtctccaacatcgtaaacgggatcaagagcacgatctccaatgtattcaataccatctggagcacggtctccggcatcgtcaacaagctgaaaagcgtattcaacttcagctggagcctgccgaagatcaagctgccgcacttctcgatttccggcagcttctccttaaacccgccgtccataccacacttctctgtggactggtataaaaaggcgatgtcaggcggcatgatcctaaaagacgcgaccatcttcggtcagagcggcggtacgctccttggcggaggcgaggccggtgatgaggctgttgtcggtgtatcgtccctgcgctctatgattcaggacgcggtgagcaatgcatcgctttccctttcgggagaccagccgctgatcaacatcgaagaaatgagcgtcagaagcgacgacgatatccgcaagatttctcagcaactcaacaccctgctgacagcaggacgcagagcgaaaggactggtgtgatatgggattttcattcaacggaacaacctcccagtctatgggacttgcgacaagaattacaaacgaatatcggatgccggatcttaggaataacacggttaccatgcccggacggcacggcgtgtttgatttcggagaaacggtatccgagcgaaaaattgtgatttcctgcttcatccctccgggtgaaacggatgagcaatttctcgcaaagaaggatgacatcatcgaatggctgaatccggacaacggcctctgccagctcattctggacaaagaaccgggacgagtttatgaagcaaggctcacgtccggattttcctttgaccgggcagtccgcaattcctgcaccttcgatctggagttcttatgtcctgatccttatggctacgccatatcggacgagacctttgactttgcggaggcaggaacatttactgcctcccgctctcttggaaatatagagtcttatcccatctacgccctgcagggagtgattccttccgggacggactcgtatatcggcataaccacaaacggcagcgagctccgtatcattggacgcctatcctccggcgagacgcttatcattgattcgtctcacatgacggcaaaggtcgtggatggaaacggcgatacgctgcgaaacgggctcccgctgctatcggagcttaatttcccggtgcttgataccggagataataccatcgtgattgaggcggtcggaaccaatacaacatttacggaacttagcattcaggccagaagccgctggaggtgatttcgcatggctcttaaaaatacacttaatacgcaggatgccttcaccggtgagttcccggctgcttgggctccggacggcctctggcgctttaacgaggaaaacccggatgcggatgataacctcgccgattcctccggcaaggatcgcaaagcatatatccataactggagcggcactacggcctcgatgaagaccggcaatttcggtcggtatttccaaatgaacatcaataacccttcatctgagaaaacctacctgaaggtaacgaacgacggcagcatcttttccaatctcggcgagactatcgtggtcggcggctggatgaagcccacaacatattcagtcggaaatacctatactccgattctgaatacccgctacggctccggtcagccgattttttatttatcgctcattcgcgggaagccgagaatcatgctgtataactcctccggcacactcattctggatcagtcggtgacaccatcgttctctctgcagaatggcaactggtattttattgcctgcgtgataaagcccgtggcaaagacagcacagtacatccttggagataaaagttccggcacggtatggcaatcaggtgtgcttacctttaccggcgagctgaaccgctcctgcgtagctgaccttatctggggaatgcatgcggattccaactggtacgcgggcggctttgacgactggttcctcgactgcaattcttcgcttacagctgatgaccttgcggagtactttctggaatcgctttctgccaacggcgcggatttgaccggagatgttgatgccctgaccacggctgatgtcgtgacgctgcgtgcgaccagctctgtctatccggaaagcggccagctggtcactgccgcaagaaagtgcggtgtggtcggtaacggcagagtttccatcaatgcgaactactctccgggcgagaccgccatttcactggtggaaacagcaacctcggacgatctttcgacttggacgcagtggcaggctatcggctcaaacggtgagctggaatcaccctcaaggaaatacatcaaatatcgcgtcacccttgccaccacaaatacggcaaggacgcctgtcctcacagcaatcaatctgcatgataatccgaaaccgctttatacaaagctcggatatgcaaggccagtcatccttgatgcggacggaaatgcggaagcggtgctggataacgcctatgacattatcgtgaccagcgagatcaacggcgtggatgagctggagttcaagctcccgtttcaggacagcaagcgctcctatgtcgataacgaaaagaccgtgcgcattgtcagcgacacctaccgtatccggacgattacggatgacaaggaagaaagcggcaaagccatcaccactgtctatgcggaggcggccttttacgacctcgcatattcggtaaagaaagagccggttacctttaacgcagatacagcagatgtcccgatagcttacgccctgcaggacaccgactgggatatgggagcggtcaatgtctccaccaaacgaacgtggacttgctctgagaagaacgcgctggcgattctccgggcagtacaggacattcacggcggtgacctgatttttgataacgcgaacaagatcgtgaagctgctgactttcagtggcgaggactccggcgtgctgttctgctacaagaaaaatatgaaatccatccagcgcgtcattgatacgacaagccttatcacaaggctgtacgcctacggcaaggatggcatgaccttcgcgtccatcaatgacggcaaggaatatgtgcaggacaccacctacacctccgaaatccgtatctcgacgctggattgctccaacttcaccaatccgtatcagatgctggaattcgcaaacatgcgccttgcggattatgcctctccgcgcatttcctatgtgctgaaagcgatggacttatctgtcctgacaggcttcgagcatgagacgtgggagcttggcgataccgtaacggtaaaggacgatgacctgaacctgtcggtcaagaccagaatcgtccgcagggaatacaacctgcaggagccttggaatacagtgctggagctttccaccaccctccgggagcttggcgattcctcctcccgctgggacagtgccgccgacacactggagtccgccgatctggtggacagtcaggaaatgaaagatctggttcctttcaaccacctgcgcaattccagagcggactccggtctcaactactggcagagctccggcttttctgttgatgcggagaatggcgtatccggcactgcttccttcatgtgtgaaggcgctctgaacaccacaaagagcctctcgcagaccataacgcctgccaaccgggaaagctatacattctcggcgcagatcgcttcggaaaacctcgtcaaaggcagctccgggcaggtcggcattgaagtgacctttgaatatgaggacggaacgacggaaacaagatttatagatctgatctgaaggagggatttctatggcttcatttacacatgtggcgcaggacatctctcctcagtatggccgcgtcattaaaatcaccgtccgtgtatgcgtcaccgactgcaccggcacggtctacatcacggacatgttcctgcagggcggctccatcgctaccggctgggtaggtcatgtatctgaaatacaatggacggaggacggataaatgccggagtttacacgctttacagagacaatcgcaaaaaagcaggataagcgcgtcgtaaacatcacggtaaagcccactgtcacagattgcaccggcacgctctggtttaccgaccttatgctgcaggaaggcgacaaggttacgggatatgtcataaacaccggaacacttctgaaaaagtatgacggagatgatgccatagcgggcaaacggttttataactgcatcgtccgctcctcggcgacctgcattatctttaatctcggctctactgctgccggacttgattacaaagtctatccgattcaggcgatggaggctgggagcatcacgctttcccttggagccggtgcgcacaaggcgacctttaaggctgcggccagcgccggtgatgaatttgaccttctttcttcaagccgggaatgcctgaagaacaatgcagctaccgaaaaggacggattttttcaatattctgctgccggtgacagcaaacacccgatcacggtcgcggataagaagtcggcaaggatttatgtggagtttcaggaaatgcaggatgggagtgatctgatatgagcagagattatttaaaaggccatcggtgtatggtctggacattcatgggaaactcccgcatgtattctgctcttgccgcctatggtgacaggatcagtcaggtcgggctcttttcctttaaggtcagagccaccggagaaatctacgaaacaggtgtggcaatctccaatatgctgacctacatccgtcagtggccgcacatcaaatggcttctgacgatatccaatgacggcacgaacagcatcttcaaggcgctgcgtgataacacggacggcgcacaggataccttcctcacggagattatccgcattatggaaaaatacccgtggtgcgacggcatcgacattgaccttgagaaaggcgacggctattccacccacgcagcctcaacggctatgtttcggaatatctataacactgttaaatcttacgacagctcaaagctcatgaacatctgcctgccgggtatgaactccataaacggctcggtcggcggcgagaactggtgtgtttacggcgacctcgacgcctactgcgatacggctgccattatgagctacggcatggcttgggcgggctctgctcccggtgccgtctcaccgagggactggctggagggcatctatgattatgcggtcactgtcatgacgcctgagaagatcttcttcggtcttccggcttatggctggaactggcagatttacgatacaccggcaaacctcggtaagacctatcgcggcacgtccaacacctactatgcggcaaagaactggatgaccgggcagtataacttcacggacgacgctccgccacagccattcatcccgattctcgcatattgggatgattacgatatggtgccttgggcacttccgcaggtctacgattttatggaaggccgggatgcagcgagctatgactacccactgatgaatggaacctataaccggaggcactacctgacagcctattccaagcagcagcacacggaatttggaaccatctatgtggatgcagacggcaccacaatctcctactccggcattgtctcctttgaaaatggtgtggccacgcttggcgataacggctccgccacctataccttcacggtaccggctgccgggaggtatgatattgcgatccgcctttgctatcccttctgggacaagaacggcatctatgtatcgattgacggcagcaccacccacttttcggagaacaggctctggtggccatattggagaagcaccttctggacgacgcttgccagcaacatatccctgtcagccggaacgcatacgatcaagatttctgtagatataaaaggcgtgcagttttatggctatcgggtatgcagcagcttttcagaggctccgtcggcaggatcggcatctttcactttgtctccgcgccacttcattgatgtggatggaaacgagtgccagcctgacagagctttcaagctcacctgtgaaatgctccggagaaagccggactccgctctcatctggtatgaggattttagggattatggcgtgctgaataccaactactggacgacgctttccggctcgtggacagtttggagagaggatgaatactccgaagtccgcgtctattcacagctggacggctcagggaagctggcatggcaatatgacggcttctccgatatccacctgcgagcgaggctggccttcccatccaatggacatggcaaggccggagtattctgtggcgacctgttctgctgcctgaattatgattctcaggctgtagagctttacaacggctccacgctccttggaagctacagccagactatcgaaaggactgcaagcagcgacctcagaaccgatccgtccatgtatacggtcgaaatgcgcatccgaggcaacaaggtcagagtttactccggctcctcatatacgctccgcttcactgcaacagtcatcggcttttccggaggctatgccggataccggtcagataaccggacaatctgtgagctgctccgcatgggtgacgcttggacatacgagccttacgagcgttttgatgtaaccttcccggacggaaccgttacgcggtacggcaggatcagtcgctcaaatgctacatgggactctgaatttcaggtctttacgctgacctcggatatcgaggaggaagtaacccgcagcgaaaatatctcgctggattatgagttctaccactcccacgagctcgctctttcctgcggaagcgactacacggtgacgatcacgccaaaggacatcaacatctggatatccagattgtttctcggtgacgcggacggcttttccattctctactatcaggatgtggactcgctcatttactgggcaaatgaagcggcctaccgctggagagtgaaaggctttgccatgtggtcgctgggacaggaggatatgcgtctctgggaggcgctgccaaagcaaatataacttcataacagattcagttcacaaggctgtctgcaatcacgcaggcagcttttattttgcacaaaaaggaggaatcgcaacatgaaagaattctggaacaccattcaactcatcttcacggccattggaggctggctcggctggtttcttggaggctgtgacggcctgatgatcgcactcatcatcttcgtcgtgacagactacatcaccggcgtcatgtgcgccatcgctgacaagaagctctcctcggcggtcggtttcaagggcatctgccgtaaagtgctgatcttcatcctgatcggcatcgcaaacgctctcgacatctatgtgctcgaccatgcgggagtgctccgcacagcaatcatctttttctacatctcgaatgagggactgtctctcgtggaaaacagcgtccatctcggcctgcctgtaccggaaaagctgaaggacgtcctcgaacagctccacgaccgcgaaagcaacgataccaaggagggtaaataacatggcaagaacaaaaggaatcgatgtatcccactggcagggaacgattgactggaacaaagtaaaagccgctggcattcagttcgccatcatcaaggctggcggctcggatgctggcacctataccgacagcaagtgggaggcaaactacaagggagccaaggctgccggtatccccattggcgcttattactttgtcggtaaggactgcgtgactgccgctgccggaaaagcggatgccgagcgcttcattcagattctcaagggaaagcagctggaatacccggtctacatggataacgaggcacagcccgcctctgccaaagccggtatcacagaggccaccatcgctttctgcgagacaatggaagctgccggatacttcgtcggtatctacggctccgctgtttccggtttcaaggagcggatggatgatagcaagctcacggactatgcccactgggtagcgcagtatgccagcaagtgctcctacaagggcaactacggcatatggcagtattcttccaagggcaaggtcgatggcatctccgggaacgtggatctggactacggctatatcgattatccctccatcatcaaagccggaggcttcaacggctacacgaaggaaaacaagcctgcgcctgtcgtaagctcccagagagacagcatcctcgctcaggccagagcgtggctcggcaaaaaggaatcggacggaagccacagagagatcatcgatgtctacaacagccacaagcctctcgccagagggtataaggtaaaatacacggacgcatggtgcgcgaccttcgtctcggctgtttccatcaaatgtggcctgacaggtatcatccctaccgagtgcggctgcggtcagatgattgagcttttcaagaagctcggtgcatggaatgaaaacgatgcctatatcccgaagcccggcgatatcattttctatgactggcaagactccggttccggcgacaatacaggctggccggatcatgtcggtatcgtggaagctgtctccagaagcgccatcacggtcattgagggaaacaagagtgatgcggtcagcagacgcacgcttcaggttgacggcaagtatatccgtggctatggtgtgccgaagtacgcggaaggctccggaaacagcactcccacacctgagcccgcgcctaagaaaactgtggacgagcttgccaaggaagtcatcgatgggctctggggaaatggcgctgaacgcaaaaaccgcctgaccgctgccggatatgactacgcaacggttcaggcaaaggtcaatgagctattgaagaagtctgcctctgctgctgtctggtacaccgtgaagtccggcgacacgctttctgctattgctcggaagtatggaacaagcgtggcagcgatccagaagctcaatccgacgcttatcaagaacgtcaacctcatcatcaccggctggaaaatccgcgtgaaatagcgaaacgggagactttgctttattgcattgtctcccgcttttttaattgttgtaatcacatttctggcattgtagcatggtattttcgttatcttccttatggaaaattcctgaccatttacagatgctttgcaaaatcggcacaacggactgccctttctcagaaaggctgtactcaacacgtggaggtatctcgtcatacgattttctttggatcaagtcatttgcaatcagcttttttaatgtcgctgcaagcaccgcatcagtgacatttcccatctccttacgaatttcgctgtagcggagcactttcttttcattcaggacacagataacccgtgaatcccatttccctccaaagatctcaagtccatattccagcgggcaacggatgtccgactccattttctttttatacatctctgcacctccaagttactactgttttatatagtaactcaattattcttgtgtttcaagagttttcaatgaaggtgctttcttatgacagatttcgacacaattcccgcaaccgatacacttaactgtatcaatttcacttttccatcccggaagcatatggattgctcccgcaggacaattttgtatgcaggcaccgcagcctacgcatttctcttgattgatataggcttttttcattgtgtaaaaaacgggagcagctttttgccgcccccgccactcttccttgtttattagagaaccttcttgttttcagcacccggtgtggtgacgatcactttctcaggagtgatgatcagcgctccctttgcagtagctgcgccattgaacatcttctcgaccatagccttaaaggtatcaacaactgcaccctcggtcacatattcagcagttcccttgatctgataaccttccagattcttggcatcatatacggagatcgcaatcttgccgccattcgccttgatattgttcagtgtggtctcaaggaaaacatcgcctacgaccaactttccatcatccgttacatccttaaatgcaaccgggacgacattcggctctccattggcacaggtagccagatcccacataccttccttaagcagttttacaacattttcattcatcatagctgttcgctccttttctttgatttcctgtcagcaacatctctgttgtggctttattatattcaagctgcacggcaaaaagaagatattagcaaatttatgagtcactaataaatttcatagtgcgatgcctgcgagtgttcttcggaatgcccgcaggcttttttcgtttcggtgaaaaatcctccgctcaaaacggctcccaatctccagtggaaactggaggtgaaagcatcatgaccagtgaacagaaagctaaaatcaccgagctccgcactgccggattcggttatgccaatatagcaaacaccctcggtctcaccaagaatcaggtcgtatcgttctgtcacagaaacggtctggccggagaaaaatccacgcaggctacaaaaggcaagccggatgtcggctgctgcaagaactgcggaaagcccatcgtccaagtgcccggcaggaagcagatcaagttctgttctgacgaatgctgccagagctggtggaacgctcatccggaggctgtcacaagaagcgctgatgccgtctactcctttacctgtgcttgttgcggaaagccattcacggcctacgggaatcggagcaggaagtattgctcccacgcctgttacatcaccgggcgctttggaggtgatggccgtgaatgaggatcagttcgaacgcgagaagctctatcaggccagcatgaatatgtttcaagccatgctcaaagacggcattatcaccgaggagcaatacgccataattgatacaaaaatgcgggagaaataccagccgataatcggcacattatatcccgaaaatgcttgataaataaggcttttagagtgatgtatagtaccggaaaggagtgattcaaatggcgaaaatcacgaagatagagccgcagataccggcactgccgacaagaaaaaaggtcgcagcctacgctcgcgtgtcaatggaaactgagcggctccatcattccctctcctctcaggtgagctactactcggagcttattcagaagaacccggagtgggaatatgtcggcgtctacgcagacgaagctatcacaggcaccatcgccaagaagcgtgatgagttcaagcggctgatcgccgactgcgatgctggcaagatcgacattgttctctgtaagagcatttcccgttttgcccgcaacaccgtagacctcttagagaccgtccggcacctaaaggagctgggcatcagcgtccggtttgagaaggagaacatcgacagtctctccggtgacggcgaggttatgctgacgcttctggcctccttcgcacagtcggaatcagaaagcatcagcaacaatgtaaaatggggagtccgcaagcgtatggagcgcggaatcccgaacgggcactttaggatattcggataccgctgggaaggcgaccagctggtcatcgttccggaagaagctgccatcgtaaagcgcatctaccagaacttccttgatgggaagtcccgccttgagacagagcgggaatttgccgccgaaggcatcacgactcgcgaaggctgccgctgggtggattccaatatcaaggtggtgctttccaacatcacctacaccgggaacatgctccttcagaaggaatacatctcagacccgattagcaagaagcgaaaaaagaaccacggcgagctgaaacaatactatgtcgaggacacccacgaacccatcatcgatatggagaccttccagtatgtgcaaagcgagatggccagacgaagggagctcggtgcccttgccaacaagagcctgaacatcacctgcttcaccagcaaaatcaaatgtgagaaatgcggcaaaagctatgtccgcaacactcgaaagaaccgggcaaaggtctcgcagctcggagatcagctggtcggctgggtctgcggttccagcaaaacgaaaaacggtaagtgcaaggcgatggagatcccggaatacattctccggcagaaatgcgccgaggcacttggccttgaggaatttgacgaggatgcctttgcggaacaggtcgaggtgatcacggttccggagcagggcatcctcaattttcacatgacggacggcaccgagaaaaccctcacatgggtgagcacggcaaagaaggacgcatggacaccggaagcccggaagaaggcatcctcctaccgccggaaccatgccatgaagcgctatgacgtgacctgctttaccagcaagatcaagtgtgccgattgcggcaacaactaccgcaggcagaccagaacaaaagcctccggtgaaaagtaccaccttttcgtctgcgctaccacaaacacctgcagcaataactgcatccacgaggacacgctccgagagctcaccgctcaggcgctcggccagcaggcgcttgacgaggcggttttcctgaaggaaatcgaccacatcaccatcgcaccgggcgggcacatcaccttctgcttctacgacgggcatgaggtcagcatggagtacagcaccaagcgcaggatgcctgcgtggacagaagaacgcaaaaagaagcagggcgaggccatcaaggccagcttcaccgaggagcgtcgccggaaaatgagcgaaaccatgaaaaagataaggagtgagaaatattgggcatcaacgaaggcaaaaaggtaaaaacgatcccggccacgctaacgcgcttcactgcttctccaatcacggagcagaaaaagcgccgggtggctggatacgcccgcgtctcaacggatcacgacgatcagttcaccagctatgaggcgcagatcgattattacaccaactacatcaaaagccgggacgactgggagttcgtggatgtctacaccgacgaaggcatcaccggaaccagcaccaagcgccgtgaaggcttcaagaggatggtcgcggatgcgctggccggacggattgacctgatcgtcaccaagagcgtcagccgctttgcccgcaacaccgtggacagcttgacgaccatccgaaagctcaaggaaaaaggcgtcgagtgctattttgaaaaagagaacatctggactttcgacggcaagggcgagctgctcattactatcatgagctcgctggcgcaggaggaaagccgcagcatttccgaaaactgcacatggggacagagaaagcgctttgcagatggcaaagttacaatcccattcaaccggttcctcggctacgacagaggcgcaaacggtgagctggtggtgaatccggagcaggccaaggtcgtccggagcatctacgatatgttcctacagggcacgacctaccacggcatcgcacagaagctcaccgatgacggcatcaagactccgggcggcaaggataagtggagcatttccacggtcaagagcatcttaagcaacgagaagtacaaaggcgatgccctgctgcagaagtgcttcacggtcgattacctgaccaagaagcaaaagaagaatgaaggtgaaattccgcaatactatgtggaaggaaaccacgaggcaatcataccgcctgaaaagttcgacatggttcagcgggaaatggccaagcgcggcaagggcaagaaataccacagcggcgttcatcccttctccagcaaaatccgatgcggccagtgtggaagctggtacggctcaaaagtctggcactcgaccgacaagtaccgacggacgatctggcaatgcaatcacaagtacgatggcggcaagcactgctgcactccgcacctgacggacgagcagattcaggatgccttcctatcggctgcaaaccagctgctggccacaaaggatgcggtcatcgccaacggacgcgagatgatggaactcctctttgacacctcagagcaggaagccgagtgcgataagctgctggaagaagcgcaggttgtttccgatgccgtccagcagaacatctacgaaaacgcccacgtcgctctcgaccagaaagcctaccagaaaaagtacgatgacctgaccgcccggtacgaaacgctcaagacccgcatcgaagatttgaacgagcagatcagccagacgcagtcgcagaaaggcagcgtcgaggatttccttgccgcctttgagaaactgccagaaaccctgaccgcattctcccttgataatttcaacgccctgacggattaccttacggtcaacagcgagggcgacatcagcgtgaccttccgcaacggccagaccatcaaggcataagaaaagctcctcaccactggatttctccggtgacggggagcctttcttgctctcatctcttatttgcagatctaacttctgctgttgttctttcaaaaaccttgtcaataagctcgattagtatttctttgattccatgtacaatttcgataatcacctcgtcgcttacacccggtttaatctccattgtctcattcttagctacatcaagttcagttctgttttcatccatagtataattctcctttgttttagtgtcttcgataaaggttgtggccacttcccttgaagcacctttatcttagcacgggagaaaatcagttctctatggacggttttcgggataaggatttgtagttgagcgacaaagcatcgtacatcttacgaacggcttgaattttcgcaggagaccagctcttattctcatgataagtcctaaacacatcataagtctcgaatacggatgcccagtcattaatatccgtattctctgcaaaccatacacgcatcggttttccattcaaatagatatgagactgaacagcatttgccagcacattcgcttcaatgatccttgagaacgacaactcgccaatgctccctgccggaaggcttactatttgtttcaagaatcgctggcgctgcaatatcatgggatactctacaaaccgatcattgtcgtgcgcataagcaggacaaatgtccgggaggcaagatgtgcatttatagctaccagccgtagccataagcctgttctccatatcaggaatctgcgtcacaccagctgcctccatttctgtggccagcgcatagaaaaactcaaatgaatactttgtttcaagagtaaacagtaccaaagaactgaagattgttgcttcttgctctatattaaattttcctctctgctttcctatgacttcgtcatactgattcgccatgtctataaatcgatcaaccgatattttcttggatgaaccaatacgtctttcaataattgcttttacaagacccatgtcatgtatgttctgaatttcccagtattgaaattcagagagttcatagccggggaatcgattagtctgcttctgcggtttggtatctggttttagaatatctacgcctatcgtctcttttagacgttttccctcaagttcataatgatcattcacatagtctatgatgcgcttgttattctttcgagcaagttcaagctccaatccgtctctttcaatgtagtatttcaaggaatgcttctccgcattgatcaggtatgcgtatctacagcactctaccagaatttgaaaaattacgtcttcaacgacaagctcgttagaaaacaatgtatccagatactcctcttcgtagtatttgaagatgctattccctatttcatttgccgcagcggtcatttttgaattcaaatcgcaacaccagctttctttcttcttaagacaaagggcgaccatcatggccgccctctgctgcattctccaattagctacgctctgcgatccagtccacgacatcgtcaatggtgagctcaaaccggcttcctgcaacgacgtaattcccgtacagatcatagatgctgtacccgccgagattatcagcgtgtatattatgaacgcgactcttatgcagtccatagcccagcttggaaagtgcgtaacgagcttgtctctcagacatggttcctacctcctttcagagaaagttccatgccataccacgccacgccaaaccacgacaaaagtattgcgctcggtggagctcgtgtttcacattatatcacgggcggtaaaccctttctattcgcattataactatatcttgttttctttcgcctgaaacttcgccagagtctcaagcatatgctttccgatggcctccggatcataatcgaatccagcacagataatccgtaacccatctggcgtcaacatctgtccgtggtctctggcgtggcacagacgcttgtattcttcgtactgtttattcgtaagctgatgcattgttacaaatctccctgtatttcttctatattttcctttttgacctcatacataagacataacgcttccaaagaatctctaatacaaataaatctttctccgaggttttcgacatcaattaccacattatccttttcttcaacatagaaatgcgctgctccatctgcggtgaatggatatctggcaaaatcgatattaaccctgtcacgcccgttgtcgtctttttgttttattttcacatacagctcatcgataaattctgtaacaggttttagatgcttttcaagtccagcagttttcttctcgaccttctttatctttgctaccatttgctgttttaattcggcgatatcgtgactcttgtagtttgaaatcccgtctccgctttgttcatcaataagtcgaatgatagttttcaggaacagctcaattgactgatctatcgaatacagaattggcattattaaggaatcagcctttttgtcactgttatctttcaacactgcatttattaacacaaccgctccgtcggcgtaatcagatgcaagaacatgtaaattatgtgccggatcatttgcttgcgtacgccaattcaaataagcgttttttctgatatctaaattgtatgaaaagagttttcccatagcgcatttcctccatatacaaaacaagccgggactgtgcccgaccgaaacccctgacctaaaacgaaacccctaagtcaaaaccgaaacccctacggtcaggcaaccttaaattgtattaaatacggcgtcttaatttccaaaagtattcctgacttcggttctatcacatttactatcattttaaccaatgatttaggcgtaaagaatactccatcatctgaagctacattcttcgcaaacttattcaggaaatactcgtagattcttccgattatgtctccgcccacatcgtctaatgctctgttattaaaaattctaagcagctccgacagaagatcatctgaaaaatctgtatagctctttggcagaactcctttcagctgttcgctctgattctcaatcagctccatagaattattgactacttcaccaaggctcttcatttcttcgccactgcgatttttcaaatgagccgatgcaatatctgacgggagatttaccagataatcgtattgtgcttctcttggcagataaagtgcgctctttgccgcaaagtcacttgcttctaccggcatcactctcccgcctcgtgtcggacggtcttttaaaatctccttctctgctgctttatatctgccataggcgtaccgaagaaaaataagtcccaaaaccggcatacaatactgatttgaagtcagcttagatccctggcgcagaagatccgctgattcccagagttctgattccagctttcttatatccacagcattagccataacattttctcctcaagtacttttgattctatttttgcctgtttacaaaaatattatagcatatttggaagatagataattggatgaaattttattttttctttattgaaataatcagaaaattattttactatgaaaatgcgtgttaccacgcagagcacctatgacgagagcggatgcctcacttctttacggaagggaggtggtgcgaatgaatagttatgagattatcataattattttgacagtaatgaaccttttgttattgtcaggagtattttttctttaacatccggtatttctacaagataatcaaggtacatttgatgtcctttctttagtagtaatcacgactaaatatattatatcaaaaaacctgcatcattgcatgcaaaaatgccgtttttttcagtattttcaatggtttagaggctttaaatccagcttggttttcatttagttgcactcaagagtggaagttcacatgcaaacaggaatttgccgttatctacgacgatgatggtatttccggcaccaacacaaaaaagctgacaatgtggcttacgcagctatattcttgctcttctatctatgccactattctgataatacaattgtttatcttcatacattcgtttttctgcttcagcaatcaaggatgatatatttttatctgatgtgtttccaacagaacatcctatagcaatgtgataagattctttttcaacctgttttcttatctgcccaattttcgcccttatcctatcttccgattcatcggtaagcaaagcgacaaactcatcaccgcctatgcgatatggtaagctggtcgaaatctcactaacaaaggagaacaaaaagaaattaaaagcataacaagcagagacaaaatcgtgatcgcggaaaagagcaacaaactgtttctgttctcctcctgcatatctttttgaatcatatcatattccttatccgaaatatgatatttcatgaatttcccttttatccaatccataagtttattcatcgtaaatatccttctttgctttcttgtcttgaacgtcatatattctgaatgcaggtgttgttccgaagtgctggaatacctcttcactgtcttcatcatattttattttttcttaattgaaatggtcgtaaaattattgtacaaggcataaaaaataaagcctctctcgtctgtccaaggcgagggaggcggctctctttgagagctattttctaaaacaacttgggcatccaatcttggatcaggtgctctatttgttaatactctatcacgattctgtaaagatgtcaaattccgctatcaggcttacagtcattaattgcattccctcaagctgtgattttccgtaccagataccaataattgctaaatggtacggaaaatcccccggcatttctgccggggaatcctgaaattctattatcgtctgtcgacttttgcgatatcaatcggagtgactttgtccggttcactctcaagcgcatgggctaaggcatttgcagtatcaatggctgtgatgcagtagacgcctgtctctatcgcattacgcctgattataaatccgtcacgcgtcttgtctccatgaccttcagtcggagtatcgattacgaggtcgatcttgtgtcctaagatcaggtccatgactgtaggagattcctggtcgagcttattgactctgaatgcttctacgccgtgatcattcaagtatttggctgtagatctcgtagcatagatcttgtagccgagtttcttgaacctcttcgctacattgactgcctcaggcttatccttgtcgtttactgtcattatcatctgcttgtacttcggcagatcgacaccggcaccggcaaaagccttgtagagagcttcgtcaaatgaaggagcgattcccaggcactctcctgtactcttcatttcaggtccgagcgaaatctctgctccgcgaagtttttcaaaggagaagaccggcatcttaatagccacatagtcggcttctggggcgagtcccggcttatatcccatttcacgaagagtgtgtccgcacataacctttgcagccagatctacgattggaattcctgtgaccttgctgatgtatggcactgtacgtgatgaacggggatttacctcgataacgtagacatctccgtccatgtcaatgaactggatatttataaggccgatgacatggagctccttggcgagctttatcgtcgcatcctcgatctttttcttgacctcgtcgccgatagttggtgcagggtaaacggaaatcgaatcgcccgaatggattccggtacgctcgatgtgctccattattccagggatcagtatatcctgaccatcgcagacggcatcgacttcgacctctgtaccctgaagatatttatctacgaggatagggtgttcctgggtgatacggttaatgattcccatgaactgctctatctcctgatcattgaatgcgagctgcataccctggccgccgagaacgtatgacgggcggacaagtacaggatagccgactctgttggcgactttcttagcttcatctgctgtaaatacagttccgcctgatgccctcgggattccggtcttctggagaacttcatcgaagagctcacgatcctcagccctgtcgacatccttggcatctgttccatagattggaacgcccatctccatcagatcctgagtaagtttgattgctgtctgtccgccgaactgaacaacagctccatccggcctctcctgacgaacgacgttttcgacatcctcttttgtcagaggctcgaagtagagcttgtctgcaatatcaaagtcagtcgaaactgtctcagggttattatttataataatggtctcatagccctctttttcaaaggcccatgtagcatgtacagagcagtagtcaaactcgataccctgtccgatacggataggaccgcttccaagtaccagaatcttctttcttccggaagtctcgacagcctcgttctcgccgccgctgtaaaccgaatagtaataaggtgtctcagccttgaactctgctgcgcatgtatctaccatcctgtaggaagcaacgatgccgttttcagtgcgcatcttctttacatcgtcttctgaaagccctccgtttaaattggcgatgatgtagtcagggaactcaatcctcttcgcctcgcggagaagctcaggtgtcagaggctcgctcttaagtctcttttctatctcggtaatataggcgatgcggtcgataaaccagaggtcgatctttgtgatcttgtgcatctttttctgagaaaacttacggcggcagccctctgcgatacggtaaatcctcctgtcgtctacgatctccagctctttccaaagctcatcgtcagtcctgtctgagaaatcgtagctcatcagcgagtcgacatgctgctccagggatctgatggccttcataagagctccacagaagttgtcgcagatgctcattacctcgcctgtagccttcatctgggtagtaagcgtacgttttgcagtgataaacttatcaaatggaagacgagggatctttactacgcagtaatcgagcataggctcaaacgacgcgtaagtcttctttgtgatagcattttttatctcatcgaggttatagccaagggcgatctttgcagcaacttttgcaataggatagcctgtagccttcgaagcgagtgctgaagaacgcgatacacggggattaacctcgattacgcagtactcgaatgaatcagggtttaaagcatactgtacgttgcagccgcctgtgattccgatctctgtgatgatccttaatgcagatgaacggagcatctggtaatctttgtcggaaagtgtctgcgaaggcgctacgacgatggagtcaccggtgtgaacacctaccgggtcgatattttccatgttgcagactgtgatacagttgcctgctgcatcacgcataacctcgtactctatctctttccagcctgcgatacttctctcaacgagcacttcgtgaactctcgaaagtctgagtccgttctcgaggatttctcggagttcttcctcatcgtgggcgataccaccaccggagcctccaagcgtatatgcagggcgaagaactacagggtatccgatagtatttgtaaacctgacaccggcctcaacatcgtgaacgaccatcgaaggagcgacaggctctccaatcttttccatcgtgtccttgaattcctgcctgtcctcggctttttttatcgtggcagaagttgtgccgataaggcgcactccgttttcttttaaaaatcctgactcctcgagttccataccaaggtttagtcctgcctgacctccgagtgtagggagaagtgaatcaggtttttcttttttgatgatagcctcgagagactttatcgtaagaggctcgatgtagacctcatctgcgatatccttatcagtcatgatagtggctgggtttgaatttacgaggcagacttccacgccctcttcctttaaggatctgcaggcctgggttccggcatagtcaaactcggcagcctgacctatgacgataggacctgacccgataaccattaccttttttatgcttaagtcgcgtggcattacagctctccttccatcatcttgataaatctgtcaaaaagaaactcactgtcctgcggaccagggcaggcctccgggtggaactgcaccgtatagatattcttgccggtgtacataagtccctcgttcgttccgtcgtttacattcgtaaatgaaggcgttgcgatcttcgggtcgagcccctctgtatccacgacgtagccgtggttctgggatgaaatgtaaacccgtccggtcagggcatcctttacagggtggtttccgcctctgtggccatattttaattttttcgtatcgataccgtttgcaagtgccatcagctgatgtccaaggcagattgcaaaaataggtatatcagtatcgtacagcttctttatctcttttatgatgctcttacaggtcttcggatctccaggaccgtttgaaagcatgataccatccgggttcatgccgatgatctcgtcagccgtcgtatctgctggaactatcgtcacatcgcagcctctcttattcaagtcgagggcgatatctctctttgcgccgaggtctaagagcactactttctttcctttgcctggaaggtgcttcggctctttgcatgtgactttgcttaccacatcgccaacttcgtatgcctttattttctcgagaacaggggctttatcatcatactttacagtggagatcattccgttcatggttccgctgtcacgaagacgctttgtgagcgccctcgtgtcgattccctgaattcccgggatatcctgctcctttaaaaagtcgtcaaggcttcctttgcagcggaaattgctcggaacccttgcgagctcacgcacaatgtaaccgcctacataagatctgtcagcctctgcatcgtctgtgacaccgtaatttcctatcagaggataagtcatagtcacagcctgtcccgcatatgacgggtcggtaaggacttcgagataaccggtcatagaggtgttgaaaacgacctcgcttatggattctctcgttgagcctatactttcacctgtaaatacagtcccatcctcgagataaagatatgctttcatcttattcctttccatttcatgtcaagtgcgtcaattacttgaaataacttacgccgctctcaaatatcttcatatccagatttccgtagatattcttggaaactccgtctccgatacgctcgcagtggcacatctttccaaggattcgtccatccgcgctcgtgattccctctacgcttctgtatgaaccgttgatgttccactcgctgtccatcgagcagtttccatcgatatccacatactgggtagcaacctggccatttgcaaacagcttgtcgagccactcgtcgtttgctacaaatctgccttcaccgtgtgaagccgggatgccgtaaaccttgccaacacctgccagacgaagccatgggctcttgtctgaaacaaccttggtataggctatctttgaaatatggcgtccgatcgtattgtaggtaagtgtcggagaatcttccttctgctctgtgatctttccataaggaacgaggccaagctttataagtgcctggaaaccattgcagataccaaggacaagtccgtctctcttatttatcaaatcctcgacagcttctgtgatcttctcatttctaaatgctgtagcaaagaacttcgcacttccctccggctcatcacctgctgagaagcctccagggaacataacgatctgtgcgttgtttatgccttttacaaagtcatctactgaagatctgatatcctcggcgttctggtttctgaatacgactgtgtttgtcgaagcaccggccttttcaaaagccctggctgaatcgtactcacagttcgttccagggaatacaggaatgaatacgtttggctgagtaactttgtgtttgcagatatatacgttcttttcgtgatattcaggcgatgcgaccggagtcttgtcatcgtctgctctcgaagcaaatactccctcgagaggattcttccaggcttcgagtgcctcgtcgactgtgatctcctgtccggcaattgtaaatttgccgtcatcagtaacctctccgatcacatcgtagaagtctgagatcgagttgtttgtcatagcctgatctatagcatcaatcgaatcaggatcgacctctgccaggatacagcaagggtatcccctgaatgtgtcaagcggtgatgacatatcaagctttacaccgagcttatttccaaaggccatcttcgcagctgcgggagcaactccatagaagtccgtcacataggcagaaacaattgccttctttaagataagcttgtgaatcgtatcgtagagagtcataacctgatcgtaaaccggcaggtcaaaggtatctcttgcaatccagaagaacaccagcttgtctccggctttcttgagctcaggcgtgataatatcgtttacattcgctgtatctactgcaaatgagcaaagcgttggcggaacatcgatatcgttaaatgttcccgacatcgaatctttgccgccgatcgaaggcagaccatatctcatctgggcttcaaaagcaccgagaagagctgagataggctggctccatctcttcggatctgcagtcatcctgcggaagtactcctggaaggtaaagcggatctttctgaagtcaccgcctgctgccacgatctttgccatagactgtgtgatagaataaatggctccgtgatatgggctccacttcgaaagatacggatcaaagccatatgccatcatagaaactgtatcgcacttgtggtttccaaccggaagctttgcgaccatgctctgtgtctcggtcagctgatatttgccaccataaggcataaagactgatgaagctccgatcgagctgtcgaacatctcgacaagccccttctgcgagcagacattcaagtcgcggagactgtcgagccatgcgcccttataatcctttctgtcaagatcttccttcacctttgagacagcgaatttgtcgaaatagttgtcctctttctcagggatctcaacttcaacttctgtctcctgatgggcaccgtttgtatttaaaaatgctctcgagagatctactatggtctttcctctccagtcaagtcttaaccggggctcctctgtaacctccgctactactgtggcctcgaggttttcttctctggcatagcctaagaatttgtctacatcctgaggagatacgacaacagccattctctcctgagactctgaaatggcaagctctgtgccatcgagtcctgcatatttcttaggaacaaggtctaagtttacgcgaagaccgtcggcaagctcaccaatggcaaccgagacaccgcctgctccaaaatcgttgcacttctttataaggtaagcgacttcctctctcttgaaaagtctctgtaattttctctctgtaggagggttgcccttctggacctcagctccgcagacagatgtagactcggtattgtgagcctttgaagaacctgtagctccaccgattccgtcacggcctgtgcgtccgccgagaaggatgatcttgtcgcccggatctgaatcgagtctccttactgcacgccttggagcagctgccataacagcgccgatctccattctcttagcaacatagtcaggatgatatatttcctttacatatcctgtggcaagtcctatctggtttccatatgagctgtagccgtgagcggcctcacggacaagcttcttctgaggaagctttccttcaagagtctcgcttactggtctcgtaggatcagcagctcctgtgattctcatagcctgatatacataggttctgcctgaaagcgggtctcttatagcaccgccgaggcaggtagcagctccaccgaacggctcgatctctgtcgggtggttgtgagtctcatttttaaaattgagaagccactcctctgtctttccatcgacctctatcggaatgataatagagcaggcgttgatctcgtccgactcctcctgatctttcagaagtccctgcttctttaatatcttcgctccgatagtagcgaggtccataaggcagacgaacttgtcgctcctgtctctgtagatcacgcggaaattgtcgagatatttatcgtaggaatcctgaataggcttcctgtaaaatccgtcgtcaaaatatacagatgtaagctctgtagaaaatgtagtgtggcggcagtgatctgaccagtatgtatcgaggactctgatctctgtgatagtcggatccctgtgctcatctgatctgaaataatttctgatatggaggaaatccttgtaagtcatcgcgaggttaagggattcatagagcttcttgaagtcctcgtcactctcggtacagaaaccatcgaggatttcaacatcctcaggctcttcatagtgatcctcgagtgtctttggctttgtctctcctgtaaccctcgaatcgaccggatttacgcagtgtttctttatcttctcgaaatcatcgtcagaaatgtctccctcgatgacataggtagtagcagtttttatgataggctctgcactgtcgtccaaaagcttcatacactgctcagcagaatccgccctctggtcgaactgtccaggaaggaattctacagaaaaaatccgcccggtaaaatcgaaactttcctcataaacatcgtcaacaggaggctccgaaaatactgtgcggaccgcttttttaaatacttcatcactcaggttctcaacgtcataacgaataaggaccctgacacccgtgataccgttgataccgacgaaatgccttaattcgtgggacagctgctttgctgcaacggcaaagtcaggcttcttttctacatatacgcgtcttacttttcccatgctttttcctttccaagaaaatggaaacaacagtcatcagatgcggttttcaccccgcatccgtatgattatagcataagtcagtcattatttaaacaaaattttaatttttttggaacaaatcagatcatcttgcgaaggatcacatgaagatcctcaccacatttttccactcctttaatcgaaaaatgccaggcgtcttttaaatgctctactccctttccgcctacgatagtcttcgcgtcgcctccgagtatcatcggagcgataaagagatcgacctgatctacaagtcctgcccgaagcatcgaagcgttcagtattcctccgccttcgagcagaattccgtcgatttccatctcgccaagttttttcactaaaaatgtgaggtcgatctcgctgtccctctcagggcattttactattttaatattttgctctttaaactcagctgctttctcttcagaaacgcgctctgagcaggctatgatagtttcaacctcacaagcgctcataaccagcctgctgcaaagaggggtagataaacgtgtgtcacagacaatccttatcgggtttcttccacccccggcgagacggcaggtaagcatcgggtcgtcggctttaaccgttccgattcctaccatgatccccctgtagaggtttctcatcttcatgacttcatttctgctctcttcgcctgagatgtacttcgactcgcctgtaactgtcgcgatctttccgtcgagagactcggcgcacttcattacgatatacggagtctttgcagtaatatagtgaaaaaataccgggttaagctcatcgcactcgtcccttaaaaaatcccgtgtcacaagaacaccgtgttcttttaaaaatttttctcccttaccatgcaccagagggttcggatcgcgtgatccgtagataaccttcgaaataccctcctccagaatcgcttccgtgcacggcggctggtgtccgtggtggcagcacggctcaagagtcacatagatagtcgcgccttttatatcatttccttttctatgggcatcctttatcgcatttctctcggcgtgcagatctccgaatttgaggtgtgcaccttcgcccaggatcttaccatcttttacaatgacggccccgaccaggggattgggatttacacctccctcacccctgtgcgcgagctctatcgcgcggcgcatgtaatcttcatcagtcatttaaaaaactcctttaaagctgccgattacctgtagtcatgataattacatctgctttataagatttaccatctcaacagcagatgttgcgcagtcgtaacccttgtttcccgccttgcttcctgctctctccactgcctgctcgatattgtctgtcgtgataactccgaaaagtactggaaccccagtctccaaagaggtctgggcaatgccctttgaaacctcattgcagaccatctcgtagtgagatgtttttcctctgataacagctcctacacagatcacagcgtcgtattttttggagagtgcaagcctcttcgcaatcacaggaatttcaaaagcgcccggaacccaggctgtcgtgatattttcctccctgacaccgtggcggataagaccatccagggctccatcgagaagcttgtggacaatgatctcattgaatctcgatgccacgatggcaaccttcatgttttcgtcggctactaattttccctcaagtgtcttaacttcgtacatattaatctcctttacaataaaattactaaatttatcagattactttcttaaaaatatgtcccatcttgtcgcgcttcgtcttaaggtacctctcgtcgtatttctgcggagcgatctcgatcggtacacgaccggtaatctcgagtccgaagcctgtgaggccgtagatcttctgcggattattggtaagaaggcgcatgctgtggattccaaggtcctcgaggatctgtgcgcctacccaatattctctcaagtcaggtgcgaagccaagctttacatttgcttctacggtgtcataaccctgctcctgcagagcgtaagccttgatcttgtttaagagcccgatccctctgccttcctgcctcatatatagaagcactccgcggccttccttttcgatcatcatcattgcgctgtgcagctggtcgccgcagtcacagcgaagcgaaccgaagcagtcgcctgtcagacactccgagtgtactctgcagagaacgtcttcgccgtcgcctatatctccctttacaagtgctacatggtgttctccggtgatgtcattctgatagccatgcatgataaaatctccgtattttgttggaagcttggcggaagcgacacggataacgtgcttgtcatggatcctgcagaagtctttaagctgtgaaatagtgatgtaggtcaggccatgactttttgcaaactcgtgcagctcctcccttctcatcatccggccgtcatcagccataatctcgcagcagataccgcatggtttaagtcccgcgtgtctcatcagatcgaccgtcgcttcagtatgaccgtcgcgctctaagactccgttcttttttgcaatcagcggaaaaacgtggcccggatgcctgaagtctgctggtctgctgttttcatctgaaagtgccttcatggtcacagccctctcggctgccgagattcctgtggtcgtatttttgtgatcgcaggagaccgtaaaagccgtctcatggttgtctgtattgtttacgaccataggatcaagtcccagacgaagtgcattttctgcggacattggtgtacagataaggcctttggcgtaacttgccatgaaatttatcgactcagtcgtcgcgaactgagcggcctgtatcagatcgccctcattttccctgtcctcatcatcactaaccatgatgatttttccgtgctgaaggtctttaacagcctcctctactgtgttaaactcaaattctttttccataagagcctcctgtcagataagattttcaagcatttccatagttaaaccgtgggattcatttttttgtgaaataaaatgctccacgtatttgccgatcatgtcattttcaatatttacagtgtctcccgctttaagctgccccagattcgtgacctgaagcgtatgcggtatcacttcaatagaaaaggtattttcacctgtctcagcaacagtaagtgaaattccgttgactgtgactgaacccttttttatgataaatttcatcagagagtcatcacataaaaaagtgtagagataggagtcgccgtcgtgctctattctgctgactgtgcaggtcccgtctacatgtcctgcgactatgtgacctccgagccttgagccgactgaaagcgcacgctcgagatttacgaggtctccaggattaagcgagcctaaaactgtatatctgagcgtctcctctgaaacatcagcagtaaaaaagtcatttccaagtgtcgttgcggtaagacagactccatcgacacagatcgagtcgccttccttagtgccttctaagaccttctcggcctttactgtgagaattcttcctccgccagtgtccctcagctgcctgatcgtgccggtctcttctgcaattcctgtaaacatcaaatcacctcactcacaattcgcacccacatcgctccagcggttcgcgcctccaaatcaaatgagcggtgccaattcgcacccgcttcgctccagcggttcaccgtttccgctctgtcttcgcccttcgggctcgcggcagcataacaaccgctccatgctcattcgcgcgttcgcgctattgatacataaaaagacgcccttccagacacgagtgtctttcagggcgtctttttatatatcagcaccgctcatttaatacgcgtaaaaaaaatcctggggtctatgacctcaggacactgtaaacaaacacatcaacatgaaactctatctttcatccagactatactgtcggccctggaatctcaccagatcatgccaaatggctcgcgggctttaccgccggtagggaatcgcaccctgccctgaagagttattcaattgtaaataatttattaacttaactgtaaaaattgtaccacttgttctaaacttatgcaatagcaaatttagaaacactttttttgaaatcgtctgatcccttcggacagataacttcggcattcttgttcagagcgcacgatataatgcccagcagagacttggcatccagataagcagcgccggttttaagatctatatcgtaatcgaagccggatgctatatgtacgaattcctctgcctccttaggattgcgtaagcgaatcataaacttcatagcaaaacacctcttcatcatactttttaacttttgtttacagcgatttgggaaaccaaaaagtctaaaggagtttccccaaatcttttcaagtataatatcacgttttgagatgttgtcaatgttgcaaccggttattcgttgtatttttatcaatacagcatattatataaacacttaataaaaataaaaaaatatatttaagtttgctttaaatctttgcaagatcagagtatctgctcgagacaggtgaactgtggtttcaaccccatcctggcatagaaggcggctgcattgtcatttccctcccagacatgcagggtgatattgtagaagccattctcttttgcgtattttttcacatgctcatacagcgcagcgccgatatgctttccgcggatcgtctcatctacgcagagatcatcgatatagagcgtctttacatcagttcttattgaatcgcctgttatctgctcgaaccaggtcatgcagtatcccaggagcttgtcgctttcatcgactgcggcaaaaatagggtgagtcttatccgcaagctttccggcgagctcctcgtcggagtatttatttcctacattaaaaaggtccggcctgatatcgtggtgtacaagatttacctgggataagagcctgttaatatccggaatatctttcttttctgccattcttacagtaatcatttttgctcctttccaaaagccttatacggctcaagcttcattcctttaaaggaatgagcgctgttataaacagccagtgcctcgtcgagaagcgggaagagcatcaccgctcctgttccctctcctaggcttaagttggcgtagattacaggatcaagcccaagggcatctgacacagctttcgttaccggctctcgtccagcgattgaggcgatgataaagttttttgtgcctggaactaacttttctgccagaagcgcagctgaaagacttacggctccatccgctaccaccgggattctattttctgcaccggagataaacgctcctgccattgcaccgatttcagttccgccgatcctagcgagaagcttgagaggatcttcaccatatcttatattttgagaaataacttttcgcttaaataacaggccgtcgtcgctaagccctgctccccttccagtaacgtcttcagcggagagattcagaagcgatgccgtaattacagctgcgcaggtcgtatcgccaattcccatctcgccgaccgctgcaatatcagctcccgactccttcagggcctcttccccggctttaatgcacgatctcgcctgatctgcctccattgcaggggattcaaggaaattttttgtcccacggactatatttttttggatgatattacccgaatgtgtctcatcctttatgccgacatcgatacagctgacttctgcccctgcgacagccgccatcctgtttacagagctcttgttctcagcaatctcgtccgccaccatcgctgtgactgcagagccgctctgggatacagctgtctctgaaatcccattgtctccgcagaagatcaggatatttttcttagtgagatctatgtcggcgcttcctgtaatgccggcgatctggacaataatgtcttccatcgtgcccagaccatgaagaggatgcgcaacgctgtcccattttttcttagattcgtccatcgcgtccctgtcgagaaacggcatcagtcagcctcctctcaaaaattcataattaaagcgataacaagtcccagcagaaatccaaagaaaacctggagcggtgtgtgaccgacaaactcttttaatttttcctcaggggagagggttttactgtagactacctcaacaagatgatttaagacctcggactgctttcctgtctcgcggcggactcccatcgcatcgtgcattacaattatcgccatgatgcaggcgactgcaaaaaccggcgaatcaaatccatcctggattccgcaggaaactgcgatagccgtgaccgtagccgaatgtccgctcggcataccgccgtctcctacaagcctgctccagttaatcccgtgatttgtgatcgcaaagataatggtctttatgacctgagccgtaagccagccgacaactccagataaaaggatagtgtttgaaaataattcgtataaaaattcagtaaaacccgacattcttctgattcccctcttttagtcgatatacctgtcagttctggattcgtgctttacaagcctgaaaacaatgatatacaggacaaccactacagcaacaaatactgcggtcgaagtgctgctctgtatcgtcgcacaggtgtcgtaggttccgtgaagaaaaaccgcgagaatgtaaccgaaagcgagctcgaaggccattttgccattacgtccctcattggctgcaagccttgctctgccgtagaaacagccgaaaataactgaaaatccgaggtgaccgggaatcgacagaaatgctctcggaattgcgacggagagcccgtatctgaatacatactctacattttcaaatgcggcaaatccaagtgatgtaaatgcagaatagacgattccgtcgaatctgcagttgaattcagggttacgccaggtgagctttcccataagaaaatacttcgtaccctcttcaacagctcctactacaacgaaattcaagatcataacgccaagcagcgtatcctgtcttacaggactgagcttcagaaggctctcccctgccatttcaaggatcatcgaaacgagggctgcaagaacgcccctgcctacacaccttaaaagtaatgccggagattcgctctctatcgtatcctgcctgtatatatagctcataaggtaaatggccggtgccagggcagcaataaaatatacccagagtatcgtatcaaatgctgtcattataaacatatagcttcctccaaatcatttatatgaaaaattataaccgagtatatgatatttgtcatcagtttatatgtaatatctttgaaaaacacctgtatctcaggcatccggctttatcctgtcccaaaaatcccggatgatctcatttatattgtcgatatccgcatcgactatgttctcccattcccttgggaaaagtgagcgtatatcggggcgtgagaacctgtcatccaaaagaacgataactcctttatcattttctgtgcggatcagcctcccggctgactgcaggaccttgtttacagctgtgtataaatatgcataattaaacccttcaccgtactttttatcaaagtatccacttaaaatttcctgctcaaagcttacctgcggcagaggcagacctgctattataactccgataaggcactccccgacgaggtcgactccctcaccaaaaatcccgccggcaatgcagaaagctgccaggctcttttctctcttctgcctgaactcagccaggaatttgtccctgtcgtcctccttcatctcaggagtctggcagataacgtcgaattcctccgagagcaggtatccgctgatcttatccatgatcgcataggatgggacgaagaccatgtagttgccggttttttcgcttataactttttttatataacaagcgtacttttcaaacatcgcatccgaacgctgtttgtagacacttgtgacgccgcttcctgtgactataagcctgtttgcagtgtcaaacgagctctcggcgtagattgaatacggcttctgttcggtcgttataaggctcctgtagtagtgaagcggcagaagcgttgccgaaaaaaatatcgcagatctcgccattgaaagcttcttttggagacgcctcgacggatcaatgcagaaaagtgtgatctctgtgaattttttcctgcacgagacctttatcacatagtcgtcgtcaagctcctcatatacatccaggaaaaatgacaggtcaaagtaaagctgccttaaatcctcgattccctgataattctgctcgtcattgtcaagaaaatcgtcaagaccagccttaagccttagcagttttggcattagaaggttcagctcttctactgtaaaatcgccgtctcttccctcaaatgagtccctgaaagccctctgaacagatgaaattttagattttagttttgaaaacactttaggaatcggctttttggccttcgaaatctccgcagtactaagggacgccgagaacatttttcttccccgctccggcagattgtgagcttcatctataagaaatacatagttttcgccattatccgccgcaaaaaatctcttcagataagctgtagggtcaaacacatagttaaaatcccctataatattgtcgcaccagtcgcagagatcgtattcgaggagataagggcagacgacagcgctcctgccctcgtcttttatcttctcccttgaaaaaatgtccgcattatttaagagatcaaatagtgcatcatttatcctgtcgaaatgaccttttgcgtacggacacttcgatggatcacattctactgtctcattgatgcacatcttctcctttgaagtaagcgagacagtttttccacgatagccattttgtgcaagaagtgagaatgcatcctgtgcatttctcgcggtcattgtctttgcagtcagatagaatattcgcccgcatagcccctctcccatcgacattactgccggatagacagtcgagagcgtctttccggtgccggtcggagccatcataaaaagaaggcctttttttacaatgcacctgtaaactgctgccatcagatcaaactgtcccttcctgtaaggataagggaacttgagtccgtgtattgagtttattttttcttttgaaaaatagaaagtgaagtctgaccagcgtcgatatgactcgactaatcctgtaaaaaatttcgtaagttcttctctggtatagctttctgtgaattttttgatgtcctcggtctcaagattgcagtaagtgaccgtaatatcggtctcttcgaggccatttgaacatagaaagataaagccgtagcatttcgcctgcgcaaggtgcagcagatcaggcttctctttataccttaatttctgatatgtgcctttgatctcgtcgatctcaggttttttggattttttgatattgggaaaaaagcccttgccgaaagtataatcaggaagattttcgttctccgactttttatttttctttgccttctcctggtagataatgccgtcagcccttccggaaacaacaaggtcatagtctcccatatcgacactgacagagagtggaacctcggcatgataattgacaccgcccattttctggatctttttatgcacgcgggcaccggcctgcatggattccaggttatcccgcacagccataccctctgtgatatcgccgctcctcaggagaaattcgacaagcctgcggaccgatatttttatctgtggtctatcttcactcatggctcaattcgtagtaacatcgatgtctgatttaacatgactcttaacctctacaaagaccttattaggcaggcaggtgatcgactcaccgtccttcgacttgtgacccatctttacgcagatctgatcgggacagtcggcgtacttcataaatacttcgccattttttatctgaactgtattagtcacagtgcctctgctgtttttaatcggtatgagcctgtctctgttcagaggaaatgagccgactcttttcccgtcacaggtaataacggccacatctccggaatttctcgaactgtaaaaacagactgaaaaaatggcaagaacggccagtacaatacaaattataataatgctttttttactgatataagggtttgtcttcatttaaattttacaagtctgctgtgtactgcggcacttaaggacccggtgataattcctgtaataatgcctgctatgataaggaccggcaggtaaaaaactatattgtaatttgtcacaagaaaagcagccgcgataagctgccctgcgttgtgagataccgccccgataacggataatggtatcatttttacttttttagtcttaaagcagataagcattactgcaaagctcagcagtccgcctgcgagcgagtagataatactcaagccgtttccaaagagaagtccagatagaaatatcctgacaatcgataccagaaaagcctcacccggtgtaaaaaggtacagaaggataactactgccatattcgcgagcccaagcttcatgccgggaacgccaaagtttatcgggataagcgtctcaacatagccaagcatcaaagcaagagccagaaaaactcccagtgatgcgatccgtgatgattttttcatgccccttttagattccatatcaactccaatgctctacgaagccctcgcccattgcctctgaaacatttcctactataaaaaatgccttcttatcgcgttccttaacaatatccttgatctgcggaacatccctgttcgagcagacacaggctaaaatctttctgccctttccagagtattctccggttccatcgatgcttgtcacacctctgtcaagctcgacaaggatatctttggaaatcgcatcacattccttcgatataataagagcaatctttgcctttttaccacgatcaacaaccttatcgattatttttcccatcacatatactgaaataaaagcgtagagagtgttttcaatattaaaggcaaaaagaccgagaagaacaattgaaccatccagaatctggatcaataccccgaccggaatatgcctgaagatatgcgacagagagttccccagcatatcggtaccgcctgtagtggcgcgcgccaggaggataattccagttccaaagccaaacagaacgcccccgaacaggcttgtaaggaaaatattgtcagagatcggcgtaaattcaggaaaaacagctagttcaaccgtcattattgcaaaaccaatcgtcgttctgattatactctttattccatccaccttcaaagcgaacaggaaaatcgggatattaaacacgaggttcgaaacccagagcgggatgggatgatgaaaatacctgcctgtcaggctttttacaacgatagcaaggccgctgactccgccagtatcgagcccggcagggtccagaatatatttaaccgcaatagaaaccagggtagttcccagaagaattatgaaaaaatccctgacatgcttcttaaaatatttcggcttgaaaaaatcgctctgaaaaatgtctttcatctgacatgctccttaaaaataaaaaaataaaagcctgcagccaaagccacaagccttacatcataacagaggcagaaggacttgaaccctcgacatttggttttggagaccaacgttctaccaactgaactatacctctataaacaaaacacccaataattctacattattgggatcatcttgtcaataaaattttaaagcaccttcaaaacttcatacattaatagccaagttacaagtttgcttttaaggaagttcttttcgctaagctcgagcttcgtctatgactcgctctcgctaatctcaaagaacgatcttgctgtgggctcggacttcggcttcgccttgtcctcacctcacatctttcgatcaagccttcgatctattagtgacagtcagctgagagccttgcagctcttacacccctgccctatctaccttgtactcttcaagggatcttatgtcttttaaagacgggatatctcatcttgggcttcacgcttagatgccttcagcgtttatcccttccagacacagctactcagctatgggactggttcccaactgatacactggaggtccgtccaccccggtctctcgtactaggcagctccctcaaatatcctccgcccgcgccggatagggaccgaactgtctcacgacgttctaacccagctcgcgtaccgctttaatgggcgaacagcccaacccttggaacctgctacagctccaggatgcgatgagccgacatcgaggtgccaaaccactcgtcgttgtgaactcttgggagtgataagcctgttatccccagggtagcttttatcgcttgagcgatggcaatcccactttataccaccggatcactaagtcctgctttcgcatctgctccccccgtcggtgtcgcagcagcctgccttctgcctttgcactcttcaatggtttccgaccattctgaggcaagctttgagcgcctccgataccctttcggaggcgaccgccccagtcaaactccccgcctggcattgtcccaccgccggttcacggcggctggttagaaatccaatgatgcaggggtggtatcccaacagcggctcttcgaatgccggagcactcgtctctcagcctcccacctatcctgtgccatcaccgaatcccagtaccaaactggagtaaagctccatggggtctttccgtcctggcgcgggtaaccagcatcttcactggtacttcaatttcaccggatgcattgtcgagccagtgctcaaatcattaccctttcgtgggcggtcgaacttacccgacaaggaatttcgctaccttaggaccgttatagttacggccgccgtttactgggcttgaattcaaagctcgctgcgctgacttctcctcttaaccttccgcaccgggcaggcgtcagcccatatacttcacctttcggtttcgcaagacctgtgtttttgctaaacagttgcttgagcctattctctgcggcctccatctctgaaggccaccttatcccgaagttacggggtcattttgccgaattccttaacaatgcttccccgtcggccttaggattctctcctcatctacctgtgtcggtttgcggtacgggcccatacagaacgatagcggcttttctcggcagctggctcacgcgcttcgctattttatgttcctccgcatcacagctttggcttgcatgggagatttgctgcccatgcgcctcctctgcttgcaccggtctttccattcccgctcgcgctttccctctgcgtcccacattcttctgtacatgcagctgtctgctgtacatcatctaactgctttccatcgactacgcctcgcggcctcgccttagtcccgacttacccagggcagatcagctttaccctggacctcagatattcggccggaaggattcacaccttcctctcgctactcattccggcattctctcttcaggcatctcactgctccttatcggtacagcttcgctgactcctgaagctcctctaccaattattataattcacggcttcggtgtcgtgtttcagccccggacattttcggcgcaggacctctcgaccagtgagctgttacgcactctttgaatgaatggctgcttctgagccaacatcctggttgtctttgaaatcccacatcctttaccacttaacacgcactttgggaccttagccggtggtctggcttttctccctttccccctatcatatctgtatagtctgactcccggtgatcatctacatggcatcggagtttgctattcttggtaagctttgacgctcccgcggaaattcagtgctctacctccataagactgcaccgaggctagccctaaagctatttcgaggagaaccagcatctccgggttcgattggaatttctcccctacccacacctcatcgccatctttttcaacaggtgtgcgttcggacctccatcgccttttacggcggcttcatcctggacatgggtaggtcacccggtttcgggtctgcactaactgacttgatgccctgttaagacttggtttcccttcggctccggcacttcatgccttaacctcgccagtccgcgcaactcgccggaccgttctacaaaaagtacgcggtcggccttgcggccttccactgtttgtaaacacagggtttcaggttctctttcactcccctcccggggtccttttcacctttccttcacagtactatgcgctatcggtcaccagtagtatttagccttacggagtggtctccgcatgttcagacagggtttctcgtgtcccgtcctctctggataccgccatgccgtctctcctttcgcttacggggctctcaccctctacgcctgctcttccaaaacagtctgctaagatcaacggatcatttatgcggtcctaacccacagtgcacgcaccgtggtttgggctcttccggtttcgctcgccgctactcccggaatcgaatgtttctttcctcccgctacttagagtttcagttcaccgggttcccttcataacgctatttcgttatgacgctgcatcgctcgcagcaggtttccccattcagacatctgcgggtcatggcttatgtgcagctcaccgcagcttttcgcagcttatcacgtcttcatcggctcttgtgccaaggcatccaccctgcgctctttttcgcttgatcatctctttctgtcgatgcatacgttgcatctctttgatctttgctttaaaagcatttgtgttctctcagatctctctgaaagacctctttgttttactcggatgtcttagcatttctagtagaaatactaaacattgcattagatattatctaataatgtatgaagttttcaaggtactttccgactggtcatccagtcatcagggtctcagggtatccccgaaagctctgatcactgtcacagcttctgctgtcagcgacctttatgtccatcagatgcatccatctgccttttgtcagaaattctggcgcccacctgctctcccatgcgttaccagcatagtaccatcggccgtctgcgtcttaaccatcgtgttcgggatgttataacgggtgtttcccgcaaacgcatcggcaccagaagtgttgaatatcattcggagctcctgcccctcttgataacgggacagtgaaacaatcccctcgttttcccttaaaaggaggtgatccagccgcaggttctcctacggctaccttgttacgacttcaccccagttatcagccctgcctcggcagctccctcctgcggttgggccactgacttcgggcattcccgactcccatggtggtgacgggcggtgtgtacaagacccgggaacttattccccgcagcattctgatctgcgattactagcgattccagcttcgtgtggtcgggttgcagaccaaagtccgaactggcgttatttttgggatttgccaggctttacagcttcgcttccctctgtttacgccattgtacactggtgtagcccaggtcataaggggcatgatgatttgacgtcatccccaccttcctccaggttcaccctggcagtctctcatgagtgcccatccgaattgctggctacataagataagggttgcgctcgttgcgggacttaaccccatctcacacacgactgacgacaaccatgcaccacctgtctcttctgtcccgaaggaaatgttccattacagatcactgtcagaaggatgtcaagacctggtaaggttccgcgttgcttcaattaaaccacatgctccaccgcttgtggcggtccccgtcaattcctttgagtttcatcttgcgaacgtactccccaggtggaatacttactgcgtttgctgcggcaccgaatcccaatggacccaacacctggtattcatcgtttacggcgtggacaccaggtatcatcctgtttgctccccacgctttcgagcatcagcgtcagttatcgtccagcatgccgccttcgccactggtgttcttcctgatatctacgcatttcaccgctacaccaggaattccacatgcccctccgacactctagtcctgcagtttccaaagcaatcccaggttaagcccagggttttcacttcagacttgtaagaccgcctacgctccctttacacccagtaaatccggataacgcttcctcatacgtattaccgcggctgctggcacgatttagccggagcttcttagtcaggtaccgtcattatcttccctgctgatagagctttacataccgaaatcttcatcactcacgcggcgtcgctgcatcagagtttcctcctttgtgcaatattccccactgctgcctcccgtaggagtctgggccgtgtctcagtcccaatgtggccggtcaccctctcaggtcggctactgatcgtcggtttggtgggccttaccccgccaactgcctaatcagacgcggatccatcatacaccgccggagctttggctcaggaccatgcggtccagcagttttatgcggtattagcagctttttccagctgttatccccagtaatggcaggttatccacgcgttactaccgccactcgctttatggccgtcaccccgaagggatcgtggccataaagctcgttcgacttgcatgtgttaagcacgccgccagcgttcatcctgagccaggatcgaactctcatgttaaaatgtttaatcagcaccgataagctctgtgctgactgctcgcagtcaagcacacaagcttatcagtgcgccaccacagttccagaaaaaatttgatataaggtttttctggaacctgtggttttttgtgagtgcgaagcactcacaaaaattaaactaagaaattcgaactgtcaagataaaagcttagcttttcttctttactgttcttaaaaggtttcgagtttactcgaatgatttaaattctcttagaaatctttcaaggttgtttcactgttcagttatcaaggttcttcgtcttgctctctcgcgcgacgacttaacaatcatatcacaatcatcggcgcttgtcaagaacttttttcaatttcttgaaaaactttttttgcatcgctcttgcaattccttgtcttttgcggtgcaggtattatattatcaccctgcccccgattcgtcaagcaaattttgtaaatttttcaaagttgtataactgtatctttttttaatgattttcagttaattcacacaactttaccggaatattacactcttgtctgaactgttttcttctgtttatcaaaagaggcagatcagactaccttgtctgccgcctctttgatttcctttaccccaataagctcaactccatccggaatctcgtcgagtcctttcaggtttgcatatggaagtattatcgtcttgatgcccatctttaaggcttcgtttatcctctgtcgtgccatgcttactgccctgacctctcccgagagtcctacctctccaaatgcgaccagagattcagacagtggacggttcttaaagcttgagattatcgccagtacgagccccaggtcgatagccggctcatttatcctcatacctccggcgatgtttatataggcgtcctggtctcccatcataaggcccattcgcttctcgaccacagccatcaggagatttaccctgttgtaatctatgcctactgctgtccgtctcggtattccaaaattcgaatgagtagtgagagcctgaatctccagtagaatcggacggcttccctctatagcacatgagataacagagcccgagcttccaaaagctctcccgtcgagcaaaaactctgacggatttttgacttcttttagtccatcggacctcatctcaaatacaccgatctcatcagtacttccgaacctgttctttactgcccgaaggaccctgtaggaagcgtgtctgtcgccttcaaaatagagcacagtatctaccatatgctcgagtatcctaggccctgctacggtaccctctttcgtaacgtgtccgactataaaaatagtgatgtcctcttttttcgcaagctgcataagggttccagtcgcgtatctgacctgtgaaatacttcccgcaattccagatgcctcttctgaatacatcgtctgaatagaatcgatgacaactatcgatggctttgtggtctttatgacttgttcgatcagaccaaggtctgtctccgagaggacttttaagctgtcagagaaattccccatcctctgggctctgagctgaatctgccttaaagattcctctcctgacacatagagcacatcgatcttatcctttgaaatatttctcatgacctgaagcaggagagtcgattttccgatacccggatctccgccgataagcacaagtgaccctttcactatgcctccgccgagaactctgtcaagctctgacatgtgggttgtggttcttttttcctctgaaacagaaatttccgagagcgccacagggcgcacctcggaaatttcacgaacagagacttttttattcttttctgtcctgacctcggtcattgtgttccactcgtggcaggccggacactgcccgacccacttcggggactcatagccgcagttactgcagaaaaatacactcgtctccttttttggcatatcaatcctttctgatagaaacagacttcggctttccgtcagaaagatcaaggcttaaagtgatctttccgccgagattagtcttcataacgccatagtcctcccccgcggctgaaacctgatactctgtctctggtgaaagccctactgtaatgtcagtgtttcctgcaccctctacctgaaagctcatagaagaatcatcgtacttcatgtgtgaaactcgggtacctggctctgattcgtaaacaaacaggtcgttactctcgagcttcgtagtagtcttgtaagtcttcacgtataagaggtcacccttatacttgaaatcctttacctttgtcttctcgtccagtgtgtaatcgccaaacgaaagtgtgccgtctttctcactgatgatcagatctttctgtgccatttttttctccttttacctttttggatgaactatctgacttactaaatactagtttatcattttttaccgaaatagtcactacatctcctgaatttatttttcctgagatgatctcatcggctacaggatcctcaatatctgtctggatcttcctgcgaagcggtctcgcgccaaacttcgggtcgtatgccttatcgacgatccatgtcttgctcattccagttgctttaaggcttattcctgtattttgcatgaggcggtctgagacctcttttatcataagcgtaacgatctttgacatatccctcttagtcaaagacctgaaatagacgatttcgtcgatcctgtttagaaattccggtctgaaagtgtgctttaaagcatcgtcgaccttagacttcatcatcttaaactggtccttctcgctgtcgccggatccaaatccaagactctcgtgtcctgttatatcaacagcaccggcatttgatgtcatgatgattattgtatttttaaagtctataagccttccctgcgaatcagtgagccttccttcgtcaagaacctgaaggagaatattgaaaacatcagggtgagccttctctatctcgtcaaaaaggatgacactgtatgggtacttgcggaccttctctgccagctgtccgccttcctcgtaacctacatagcccggaggcgatccgataaacttcgagaccgcatccttttccatatattctgacatatcgactctgataaatgccttctggtctccaaaaaccaccttcgccagagtctgtgcaacgagagtttttccgacaccagtaggacctacaaaaaggaagcttcccatcggcctgtcaggggacttaagtccagctctgcttctgcggatagcctttgaaacagccttaacagcatcgtcctgcccaataacagacttgtgcagagtgtcctcaagctttaaaagcctcttcgactctcttatgccaaggcttccgacaggtattcctgtccagtcagaaacgaccgatgcgatatcagattccgaaagagaactccgtctgccgtaagccttcttagaggccctcttctctgctttagcaagctcctcttcatcatctgttaattgcaggcgtatctgatgggcctcagaaaaatcgccacctttcagtgcttcctcgagcttctttgagaggtcgtttttcttctgcctcaattcgtaagtctttgtggttcccggagtattaaaaagcctcttcctcgcgcaggattcatcaagcaggtctatagctttatccggcagaaatctgtcgtggatatatctttttgacaaataaacgcaggcttttacagcttcgtctgaaatttttacctggtgatgcttctcatatgcgccacgtaaaccctcgaggatctggacagtctgctcctcatcaggttcttcaaccataacagataaaaatctgcggtcaagtgccgcatccttctcgattttcttcctgtactccttaatggtagtagctccgataatctggagctctcctctcgcgagggcgggctttaagatatttgcagcgtccatagaaccttccgagccaccggcaccgattatcatatggagctcatctatgaaaagaagcacatttccagccgaaacagcctcgtctattactcctttaatcctctcctcaaattcgcctctgtactttgtaccggcaaccatcgcagaaagatcaactgtaagtatcctctttccaagcagattctgcggtacattctgtgatactatctgctctgcaagtccctcgactatagcagtctttcctacaccaggctctccgatgaggcacgggttgttctttgtcctgcggcttaaaatctcaattatcctgtggatttccttctccctgccgataacgggatcgagttctccgtcctcggccaaagtagtcagatcagtcgtaaactggtctaaagacgggtattcctcctccgcagtattaccatgattctggtagagaacctgtctgtacgcatctccctcttcacccatggatttaaggagattgttgaagacagcattaatatcagtattaagtgtagataaaatcctggctgccgaagaatccggcatacgaagaacagccagaacggcatgctccgttccggcctggtccatattgcacatagcagcaatggaattgatgttttctaaaagctgcttaaatctcggtgaatcagtgtcaggactaatgtttgctttcttatctttaaaaagctgaatctccttcataacagagacaactttgtcttctgtcactccagcgtcttttaaaacctcactggcaagattcgggcccgtatgtaaaagtcccagaagaaggtgctgagtgccagtgtactcaccgttgtccttcgagaccttgtgtgcgtaatctatagctttctttaagctttcagtgtattccatttaatatcttcctaaagatcagggttagttcagatcctcgacatgcagttttttcttattctttgaaaccttcggcatttttaacttatcttctgccattagtctgtcaataagcgcatcaggatcatcgatcttatccggtaatttgtccatgatatcatctgaatctcccagtttgatatcataatccttttccgccttatcatctgcattgtaatcgtaatcaaatccggcatttttctggagattcctgtcaatatcattaatcatctcatcatctgcgatgttatcaccggtattaccgctctttgatactcctccagcagacaggccatcgttgtgacgggatggcttgctgacatctccgcttcctttcgaatcattatcagtgtcgtaatcatagacatcgtataaaacatgaatacgaataagccttatagcgagtattaagataatgacaacaaggactgccagaacaaccagcattcttctgtcaaggagaagttccttaaaagacaaatctgaagacgtaaaagactcattatctgaaagattcttagtcgagccggcatcagaagattttacagtctttgaagcatcagaagacgcctttttggtcgaagtggtttttttatcagttgtctttgaagtagctgtggatgccacagtcgcagcagtctttttcgtatctgtagttttcttggtatcagcagtcgcttctgaaatatttacttttgctgaacttctgccataggtacttgaattcgcaataagataagaaaatccggtctctttcgcagtaaatgtaaatgaagcgctctgagcatacaggcttacagtgttgccgctatatgttgcatttccacgtgacttcaatgtcactttgcttggatcaaatgaaagtgacagcctcgaagctgcagtgcccgaaaccgtaacggtaaactcgtctccaaccttaacttcagtattggatacagaaatgacaggacgagccgccttggcatttaccggcagaagtataaaaatcactgctgccacggccataaaagatgccattaattttctaatagatttcttcataaagacctccgtctgttttttattttagtatagaagactgttttattattgtcaaatttaaaaatgaaagcgccttttaagctcagttctcgcgttcgctcctccaagtatcagtcccactaagaacagaagtaccgatgaaataaaagcaatttcagagactgtaggatgagtcacaaagtcaaacttcatcaatacaaccggaattattccgaaagcaattgaaagcagcggaagccaggtgtagctctcccatctgcgatgatttacgaacatcataacgacgatcagcatattaaagaggatcagtgcgccaggcaggcagtaattcagagaccacttattaaagcctgttacgacgtctattattacgacaaaaaccagggcaagaaaaatcgttattgcgatttttgccggtataggcatatccgggtttaagaacatgtaaaactctatatagatatagaccagactgcttaccacaataacagaccatggaaatcctctgtttataaaatttatcgcacaggaaagaaagctgcctgccactacaatagtaagcagaagcatcaggaaaaatgttctcctctggcgcttcgcgacgacatccggatagccattttgctttacagcaggataagaagaatcctctgacagggctccattgcagagcgggcagaaatcagcatcactgtcgaggacagtaatatgacaatgcgcacattttttactcataaaaaactccattcgtctcgactgaggatacggcgccaagttctgagagtttccttaaaaattccatgattagcgtcgtgtcgctgtagactgtcgaaaaagaaagtgtcattacatttctaaaagaggcgatgcccagctttaagccctgcccctttgaaaatgacaggaaagtctgagcactctcgatatagtcggcatagacatccgggacattcacctgccccatattcgtaacagtcgtggtatttgccagagcgctcctgccgtagactgcccgaagtccaatgtttttaaagataagaggcactgtgcgggcaagcatcatctgctgtcctgagacattaaacgagaagatcgactcgagattttccttcgtgatctgctttctcaagctctcctttgcaatatcaacgatttcctcaaatgtgtagtcatctttttcaggaataaattctgccgagatcattacgaaaaaattcttcgtagttatcgaatcaaagtacgggcggagatttaccggaactgccactcttatcggcctcttaggggtcatctgcggcctgtatgccttgtaggtgctgtacataaaaagagcaaccatcagctcatttatagatacaccgaaggaatgtgctatttttttaacctcaggaacagagagataggcgtttactactccaaagccgtggtaagggaggtgttcgccttttataagaaatgcccgctttacggcatagacattcgacagcttctcaggcttcttgtagtttcttacaaagctgtcatcgcggtttacagatgtcccctccgaaaatgaatccccgactttttcctgaagcttttcgtgcgcgaatctcaaatacgcgaacgtcagctcctttaaaaattcaaatccaccggttccatctgcaaggacatgaaatacctcaaggttaatccttctgtcatagtaagtgactctgaaaaggtagctgttgttctcgtttgtcttcgtcgagcggcagggataagtgtcctcctctactaccttggggataggtttgtcgttttcctcgaggtagtaccagaagaagcccttcctgagcctctgcttgaaacccggaaacctcttgagcacaaactcaagtgcctcctgcagtatatctccgattactttttcttttaaaattacagcaagcctgtatgtgttagtcatgctgttagtcgctatggccgggaaaagaagagccgaattatcgagtttttcccagtgcgtcatacgatgtggcatattgtctccaactaaaaataagaccgttccgcagggaacggtccaaaaatttactaaataatgaacatactcccaaatcaattatatcggttgggaatctgccagtcaataggctctattccattttccttcaaaaattcattgcactttgaaaaatgtctgcacccgaaaaatcccctgtaggctgaaagcgggctcgggtgtggagcctcaagtacaaggtgctttggattcttcacatatgctgacttcgatctcgcattagaaccccagagcatatagacaagcggcctgtcttccgcctccacagccctaaagacagcatctgtaaactgctcccatcctatcgtcttgtggctgttcgcctgatgcgctctgacagtcaggacattgttcagaagaagaactccctgcttagcccagggtaccagatttccattgtcaggaatgaagcagccaaggtcatcgtgaagctccttgtaaatattttgaagagatggcgggatctcgacatcaggcttcaccgaaaaagcgagcccctgtgcctgacctgcctcgtgataaggatcctgtccgatgatcacgaccttgacctcgtgaagaggtgtaagatgcatcgctgtaaaaatctcttcggccggcggatatatggtctgtgtggcatattctctccgcacagtatcgtataattttctgtaatatggctttccaaactcaggttttaatgcctgtgcccagtcaccatcaagagctgccattatattctcacctgaattccgttgtcccgaagataatgcttcaagtccataatatcgagctcgtgatagtggaaaagagaggctgcgagagctgctgaagcgtctccatcctcaaatgcctctttaaaatcctcctttgagcccgcaccgccagaggcgatgactggaatcgggacttcatcggctatttttctggtgagagggatatcgtatcccttctttgtgccgtcacaatccatgctcgtaaggagaatttcaccggcacctagctcataggctttcctggcccattttacggcgtctaagccagtgtcttcgcggccaccgtacttgtaagcgtgccaggtcccatcgtccattctcttcgcatcaatcgctactactacgcactgattgccaaatttctcggcagcatcgctgataagcctgggattctcaatagcagatgaattgatagatatcttgtcggccccggctcggagtatctcgcggaaatcgtccacagtccttatgccaccgccaactgtaaatgggatgaagacctgggaagcgaccttctcgaccatgtcaacgactgtgtctctgtggtcactcgaagcagtgatatccagaaaaaccagttcgtccgcgccagccttatcgtaagctttggcgcattcgaccggatctccggcatctgtcagatgtacaaaattaatacccttgactaccctgccgtcttttacatcgagacaggggatgattctctttgtaaacatgattaaatctccaggaaattatttaagatctgaagtccggtttctccgctcttctccggatggaactgcgtggcaaatacgttacccttctctacagaagcatcgaagttaagaccatattcacaggtagctgtaacgatcgacggatcatcggccttaagataatacgagtgaacaaaatatacgaagcttccctcttctatccctttaaagagccttcctgccttcggaaaacggatgctgttccatcccatatgaggaaccttcaagtccttccgttcagggaattttatgatatggcccggtaaaagtccaagaccttccacaccttcagattcctcgctgtcattaaaaataagctgtaagcctacacaaataccgagaaacggcgtatcgttctcctgcactttccggatcacatcgacgagacctctgtcccttagatgcgccatgcagtctccaaaatttccgactcccgggaggatgacatggtctgctgaaaggatttcagacccgtctgaagtaactttacagtctctcccgaggaattttacagccttttctacacttctaatatttcccgcgtcgtaatcaattattgctatcatctgccggtgtaagacctttctgtttaagaatagcttttatctgattcgtgtaatcttctctgtcgtctattgcagcaagcttcttagcctctgaatctgagatttcaaactgttctttaagcgctgagcttatcctcttgccatagtcttcgtaatatgactttatatcgaggcttgaagccttagacttattttcctcgtatgcagccttgcctctgataagagcatcgagagcatagtcatactcttttctcttcatggcaccttcgtagattgaatacttgacagacagctctccagcaagcttcgaactctcgagcatcttcttctcgtcgtctgagagcttatcaggatcccttccagcgagctttgcgtagactacaggatactgctgctgtgtgtactcagccttgagagatttcttctgctgtgactgaggcaggatatttatagctgcaaaaataagtgcaaatagagaaattgcaagtacaaagaagaccacaatgacatttttcggaaccagcggtgaattatctaccggctttggcttctttggcttaggctcctttttggcttttggtttcttttccttaggtgctttcttcggcttttccttctttgcttttttctttttcttctctttggcttcttcctgctttgcagcctcggccataataccttcgttttcagctgcgagatcatcaggagaaatatcgtggtcaccaataatatcgctttcagtaacctctccgtcgccctctcctgacttcgaaaaaatactctttatcttctcgatcagtgcagctaatcccttcttctttggagcatcgtcctttggtgctggtgaatcgccagaaggctcactgtcagcaccaggtatttcaccgtcgagatcaggaacttctgactcagccgaatcctcgaatttatcggcgctctccttcaagacagtgccgttctcatcggcctcaagcatatcgcctatatcagtcagctctccatctccagcgagcatatctgataaatccctgtcatctcctgactcgtccataagatttacatcttttgcactggtgtccgaaaaatcatcgttatcaaacatgtccgaagcaaattcaggctgaaggagcggatcatcttcctcctgctttgcagaatcagtttcgacgtcaacagactttgctgcctgctttttctccttcggctttggagcttcttttttccccggctcgggctttggttcaggcttcttgtcgggaagtatactgtctccggccttcttcttggcattcgatacaatagtatcgatattgtctataagatcgtccctgggatttgagctgtctttcttctttggctgaccaatacttgaaaaataagggcttacatcttctccatccggtagatcatatttctcacttccagaagaagcaggggcctcgcctctctgactttccgaatcgtcgagcgactgttcaaactgtgctagaaaatcatcctcagaaagcgccctcttaagatttgctctcggcctttgagaattgcccgcatctgaaaggccgcttttatcgacaaagtcgtcgtccggacctatctcacgtctctttgcagctctctgttctgcagccttattatttctctcgtaggatgaatccacctcatcctgagctttatttatcgaatctaaaagtccgtttagaatgtcctccgtatctggcaaaatggacctccataaaaatataataaggccacatgactgtaactgtcatatggcctgaaaagccaggttaaatcaaaattctttgtcttttcttgcgacctcgtacttgtcaacgagatcatctatagctttgaccaattgtccgatctccggcttagtaagctgtgcatcagcgccgacgctctcacctttacggcggatgtcgtcattgataagtgaagagaaaatgatgacaggaatatgcttcatctcatcatcgctcttaacaagcttgcagaggcggtggccatccatctgaggcatctcgatatcagtaacgatgcagtatacatcgtctaagatagtgcctttcttcttcatctctgtcagcttgtcccacgcttccttgccgttcacattgacattcagattcgtgtaaccggccttcttcaggcactcaatgatcatcttcgacagaagggctgagtcctcggcaatcatgatcggagcctcgcctctcttttttatcttatcttcaggcgattcacctaactgcgaaacgtcgagtgcagtcgaaggattgatatttgcgacgatcttctcgaaatcgaggataactaccaggtgatcgtcaagcttgattacacctgtggcaactccattagcatcagaagaaatagtagaatcaggagtgtttatatcctcccaggatactctgtggattccaagtacctgatccacatggaatgcggtattcagattattgaaattcgtaatgaacagaaggccctcattgtccggatcatcaggatacccgaggcattttctcaagttgatgaccgagatgatcgtatctctcggcatgaaaataccttctacaaaaggatgtgcattaggtaccggagtaacatgctgatagttcaatatctctatgatcttcgcaacattgataccgtaatagttatcagctatcttaaattcaaggatctctaattcgttagttcccgattcaagtaaaatatttgtatccatcgctttaaacctccctgaacacttatctcttttttgacatatctgtattaatcttaaatgaagaattgtccttctggactgtataggaaaccttcgatgtatcctttacggttcctttagggaactggaaaagcatgaccatattcctgccctttccagctgcaatcgtaccctggtaagtagtcagatcattcaacagaagtgtcatatctgcatctgaagtctgatttccgtaagcggccttaaacttcaggttcgcggaagagatatcaaccttcagattcttcgaagtgttgtttatcatctttagtctgaccacgagaagctcatttcccttgtcgggactcagatcatagacatcactctgagagtaaccgcctccgaccttcgcatctctgtaaagtaaagacagaccctttataccaatggcctctgtaaatgtcttagtaatcggagtcttctcggaatcagtcgtactgtttttcgctgatgaactgttgccagaagcctgagtgcttttcttagacgtatctgaactctgctgcttagaagtactggtggaatccttcgaagaagctacaggcgtaagacctgtcttcgtcgacttatcgtacttcgaaaccacctgcgcacaataggcagcaatctggtcctgttcgtctcctttaagttcattggactgaagtccgcaccctgaaagcatgacagacatgcccagaataccggcagtcagtaaaaaaccctttcgcattctgcatacctcttgttaaattaaactaccatgtataatactatcattaacaagagtaaaattcaaacatttttcattatttatcgaggtcaaagtaaaattccacgccattagcatggtttacgacaccgcactccttgtgaaggtcatccataatggcctttacaatagaaagtcctatgccgcttcctccatattcacgggttctggccttgtcgaccttgtaaaatttctcccagagatgaggtatagactcctctggaataggattaccagagttgaagactgaaattcggtaatccttttctctctctgttatctttacctctatcttcctttcattttcacagtagtgaatagcgtttgaaaaataattcgttatcacctgttctatgaaaaatggatctgcccagacgcaggctggtccgttatggataaatgaaactgtgattccatttttctcagtaagaatgctgttcgacttgataacgccttctatgacttcaaccacatcaaaacgctctaggtttaagatcttctcaccgtactccaagtggcttaaatcgagaagctcctttacgatacggttcattttattggcctcgtcaacaataacatcacagtaatactttctgtcctctgcgttgtcatcagctacagcatcagaaaggccctccgcgtagcccattataagagcaagcggagtttttaattcgtgcgaaacgcttgatgaaaattcccggcgcatcttttcgttcttgtcgcgcagatcgagatccctctgtaagtcgctgttcgcctgcttcagttctgcgatggtcttctcaagagtctcagagagctcgttcatgtgaactccaaggtcgtcaatctcgtttggctttttgctcgggacatacttgacatcgaagtccaggtctgtcatttttttactgatcttagtcagcttaatgaccggatctgtaactctcttactgaaataaagtgatgccagccacgccatgaatactgctatacagcttgccactataaggactctggcggtaaaacgcatcgtctgctttatagctccgagtccggtccttatcaggacaagattactgtcaggcagagtgccccaaagcatcagaaactctgactcgacctgctcatctttaagcctcaggatggaatagtcactcgatgtcttttctactaccctgttatcctgatttctggacagcatagaattgtagagctgggcgatcatcatggcattcgagccctgagaagtacgcacgactttaccagccggtgtacagatcagaatctgcaggttttcgttcgagcacatagtctcaaattcatcgtcatagctgtcctcatagagaatatcttttttatctactttggacagctctttgtaggcctttatcagcacattttcacgccttatctttgaaaaattggtcataaagacccagtttaagacaaagctaatgaaaatggctccaaaggcgataaacaccatataacctgtgatctgtctgcttacactgtatttcctttttttattcttatctctgtgcggttttgacatcaattcaataaaatattaatttgcatacggatctgtcggatcccaggtgtgccagtatgggatcttggcaatcaccggcttcgaaagtggctggtaaccagatttatttgtgatgactacagttgttccaaccgggcagtgatcatagatccacttagcagaaccagcctgaactcttacacatccgtgtgagcatgtcgttccgaggttattgtaagctctaactgacatggtcctgttgttatttggcttgcttgagaaaattgaatggaaataaattccaggaacaattttcgagcaccactgaccccagcatggtcccataagttcatgccatctgtactgagccataatatggaaagtaccgataggcgtagcatttcccggtgagcagataaatgacttgaccggatagtatgtcgagccgtttactccgtaaactgtaacaaactgtttcgacttaataacgtagatcacatatttgctgaatttcggctttttgtagtacttcgagtttctgcttacatttgaaccatcggcatatttcaagccgttgaataatttcgctccataaattggagaattaacgtcagtaactactttcgtaactgtcttaaaggctgcgcttacactcttagactttgtgtaactgccgtagtaagtcttcttacccttcttatagtaggctcttactctgtagacatttttcttcttacgtgaaaccttcttatcagtatatgtggttttacccttctttttcttctttacagtggcttttctaacccatttgcctttgcttttcttcttgtaaatgacgtagccggttatctttcttcctttttctgacttgtgtgaaagagtaagctttacgttagcttttacaggcttcgcagtaaattttgcagtatatacaataacaattgttatactaacagacttcgaatatgccccataatagattttcttaccattgtcatagtaagctcttactctgtagacatattttccagaacggttagatgatttgtctgtataagtcgtcttgcccgtctttttgatcgtggccttcctgacccatttgcccttactgttcttcttgtaaagaatataacctgtgatctgcttatctttggcattttcatgtgaaagagtaagcactactttgttctttacattcttagcagagattttcgtattgcagactttaatctcttttgcatctccactgccgtttttgcccttattggaatctcctgaggctgtgttgttattcttactttgcgattttgcagtatcctgcggcttagtcgtatcctgcgtatttgaagcatcctgtgacttggctgtatcctgctccttcgtcgtatcctgcggtttgttcttatcctgcgccttcgtagtatcctgcgtatttgaagtatcctgtgcttctgtcgtattctgcggctgagtattcccggcattggttccgccatttgtattttcggactctgcagcctgagtctgattattctcagtatttgtggaagtctcagcagctggtactgtagtattagaattggtattctctactggcgtattctctgctgcaagagcacttcctcccggcattgcaatgatcgtaagacatgtcatagcaacagccgttgcttttttcaagttctttagcatttagttgtcctccacttcgaatttataccccatcccccagatagtgtgtatatagtttccacagtcgccaagcttgctgcgaagcttcttgacatgggtatctatcgttctggcatcgccaaaataatcgtaatcccatacactgttcagaatcttctcacgggacaatgcgagtcctttatttctcatgaaatattcgagcagatcgaactcctttacagacagcgtaacattctcgccatctgcggtaacagtgtgggcattttcgtcgagtgtgatctttccgcaggtgatcgtaccgtctcctgtagtcgcagtactgcttccaccctcatcacggtttatgatggcctttactctggccaccagtacctttggtgaaaaaggcttggtgacaaattcatctgctccggcattaaatccctcaagcgcatcgtcctcttcggactttgctgtcaggataatcaccgggacctgcgacttctcgcggatttttttcaatgcgccatagccatcgagctttggcatcataacatccataatgataagcgctgtatccggattcagatcaaactgggcaagagcctcgagtccgtcgttggcttctataacttcaaagccatcccgcctgaggtaatccttaatgagtttcctcatcctgctttcatcatctgctatcagtatcttctttgctgccattgtcagttttccctctcttcaagttctgttcatcctcaagtatcttttcttctttttccttaacttcctgttctcttttggtcagactctcatcccacgccgcgtacttgttctcgagcttatccttgtaatcgaggatagtcaggttattcgaggtagccgcgacaataaacataaatacaacgcagccggccaggacaagcgtaaaaggcagcagaatgtggaactttctctgccatttgagcttctgaacctgaatctctgtatctcttaccttgccggaatccaccacgggaatcagcgggatctgcgcattatcaatcgaatcatccgctaaaagctcattctgcagttcttttaaaaaactgtagccaacctctgtgtcaaagacctgtttactgataaggccctttaaagccgcaagctttccggcagaattcatattctgcatctcacctctaagataagagatagcgttaagttcctttcgggctttctccgccaatgcctcatcgctgaattcgaaaccgcctgctttagatttatcaatctctggcataattctcctttccgcgcatgtttttatgataacagtcttttaccaatattacaagaaaaaagaactccccgaaggatattcgaggagtcccttctttaattcagtcgaaagatcaaagcggataagccttgttctttgtatcagccttgttcggatctaccttagtctgctgagcctctctgtatttgaagaattcctcagcaacctgtgggaacagtgcataggtgagtgtatcctcatcctgctgcttgtaaggtgcaaccttcttctccatctctggaagctgtggtccgataaggtctgcaggtctgcaggttatagcatcctttgcctcatctccaagacacttctttactacatccggattgaacggcatctcggtcttaccatacttgccaaggagaaggtcctttgactgctgggtaacgactttgtatctctcgcccataaggacattgaatacggcctgtgttccaacgatctgtgaagaaggtgtaacgagaggcggctcaccgaaatctttacgaactctaggtacttcctcgagaacctcctggagcttatcttccttatgctggtctttgagctgtccgataaggtttgaaagcattccgcctggaacctgatacagaagagtcttgatgtttacaccaagaaccttggtgctcatacggccattatccaggtacttctgtctgatcggagcgaagtagtcagaaatctctgagagaaggttaaggtcaagaccagtatcatagtctgtgtccttgaatgcctgaaccataacctctgtagccggctgtgatgtgccgagggcgaatggagagatagctgtatcgataatgtcgcagccagcctcaactgccttcatgcatgtcatagaagccacacctgaggtgtagtggttatgaagctcgataggaatagatactgccttctttaatgcagggataagctctgctgcctgttttggtaagagaagacctgacatatccttgatgcagatagagtcagcaccaagggactcagcttcctttgccttcttaacccagtactctgtggtataaggctcaccgagcgtgaaagaaagagcgatctgagcatgtccgccctctttctttgcagcctttacagcagtctctaagtttctcatatcatttaagcagtcaaaaatacggatgatatcgattccgtttgcgatggacttctgtacgaagtactctacaacatcatctgcataaggcttgtatcctaaaatgttctggccacggaaaagcatctggagcttagtgttcttgaatccggcacgaagcttacgaagtctctcccatgggtcctcgtgaaggaaacgcaggcaggcatcgaatgtagcaccgccccagcactctacagcgttatatccgactttatccatgactggaacgatcggaagcatttcctcagttgtcattcttgtagcgataagagactgatgtgcatcacgaagcactgtctcagttatctttaatggtttcttagccataaatttcatttcctccttatacaccaaagatagccatgaatacgccggcagctactgctgttccgataacacctgctacgttaggtcccatagcatgcatcagaaggaagttcgtaggatcttcctctgcgccgaccttctgtgaaacacgagccgacataggaaccgcggatacacctgcagaaccgatcagagggtttattttgccatgcgtgatcttacacataagctttccgataacaagtccacctgctgtagcaaatgcaaatgcgataagtccaagtacgacgatctttaaagtgctggcattcaggaaagcctcagctgatgtagaagctcctactgaagtaccgagcaggataactacgatatacatcaaagcgtttgatgctgtctctgtcagctgtctgacaactccgcactccttgaagaggttaccaagcatcagcattccgataagaggtgctgttgtaggaaggataagacatacaacaacagtaacgactatagggaagaggatcttctcaagtttgctgactggacgaagagtcttcatgtggatggagcgctcctcatgtgtagtcaaagccttcatgataggcggctgaatgataggtacgagtgacatgtaagaatatgctgccacggcaataggtcccatcagtgccgactgtcccaacttacctgcgaggaagattgatgtaggtccatcagctcctccgatgattgcgatagctgctgcagccttgtccgggaatcccataaggatagcgaagagatatgccatgtagataccgaactgtgcagctgcaccgagtaagaacgaaatcgggttcgcgataagaggcgagaagtctgtcatcgctccaactcccatgaagataagtgaaggaaggatcgaccactcatccagctggaagaagtaccagagcaatccacctacgccattcgaagtctcctgaggacttgcaatgatatcaggatagatatttaccagaagcattccgaatgcgatcggcaccagaagcagaggctcaaaatctttcgcaatggccagataaaggaaaacaaaggccacgataatcattataaagtttcctacagtaagattcgcaaatgccgtctgatggagcagattgcccatcgtctgtgcaatataactcatttatgaatcctccttagaatcagtcgtcgttcatcgtagcaagaagatctcctgtatcacatggatctccctctttgcactcgatagtagcgacagttcctgctacaggtgctactacaggtgtctccatcttcataacctcaagaactacaatcgggtcgcccggcttaacctttgttccaggtccagctgcgatcttaaacaccttaccctgagcttcgcataaaatcttgcgtgagccctggtttccagctggtgctgctggagctttcggtgctggagcagctgcaggagctgatgctgatgcacccttctcttctacggatacgtcatatgacttgccatttactgtaatggtataatttttcatgatattttcctcctgaatcaatatcttctcttaatagaacgcaccacgaatgaatccgtagaagcgcctgtggcggctgagattgccgcactgataactgctataagttcttctgaatcctcttctgctgaaggctcagcttctactgtctctgctgcaggagcagtctctcctgactcctgtgctttattagcctcatgtttcttctgtaaatacggaataatattgaaggcgtagatgaccaggcagatgataataagaactacaaagactatcgctaatcccatgacacagttaagagctgctctgcccatagtctcacccagtgtataaacagggttgaagttgatgctcgtaggctttgccatgttgtatgacttgaataccatgacgaaggtggcatcacgctttgaatacttcatcgtgagagtagtcgtgatattctttccggccttatcgactttgaagtctccaaagcccttgaactcgccaagctccggtgtatagtctacgaagttcttgaacatctctttgtaaactttaagttcgtcattgtccggatcggctgatgactgtgtagcataggtcttatagtacttctgtaagtcactcttcgacatagcagctaactgagtaccaaggccgactgactcggtcttaaggtcatcagcagtctttccgccataagtctggtccgtagtctggccacaggaagctaaaagacaaaggcaggcaaggagagcaaaaatgacacttatttttttcttcatcagattacctcgcttactttgtgacatgctttctatatgcctcgtctactttctttgtgaaaagtacttcaaatgcgtcgatcagatactttctgatatcggctgcatttacaaatctgtctacaacaccgcggcgtgctgcattagctgatcctgaaaccttagcttcataatctgcctcagaaacacctgcgatctttgctgcctgcttcgtctgcataggtcccatctcggcatctgagaatgcataaacaatatcagcgcctgtagaatggctgcccataaggatagctgctgaagtgtatgccttggctactactgctaccttcggtactgaagcagaagcataggcattgataaactctgctgatgcagcagtaagagaagcctctgcatgaactgtggtcaaaaatccctcggtcttaacgagtgaaagaacagggatatcaaatgcgtcacagaacttaacgaagtctgctgcttttcttaaagccttcggtgaaagtctgtcgtcaaactcctcgtctccgctctttacagtgtttccaaatgcaccgatcgtcatgccgtcgagcttgataaagccgcaggtcatatcctttgcataatcagccttaacctcgacgaagaactttccgtctgaaatctctttaaatacgtctgctgcgttctgatatgaggctcccgcaacatcagctgctctgttcagatcatctgtgcactcatcaacgcagccctcttcgatattgcttcctggaagtacaggtacaagctgtcttatggctgcaacaacatcagcctcactgcctgtgccatcgataccacctgctactgtgcttctgaaagcatatgcagaagtatctgttcccttgtttccagtaagggcatcaggtgaattgaagaataccttcgcatcatctgtcatgtaagtaaaatcagctaatgaaaggagtgctgataatccaccaccgcagtttccaaatactgccatgatctgcgggataactccactgacttcacttgctttcgaaagtacgcttccaagtgactcgatcgcatcatatgactcaagaaggcgtacgcctgtgctgtcaagaagtccgataacaggagctccgactgcaagtgcctgctcatacgtgcgaaggatcttctttgcgtgcatttctccgatagatccgccaagaactgacggctcctgggcgaatacaaatacgagatttccatcgatcgtaccgtgtccagtgactactccatcggaaggtgtgtcttctgctgcctggttaaaatccgtgttgcgggccgttacagaagaaccaagctctacaaagctgttctcgtctaaaaggctctggatccttgagactgcagaaaatactttttcctcactcatagtttattcctccaacgtctattaataagtctagcgaaaaaaatcgcaacttagctcattttatctcaaatcggatagtttatcaagggcttttcacacatctactgtctcattttcagcctcttcgactgcttcttccttgaattcagcgatctgttcgtcgcttaatgacggaagtgaagaaagtgactcaattccgaacacccgaagaaactcctcggtcgtcccgaaaagtataggccttcccggagcatccatccttccgacctcttcgataaggtcgtattctacaagcttgtttacagaatggtctgagtttactccgcggatcttcgcaattgctgccttcgtgacaggctgcctgtaggctactattgaaagcgtctcgagaagtgtattcgtaaggactgcctttttcggctgcttcgcaatttttataaggcttccatatatttccctggccgtacacatctggaagctgtcctcaagtcttacaagcctgatgcctcggtccgctgattcgtactcttccgcaagctcttccgatgcctttatgacctcttccttagtgactccaaaggcttccgccgcggtctttgcgtctaagcttctgccgattgcaaagtaaataccttcgagctctttttttaattcattagactgcatatgctacctgtgattccatttctatgtctccgaagatttcctcctggcgggcgtgtatctttccggtcttcataagctctaaaaccgcaagaaatgtgacaatgacctcagtcttcgaggtgtcaccttcgaatagatttctgaaagaaaaatgcctgtgtccctttgcgaatgaaagaagttcaccagttttttcttcgagtgaaattttttcccttttgatcgaaccgaacttggatctgatcggatcgacgcgttctctctggcgctttaatacctcattaaaaatggcgtttaactttgataaagtcacgccatctaaaagttctgccggatcgaccggtgcctcataatttttgacctcagggggaatcgtaggttccttaaagagaacgagtcccgcttcatcctctctctccttaagctcacctgcgagctcgtggtacatcttgtactcgagcagcgcatcgataagttcctgtctcgggtctgtctgctcttcttcctcttcatcttcaggtttcttctccgggagaagcatcttcgcctttatcgagagaagagtcgatgccatcacaagaaatgcactcatggtgtcgaggtcagtctcctccatcctgtcaatgtagtcgaggtattgatctgtgatttcaactatagggatatcgtagatgcttaccttatttttttcaataaggtgcaaaagaagctcgagcggcccggagaaggcctcgagcttaacgtctaatgtctttttttcttccatcaggccctccccgtagatccgaagccgcctctcgactcagcgtctaagtgctctttttcttcgaatactatcccaggctgatgcttaaaaatcctgaactgacagagtctgtcgtttgctgaaatgtgaacgtccctcgtcgcaaaaacaggcatcataaggatgtcgtcgtcgccacagtagctctcgtcaactactccgataccgttcgactggagaagtccgtaatttttaaaagtggaagaacgtggtgctgtgatcatctcgtagccttccggaagcttgacagaaattccaaggtcgataagacagaactcaccctttttcaggtcgtagtccttcgcagcgcgaaggtcgatccagtcgcttttcccgtcgatgtatttaagtttttcgattttatctgtgtgatatttgatctgaatagtctctttcatgatttttctctttttattcccagcagtctccgctgatctcactctttttgtctctgcacatcaggtcgtgtaccgcgtcctttgcgcttttgttgcagaaaagcacctgatttacctcagtgattataggcatcgataccttgtattttctgccaagtgcgaatgcagctttagctgagtagacgccctcaactaccatatggattctctccatggcttcctttaccgggactccctgtccgataagctctccggcctggtggtttctcgaatgcacagacgagcaggtaacgatcagatcgccaatgcccgcaagtcctgcgagcgtatccggctttccgcccatcgcaacagcaatcgccgtgatctctctgatgccccgcgtaataagagcggccctcgcgttgtcgccgtttccaaggccgtcagacatgcctgcagcaagcgctatgacattcttcagtgatgcgcctacttcaattccctttacatcggagctcgtatagacacgcaggttttcgtccataaaaatatcctgtactttttttgcgaggcggaaatccttcgctcctgcgacaagcactgtaggaagcttccttataacctcctctgcatgtgaaggaccggataaggctccgaccaaaactcccggaagctcgtcttcgatgatctccgtctgagtcatcaggctgtcctcttctattccctttgaaactgaaatgtatccgacatttttattgaaacatggcttgacttttccggcggtctgccttgtagcagtagacgggacagcaaatacaaccagagagcttccggaaagtgcctctccgatatcgtcgaaaaattctatcccctccgggtataagaagcccggaagatttttgatcccgcggtcttttttcatctgagaaaccgctgcgggattgtgtgaccagagcctgacactgtgtccgttccatgccaaaacagaggccagggcacttccccagctccctgcccccagtatggtgacctgtgacatctctcacccctccttctttttgtggtggaatgaaaatttattctcgtttccagtgatgagacggccaatgttgctgtgatggcgccatacagcaagcgctccgacgccaaacgacaggactataataagaggcgcctcctgcatagtaaaagctgtatggcccgtgaggattgcggccatagccatgaatggaaatgagatagcacagagtatagaacccagcgaaacaaaccttgtgatcgctactgtgatcacaaaaactgcaacctggaaaggaattatgatcggataggctatgataaaaaggccaagcgaagtggcgattcccttccctcctttaaaatgcatagtagccggaaaatcgtgtcctatgacggcgccaagcgccgcaaaaaacatgatcaccgcctttgattccggctcaaaatgagatgcgacagcacccatgataagcgccggcacaacgcccttcatgcagtcaaagaggaggcagagagccccctgcaggttgccaaggactctcaaggtatttgtcgtaccgatgtttccgctgccctgcttcgtgatatccacgtgttcagccttccccataagatagccggaaggcacatttccaaaagcataccccaataaaaatgccagaaatttaagcattattcttcctcttttctctgcctcacaataaaatgaagtgctgtcccctcgaatccgaacgcatccctcaatctgttctccagatatctcagataagaaaaatgcatcagatccttatcatttacaaatattacgaaagtcggcggcttgacactgacttctgtagtgtagtaaatcttaagcctcctgcccttgtctgacggcggctcctgcatcgcagtggcatccgctatgatctcgtttaaaacgccggtctgaatacgcaggttctggttagaaatgacctggtcgataagttcgtagagctttgataccctctgcccactcttcgcggaaataaatacgatcctggcatacgggataaatgagagcgtctggcggatcttatcggtctcgcgctttacagtgtgcgtgtctttttcgacggcgtcccatttattaacggctataataatgcctttacccctgtcgtgggcgataccggcgatcttcgcatcctgctcagtgacaccttctgtcccgtcgatcatcataatgacgacatcagacttctctacggcagccacagctctgattatcgaatatctctcgaggtcctcttttatcctgctctttcgtctaagtccagctgtatcaacgaaaatatattgctcaccgttgtactttacaagcgagtcgagagtgtcccttgtagtgcctgcgatatctgagacaatggctctgttctgacctgtgagcctgtttacaagagacgactttcctacattcggctttccaatgatcgcgatacgcgggatgtcgctgtcatcgtcactgctgtcctttgcaggaaaatccttagtcacagcatcaagcagatctccgaaacccaggtttgaaaccgctgaaaccggaaacgggtctccgattcccagattgtaaaattcgtagatgtcgttcttctgcttcttaaaatcgtcgatcttatttacacacagaactaccggtttgtgtgaacgtcggagcatatctgcgacttttccatccgaatctacaagtccacttctgccatcgactacgaaaatgatgacatccgcggtatctatcgcgatctgcgcctggtcgagcatcctcgaaagcaggatgtccgaagtccccggttcaatgccgcccgtatctataagtgtaaagtcgtgatcaagccacgacgcatcagcgtatatcctgtcccgggttacaccgggagtgtcttttacgattgaaatcctctctccgacgagagaattaaaaagtgtggacttcccgacattcgggcgtccaactatagcaactattggtttagccataatctatctcactattcttctttgccgagcagagcatccaaaagatcctgcccactcgattttacaacagtaaccggcacttgtaaagcgtcagagacttcgcctacggtcatgtcgtcgagaaatacctcctcgttgctgcgcagcatatttacagggataagaagcctgtcatttactccgtgctctaaaagctgtgtttttaagtcaattcccgtgataaggcccgataccgttatctgctcaccaaaatagtggtttattatcgtaaccacttcgacctttatcctcgggtattttttcataaaaaggtctgccagctgccttagaaaaggagccgcaagaactccggtcgcgatcgtaacactcttgtgcctgaaaaaatgcgggccttccttttcaagcgctgccttgaattcctcgatcagaaggcggatcatccccactccgttttcaagctgcccgaaaccatcgtagacagaagcctccggcaggtcccttcccgccgtaagataccactcgtccgaagcgaagacaaagtgttctccgtacttttcgaagatctttttctgccagccctcgatctggtcgatgacttttatggcgtcggccctttcaaaaggttttagattgtataagcccttcctgaatttcgtaagccctacagggaccactgaaagtgaggtgacctgcggataaaatgagagaaggtcttctatcgttctatctaactcctttccatcatttatccctttgcagagcacgatctgggtattcatcgtaagtcccgcatccgaaatctttttcaggcgttccataacgcggcccgcgtttttattcgcgagcatcctgacccggagttcaggatttgtagtgtggaccgagacatttatcggggaaagcctgtagtcgattaccctctgaagctcttcatcggacatattcgtaagagtaacatagtttccctgcaggaaagacagcctcgtgtcgtcgtccttgaaatagagcgtctctctcattcccggcggcatctggtcgataaagcagaacatgcagtgattagaacaggacctgtagttgtcgagaagaccgtttttaaaggtgattccgatgtcagtgtcttcgtctgacttttcgatcacgtagttttgttctcttccgtcagggtgccttatcaaaagatcgagcctgttattttcctcgtaatagtaatagtcgaaaatgtccttaagctcttttcctccggccttaaggatcgtatctccgggccttataccggccctttcggcaagagagcctctcctgactgattctatctcgtgtgtatcattactcataaaaataaaatgcgttcctcagcagcctgatgcgatccggcacaatgcttaccacatcaaagcgcacttttccctgatagtcgtgtaaggtcatatagtaaagagctgccctgcatatctttctctgcttcctcttatcgactgtctcctccggataaccatatcttaacgagcttctgtacttcacctcgacaaaacagagcgtatcgccttcacttgaaataatatctatctcgccgaccttacagtggtaatttcgctcgataatgctttggccgtgccgttccagaaaatcgcaggccagcttttcatactcttttccaatgtcccgcttattcatgctttccctcagtacaaaccgtcatcttccaagttttgctttcagtttgtcggccttgtctacaaagaccaggatctccgccactacttcatagagttcaggcggtatcgcatcaccgatctttaacttcgaaagcgtctcagcaagcgatgagtccttgtaaaaaggcacgtcgctctcctttgccttctcgatgatcttctcagcgacttcccccttacctgtcgcaagaatcttcggcgcctcgtatccagcctcgtaggaaagcgctacagctgttttttcctgatctttttcgtccatattcaagccctcacatcaaacgaatacctgagtatctgcttcccgcttttggccttgttggtttttacatcctgctttaaaaagtcatcgacaaaatttcgctttacatcggtatttttcacggagatcgtacagttgtatcccatagattcgagcttctcctgtaaaaaatgaatgttattttctataagcatgtaagactcgtcgtctgcgagcgaaaaattcgtatcgagctttttctttagaagcttaacggagatgtccgtagaccccagatgctccaggtcaaggtgcagaaaagcggtaagcggctcatccggatcccagtgctttttctttttgtcagcatagacaaagagctcactggtcgcgttctggtttaacatcttaagcggtatctgcacgtaattgtagaccgtatttacctgcttaatgaagttgacattggactgaacctgctggcttaaactgtttatctgcgccgcctcccgctgagggagtttttcggccgcctgctgcgcggctttagttacatcctcggagagcctgttaaacgagtcgtttatcctctgcttgtcaactgcctcctccggcgttagcaggtacttatcggaaattatcgccttcataagctccggaaaaccgctgtttttcatattcgctctgataaattcgcttcctctggtgtcaaaaagcgccttcatcgagagaaatacatccttcgtcagcgcatccggcttcagctggcctatttcattaaaaagccccggaaaattttcttttaatgcagtatttgaattcataaaatcggagagcttcttaaagtcgtcgcttcccaaagtgtttccaatcgtgccctgaggaaatgcgctcctgtctatttcacctggatttatatcggcggcctcagtccgcgccatatttgatgctgcactgctgccatcccctgcagaaaccgcctctcctgcctcatttaaagctgtctcggcggacagcggattctcaaaggccatatcagagatagcgtcatctccgtcagaaaagacattgtttatgatttcagtgaccgcgtcaaaattttcgttgttttcagaagctatatttgaaaaagcttcagataagtcttttaagtcagaagccacatagtcgcttgactctttgtaattatttatctgcgtaagtgtctccgagtcgactggaataccgagatttttaaggactacagccatcttcgggtcagcttccggatttaataaaacttcccttccgacggacgcgatgctcttcgaatcgatcggcatcttgttctttatcatctcatcgaccatggctacggtctgatctgtcacaggaagctgcgcgctgataagcgcattttcaatgatggggtttccagttgaggctccgatggaaactggtttgatgacaacctcatttccgtcattcttcttgacctgaaaaaagacagactccccctctgcaagcgcaatgtctccgagcagcctggctgtgatgttctgcccgctcgaaagcccaagcagcacctcggagccacggatgttatttaccgtgccttcaaaaacagcgccttcttttaaggcatttagcgcggaggtcagctgctctacgccctgggccttcgcgggatcagcttctgaactcactccgttgctgtaatactgatttacgagatttctaatctccatagagacacctctcagtcgggaagtccatattcctttaaaaatgtgtccattatcgtcctcggatcttcaaattctatattattctccgaggcagaaagctttcccgcctcgattctcttcgtaagaaatgatctgcggtgtatcggcagtattccatatttttcaatggcctgatagtgggccttcgtcccgtaagccttgttcttcgcgaatccgtactcgggcaccttctcgtcgtagaccttcatgatgtggtccctcgtgaccttcgcgatcacagaagctgccgaaaccgccgcaactgtcgcatcggcctttactttaggaagctgctctatgtcgactcccgggatttttacagcatcgtttactataaaatcaggcttcaccttcatagaaaaaatggcccgcttcatggccatatagtcggcctgaaggatatttatctcgtcgatctcctttacatctgcgagcccgactccgatacttaccgcatttttaactatgtctttaaaaacttcttctcttcttttttcggataatttcttcgaatcgttcagatgatcgataaagacgtcaggctttaaaataacacaagccgccacaacaggtcccgcgagcggtcctctcccggcctcgtcgattccgccgacgtgttcaattcctcttctatggagttcatcctctgtctcgtagagactctttaccctctcgcgctctttttcttctctctgagtcatctggcttcccctctgaaaaaaatatacctacgaaactcttcccgccttatcaaacggaaaaatacgtgttatcactttcccgactatctgctcgctctttacggtaccgacatctgaataccggctgtcttcactgtggtttctgttgtccccgagcacaaaatactcaccagccccgagctttatcgggtaagctgcaatccccggatcagagatcttctcttttccgtatttgtcggaaattttcttcccgtctattagtatatcaccttcgtcggtaatttgtactgtttctccaggaagaccataaactctcttgacaaaataggtgtgcttcttatagagataagtaaattcgactatatcgaagcgctgtatcttatgctttagcggggccatcctgtctacgatcagattgtccccgtcggagaggaccggctccatcgatgagcccttaacgacagtcctctgcacgaaaaaatgtgccgcgagaaatcctgcaaagcagattaaaaatataattaatgtaaatctaagatatttagtccggcttttcaaaagatacctttcccagtcttccagacctaagatcgtcaagaaaaatatttgccgcgcggtttaaatcaagtgctccgccggccgcaagaagtctcctcgactcagctattgcaggaagcaccatagcatcatccagattctcatctattccgtaaaaatcgttaagccttccaggatagagctctgtcatcctgtgatagaggataagggcaagctcctgtttttcaaagacatcatctgaaatggcaccaaagagagccaatgcttctccagtgctctcgtcgtcaaactttggccagaggattcccggggaatcgaggaggtcaagtgttttatttacatggatccactgcttacccttcgtgactccgggcttgttaccagtttttgcggaattttttccggcaagattatttataagagtcgacttcccgacattcggaatacctgcaatgagagctctgaccgggcggtttttaatgccgcggcgcagatctctggctcttttttcagctgaagccttatctatcaaagctgcgatctcgcgcttcttagccttcgagcggctgtctaaggccagtgaaaaaatgccctgtgacttgtagtattcgatccacttcgttgtcactgcatcctctgcgaggtccgctttattcagcagaaggatatggatcttgccgttcgtcagattctttatctccgggtttctgctcgaatccgggatcctcgcgtcggcaagttcgatgaccatatcaataagtctgatatcttcttttatctgtctcagggccttcgtcatatggcccggataccactgtatattcatcagtctactactccgaaatttttccttgagacatcaaaccagatcttaccttttatctggcttccgagcacatttccaacgttctggtagcgcgaatcctcgctgacatccctgttgtccccgagcacaaaatactcatcttttcccagagtgatcgtattcgaggcgagtccggcatcatttatggctgtcgtctctacaggtgcagtgtatgccttgttgttgacgtaaactatgccgctctttataacgaccttctgtcccggagtagctataacgcgctttatcgagtacctgcccgacaaatctccgtacggaagaaatgccacaacatctccggccttaggtgaatgaatcctgtaggaaactttgtctatcagaagggaatccgagactccgacctgcggctccattgactcctctgtcataatgacctgagtcgcgaacgattcgattattatatatgcaagcaaagtaactgcggcgatctcaagcgcgagtatcagtccgtgtaaaatcttgtggtagtctctcttcttcctgttccttctaaaatcaagagtcttgctcgtaggttctggctttataaatgcccttttattcggaatgactttcataaaatccgccttttaagaaaaaaagatggccgcgcgcggccatcccatttacattgcagacaattagtctcagattgtctccttgaccttagcgctcttaccaacgcggctgcggagatagttaagcttagctctgcgaactttaccttttctgacaaccttaacgtcaacaacgtttgggctgtgaagagggaaagtcttctcgacgccaataccgcttgaaatctttctgacagtaaatgtctcacggtttgagccgccctgcttctttaagacaactccctcgaagacctgaatacgctcatgatctccttccttgatcctgtttgatacacggactgtatctccggtattaaactctggaactgtctctttcttctgtccttcttcgatctgtgcaatgatctcttttgcgttcatctgaaaacctcctgctgacaagcccgtgaacatgagcctgccccaagtgtaacgttcatagggattggttgaccaaaatgcctgcctactcttcttcggcttgcgtccccagcggaccgtcatgtcaaaaagcaactatgatatactatcacatatctcattctttttcaagaattttttcttcaatctgtttgagagtgaatccctaagccctggaagagctttcttaaacagatcagggcgaagcgtccttgtcctctcgatgctctgttcgagacgccactcgtcgactaatctgtgatttcccgaaagcaggatatcaggcactttcctgcctctccactcctcaggcctcgtatactgcggatactcaagcagattattttcaaagctctcagtctctgccgactcgccgttccctaagactcccggcacaagccttgccacacagtcacaaatgacgcaggccgcaagctctccaccggtcaggacaaaatcaccgattgaaatatagtcggtcacgatctcatccaaaactctctggtctattccctcgtagtggccacagagaaatatcagatcagactccttcgaaaggtccttcgcaatcccctggttaaaagtcctgcccttcggggacatagctatgaccgggcagtcgcgccctgtcttctcgtggatatatctgtagcagtcgtaaacaggctgggcctccattaccatcccggctccgccgccaaaaggatagtcatcgactttcctgtgcttatcctttgaaaaatcgcggatatttacgcagttaagctctataaggccctcatcaatggctcttccggtaatactcgtatgcagagtattctctaccatctccgggaaaagcgtcattacaaaaagtctcatcagagatcctccagtcctggaagaaggtggactttgatgacgccggactctgtgtctacagacaggatgcagtcgtgaatagccggaatcataagagcagagccatcagtacgcttcacttcatagacatcatttgcggctgtagttatgatatcggagacctttccgagttctttccccgactcatcaattacagtaagcccgatgatatcgcctatgaaaaattcgttttcaccaagctctattccctcgcttctcggaatcctgatctcagaatttctaagagcataggccgagtccatgtcttttatctcttcaaagcccagaataacctgttttttaaaaaatttgaccgagtcgaccgtaacctgcttttctttcccattcaggtaaagcgtcacagtctttaagtctctaaacctctcaggttcatccgtcgtaggatataccttaacttctccgtggactccatgcgtcgaggtgataactccaacctttaaataatctctgtccatttcagtccctgtaaaaatgccgcccgactcatgacttatgtcataagcacaggcggcgcatcgtcaattcctgtcctctatatcgacatagactttcttgtctgtgtcaactgcggcagccttgaccacagtacgtatagccttggctatacggccctgctttccaatgacctttcccatatcggaaggatctacagaaagcaccagtcttatggctctgtcatcctcagtctcagtaactgtgacaccctccggatgatcgaccagggcacgtgctataacttctactaattctttcatgtaatccacctattcccctgacagtggtactgtccggaaaattatttctcgattccggcgttcttcaaaagacgctcaacagtagctgtaggaacagcaccgttcttgagccacttcttagcgaggtcggcatcgatatttacagcagccggctcctgattaggatcataggttccgatctgctcgatgaaacgtccatctctaggtgagtttgcgtctgcagcaataattctgtagaacggattcttcttcttaccaattcttgtgagtcttaactttaccattttgtcctccaaataaaattaaaaatatatcgttaaagtcaaaggataagctccaactttaatacctaaaatccaaacggcatctttccgaagccgctgtgtcttctgcccttcatcataccaggcatcttcttcataagcttcgcagattcgttaaactgctttataaagcggttgacctctgcaatattcatgccggcaccctttgcaatgcgctgctttctcgaaacagataagatcttcggattttccctctcttcaggcgtcatcgacatgatgatagcctttgtccggccgatcttcttctcatctaccgagcccttgagctgatccatctgagcactcgaaagtccaaatcccggaagcatgccgagaatactagtaagtccgcccatcttcttcatctggtcgagcgaagtcaggtaatcattgaaatcgaagcccttcttgaaagccttctgattcagtttcttcgcttcttcctgatcaaatgagttctgagctttctcgataagagtaagcatatcgcccataccgagaatccttgacgccatacggtcaggatggaacggctccaggtctgagagcttctcgcccatacctgcatacaggataggcttgccagtaaccgcccttatcgaaagagcagctccgcctctggtatcgccatcgagcttagtcaaaacaactccgtcgatcccgatcctgttatcgaaggtagaagctacgtttacagcttcctgacctgtcatggcatcgaccacaaggatagtctggtgaacatcgactgatgccttgatatcctcgagctctttcatcatatcgtcgtcgatctgaagacggccggcggtatctaagataacaacgttcctgttgttcgagctggcgtaagagatgcccgccttcgcgatatccaccggtgacttctcagttcccatcgaaaataccggaacatcctgcttctgtccgttgaccttcaactggtcaatagcagccggtctgtacacatcgcaggcaacgagaagaggtctcttgcctttgagcttcatcttaccagcgagctttgcggcagtcgtcgtcttaccagcaccctggagaccacacatcatgattactgtagtggcctgtcccggctgatacttgatctcggtgatgtccgagcccatcagagaagtgagctcctcatttacgatctttatgaccgtctgagccggattaagtcctccaaggacgtcgcttccaacacatcgctcagtgatcttattagtaaaatccttcacgacacggaaattgacatccgcttcgaggagagccatcttcacttccttcatggctgtcttgacatccttttcagtcaggcggcccttgctgcgaagattcttgaaaacattctgaagtttttctgtcagactgtcaaatgccatataactcctatagctgcttcatgatctcctctgccttcctgtggcagacacctatgtcgtcgctctcagcgatctctttcgccagaccctcgattcgctgatactcagcgaggagcccaagcttctcttcatagcctctgagaagccccgatacccggtgtatcatctcactgataccctgtctcgacatcgaaaactcccctgccatctcgcttaacgagagatcctcgaaggcatattccctgaagatcttcttctgcttgtcagtcagaagctctccatagaaatcaaaaagcaatccgtcatgtaccttttcttccataacctgaaacaatatactacattttgattttgctgtcaagtatttttcttgacagcaaatattctttaatcaattccccatcatattttacagaaaaatcattgagtacttctactacatatggtaaaataggagccgtttatcagaaagtattgtgacagctggctttttcaggagtgtcggtgcataatggcggacttcaggcagctcatacgggcatcggagcgcgaatatccaaatcttaattatctgaaagaggatagtgaaaccagcagggaactcgctggtgtttttggtgtatccgaaaacgagataccgctcgtctgcacagctcaaaaggccaatgatctggcgctttcaataggcaaaaatgtgctgataacagacacctccgttctgataaaggacggcgaggggccagtaatgcgcatgccactctcccggctttacagcgtactgatatcatataaaagcagaaagaaaaaagtacttttcatcacaccttcaggccgaatagagctctacacccctaagatggtatttaaagacaacatttccttcgagctctacagccttcttgtcacacttcaaaacgcgctgataaacgaaaacccatctcttaaggagagctactatcacactcttgatgctctctcatcatatgtcaagtcctgttttaaaaatcaggcatatctctctgatgagaatcgcgagcttttaattgaaatcctgcataccgatccgaataacctgatagccggcatggtcttaaaggaggaccgctacaggacattcgatgcaacagtgcctcctgcccaggaggagaagttctactcgaactacctgacgcttatcgcgacagactattcatccaggctttaccgcaccatgataaaggcctacagccgcctgttatcaaaagatacgctctctctaaaggacgcatatctgctctgtgccctcggatacaggatgaatgatcagaagacatatcttctctacgacaggattcagaaatacctgacagaaaatcagaagcactttctgaactatatatctgcacgcgtatcccgcgaaggcatggactcgtgcatgtctatgatactgaccggaaaaatcccgtcggggctgcagcttcagttcacagacgacatgggcttcgactgcctgcactatgcgataatcctcgagaaaaaggagatagtctccgaactcctgaaacaaaagacctggggagccggcgagccgtccagatcagccggtctcgcaaacagcttctatgactacttcttccttgcctcatggcatataaatgacgtgatgttcttaagagaagtcttcatctataccaggccagaggcatcagaggtctgccggactctaaagagaggccgctccttaagaggcatcgcagtatcgaggcttagtctgataaataacaagatagccacgataaaaaagcgtcagattgaggccttaaactcaggcaatccaatggcctactctgactacgagctcgccatctcatctcttctcgaagagaaaaatgacctgaagctggaattagcctatctgaagaaatgtgaagaacagaccgaagacgagctcgatgtgctcttcaataaagctctctcacaagcgaaagagatgcttgcggtattaaaaactactgctcatcctatggtctcatatatgctccaaacactcaaatcaccagagagcttcataacgcttcatgcgatgactccggacagctacacactgttgaggtacagaggactctgcttccttggaaaagcattcaaagacttaaaaggcatactctcaagcgagatcatagaaagtgaagaggccgacagaaagaggttctttactgctaagacatctccaataaataacccatggcgcgaacacgaaagggaacaggaaaagaagagagaaaaagacaggaaaaagtcgtacgaaaactatcaggataatgcagatggagctggcgataacagcacaggaaatcgtcctgagcgtggaagccggaaaacacactggttctcagaagctgcgatccacgacgacagaatcctaaagaaagagtatcatctgctgataaagcgctaccatccggatcagaccggaaacagcgatggactggagaccttaaaagagatcatcgaagaaaaagatatgatcctaagacaggctccttaaggcctctctgaccttgtcatagtcgaatccgcgtccaaggagaaaacggatcatcttcgccttgtccctcggatctgcagaagagacatcgtaatgtctcttctcaataagttctctgatcttctcctcttcactcgtaagggatgcctcatcaaggcagtcttcaataatatccttatcaattcccttcctgagaaggtcctgagttagtcttctcctgctcttctgctcctgatgaaaatagatatagttcgacgcatagcgcctgtcatccacataaccatatgacgaggcgtaatctatggcggcatcagctatatcctccggatagcctgacgaagtaagcctcccgtaaaggtctgctctggtcctgtcctgcttctcgaggagatgaaggcagcgcttcttcgcgcggggaagaaggatggacgtcttaatactctcaaaagactcctcacttaaatcttccccgacccgaaggcccggcattctcctgatctctccggcatagagcacaaatgactctctcgtatcgagtgtgatccgctttctcttcttagacctgggaagcggctcaatgctgactatctgcatctgacttccccaatcctgtactgctcaatgtcatacgccttagtcttcatctgagacctgggtaacagaaacagcatctgatgaagcatccttagtatcagtatccgacgtgttctcatcaatgtcctcgtcatcgagaccgtagtgctcacggataagcttcgtcacatctgccatgacctgtggattctcagcgagataagccttcgcattctcgcgtccctgtccgatcttatctccctggtaagcgtaccatgaacctgacttctggatgatatcgagcttcgcagctagatctaatacgtctccttccttcgagatacctttaccgaacatgatgtcgaactcagcttccttgaacggaggtgcgaccttgttcttcacgaccttgatacgggtgcggtttccaatgacctctccctgctgcttaatagcctcaatacgtctgacatcaaggcggactgatgagtagaacttcagagcacgtccaccggtagtcgtctcagggtttccgaacatgacgccgatcttctcacggagctgattgataaatataacgatgcactgggtacggctgatcgcagcggtgagcttcctcagggcctgtgacataagtctggcctgaaggccaacgtgtgaatctcccatgtctccctcgatctcggccttcggtacaagagctgcaaccgagtcaacaactataatgtctacggcaccgcttctaaccatggtctccgtgatctcgagagcctgctcaccgctgtcaggctgtgatatataaaggttatcgatatctacgccgatgttcctcgcataaacaggatctaaggcgtgctcagcatcgataaatcccgcaattccgcctctcttctggacctcagctatacagtgcagcgcaaccgtagtcttaccagaagactcaggtccgtagatctctacgatcctgcccttcggaagacctccctgtccgagcgcaatgtcaagactgatagaacccgtaggaacagtctcgaccttcatcctgttcgactcgtctccaagtctcataatagaacctctcccgtactgcttctctatctgtgagatagcggcatcaagtgccttctccttatcgtcttttaaatcctttgcatctttagccatctgaattctccaatcgaaaaagtgtttgtatctggaataaataatagaacatactatctgttttgtcaagagcctgtctgcatatacagatagtagcaaaaaaataaatccggggcaatacagaccacccggatttaatttttatttaagtgaatttattttatgtttagttttataaactaaatattaacgatctggtggtcagccttttgaccaccagatcattagtattccatttgttcctgaccgaactcggcgagctgaaggccctcgtttctgttctttaccatgtcgatgctccactcattcacaaatagaaggagcggacggcctttgaggtccttaaccttcttcatgtctgaagttccgacgatcttgtcgacatcaatgtctttattttcaacccagcggacgtactcatacgggagattttccataatgatatcgactttgtactcatgctcaaggcggaacttaagtacatcaaactgcaggacgccgacgactccaacgatgatctcttccattcctgtgtggtactcctggaagatctggatcgcaccctcctgagctatctgcatgatacccttcataaactgcttacgcttcatagtatcgacctgacgaaccctgcagaaatgctcgggagcgaatgtcggtatgccttcgaatttaaagtgttccttcgaagtcgttatagtatcgccgatagaatagatccccgggtcaaaaataccgataatgtctcctgcataggcctcgtcgatcatttttctcgaggaagccatcatctgctgaggctgtgaaaggcggacatcttttccctcctgaacatgaaatgcgctcatgccggcagtaaattttccggagcagatacgcatgaatgcaactctgtcgcggtgggccttgttcatatttgcctgaatcttaaagacgaaagccgaaaaatcctcactgtacggatctataagaccgtggtcgctctttctcgggagcggcggagtcgtcatctttaaaaagtgtttgaggaacgtctctactccgaaattcgtaagagcagagccgaaaaatacaggtgtgagttttccggcatctaccgcttccttgtcgaaatcagctccggcaccatttaacagctctatctcgtcgagaagactgtccctcttatcctcaccgatagctttgacaagctccgggtcgtcgataggataatccttctcctcgccctctttcgtgcctttcatggtatcccagaaggtcatgacttttctggtctttctgtcgtaaacacccttgaactgctttccgcttccgataggccagtttacagggtaagtcgaaatgccaagagtattttcgatgtcgtccataagctcgaaagtatccatagcatcacggtccattttattgatgaatgtgaaaatggggatgtggcgcatgacgcagaccttgaagagttttctggtctggggctcaacgcccttcgcgccgtcgataaccatgacagcagagtcggctgccataagtgttctgtaagtatcctctgagaaatcctgatgtccgggagtgtcaaggatgtttatgcacatgccgccgtattcaaactggagtactgaactagtgactgagataccacgctgtttctctatctccatccagtccgaaactgcatgtctggctgtggcctttccctttacggatccggcctgatttatctgtccaccgtacagaagaaacttctctgtaagtgtagtcttaccagcatccgggtgcgagatgattgcaaatgttctcctctttgttatctcatcttttaatgtacccaaaataaaaacctcctgatcatgattccaaaactatattattatattggaaatcattggccaggtcaagcaccttaccggattcgatttcaacaactttcgggcgcataggataatcaggattatttgcgacgactttggcgatctttccattggaaagctctactaatgtatctacaggatagaggataacgctcttggagaagcactctaaggcctttaaatccaggtcatcgcccatcgcaagtacgatctccatcgcctcacgctgtccgtagggctccttgtatggccgctttgtgacaagagcatcgtaaatatctgcgacagcgataatcctcgcatagagcgggatcttctggcctttgatgcccatcggatagcccctgccggtcaatttctcatggtgcaaaagcaccccggcgagaatatcaggtgaaaattcgtccttttctttcaggatgtcatagccaagcttcgagtgggtcttcatgacctcaaactcttcatccgtaagctttcccggcttgtttaaaatctcactggggatcttcgactttcccatatcgtgcagaaggcccgctacgaggagctcatggagctggcccttattgaggccgtatttctttccgatgatagcagaaatcgtcgccacgtcgaccgaatgcttgaatgtgtactcatcgctggtctttaacgtgcggacatcaaaagcgatggaattatttgaaaggatgctcttcgtcagatcctctgcgatagaattcgtggcctctgcgaaatccctgctctccggagcattgaaaagataggccactccctggcccactctctcctttacactgtttgaaatgcttaccttgacagggtcgtccttgtggttatcctcgatggccttcttcgtggcttccggaataacgatatgctgctcgaggtcgtccgggactccctcgtaaatgtagattcccatgattcccctcttctggaggtattctatctggaaatcgtctaaatacgtgcccttttttatcatctcacggccggtggcgtcgcttatggtctggtcgatccgtgaacctgccgctactgtcctggtacttacaaatcttctcctgcccattttcacaccctgatgctttctcagcggaaacttttttttagaaaattagaaaaagcaaaaattacagctgtaaaaaataaaccacaccaaaatatattatacaataccttttaaaaatccacaacggaaatctttatgcacagggcaagtgtccatataaatacagcctcgcagatgcacaggaaatacccgctcgtatcacccgagatgccgccgaattccttttcgcagataatcctggataaaaaaagccacaggacgcttataagtgtagcagcgatcacaaagggctgcctgtttaaaaagctgatcgttatcacagcgaaaatgtagataaacatcatagtaagcacaaactgcctgctgcccttcgtatcgaagtgaataagcgaggtattgctgtcacgccttttaaaagtgcagacggcaattccggaaagtgccctcgatatcacgaacgcgtacaggatcgaagaaaaatatcctgaagacatcacctgacagattcccgaagtcacaaaaagcgtaagcacgataagctgtatcacgccgaacgcgccaatatgagaatccttcatgatgcggattttttcgctcctgtccctgtgcgagcagagcgcatccatcgtatccatgtagccatcgatatggaatccaccggtgtagattacgattatagcagaaagcacaagtgacgccggaagcgcgccaaaattaaatatggaaaaaaatttatagaccagatacatgactcccgaaaggcccgcgccgaccagcgggaagaacgcaaaagagttctcgtaatttttctggtcccactggaactgcggcatcgggattgccgaatacattgaaaaggctatcgccatacttctgaaaaaatccattaaaattttccttgaattctgatcttcagatcagtgaaaatgaaactgacatcctgtcgtttttgcagacaaggttcatcatcgcaccgtttatcatcgtaagtcgcggaaccgagtgaccgatatctgccctctcgatcaccggaataccggagagtgcaatgcttaaagcgtcatggtatgtcatcccggactctgatgactcaaaagcgctcctgccgaaaataaccgcatttgcgccctcgaaccagcccgcatatctgaactgaagaagcgtccggtaaagtgcctccgagctcagggaaaaattgtcaaaataccagataaatccgtcgtctctgtatcttttcaggaaatcgtgtgtgccgtcgaacttagtccctatcagatctttcaacacgtcgatacatcctccgatgcatctgccgcttgtagaaagcttttgaacagagcaggtcatatcagaatcactgtcgtattcgatcttatctgccataaaaggcatagtggacatgtactttggaaatcccgattctgtcagattctctccctttatcacagaaaggttcgtctttacaaagtcaggcacaggaaaattgccgtaggctccggcattcatgccgtaaagcgtcgcgacatcgtatttggtcgtatatggatagagaagtcctgtcggatcagaggctcccataagccatttgggatttactctcataaggtcaaagttcacatacggaagacattcatcgagaaaatctccgccagcggcgcacatcacaaagtcgaccttaagatccgaaaagagagaattaagctcctctcccctggtctttgcgtcggcacttctctggtcatttactctgacagaagggctctctttaatctgaaaaccttccgactcgagaaaaccaatcgacttctcaaaaccctctatatcatcgccgaccccggcgctcggcgccgcaattcctatcgtgcttccgttctgtaaaaattcagggtataccatatattctcctctaagttatttattcagcagaaactttttccgacaaagtctcgtctgaaagagtctcgttcatgctcccggtccgataaccggtaaggtccatagtcacataggtaaaaccgtatgactttaatgcctcggttatcttcttacggtttaaaagcaccttcttgagttcgctctcgtctacttctatacgcgcaagattttccccgtggattctgacacgtacctgatgaaatccgaggtctaagagaagctgctcggctttttccaccattccaagcttcgggaccgtaatctcttccccgtagacaaatctcgacgagaggcaggcaaagctctgcttgttccaggtaggaagagcaagctctttcgaaagctgtcgaatctcttttttgtagagcttcgcatggcgcagcgggctttttatcccaagctcagctacagccataaggcccggcctgtagtcgccattgtcgtccatatttgacccttcagcgacagctttaattccgtttttctctgaaagctcaaatatttctgtaaaaagctcatgtttgcacagatagcacctgttcgtcggattgtgtgaaaatcccggtatcataagttcctcggaatcgacgacaaaatgcctgatgccctcctttttgcagaagtcaagagcctcatcgagctctcttttgggaaatgaagctgatctcgcggtcacagctatacagttgtcacctaagacatcgtgcgccgtctttaaaagaaaagtcgaatccactccgcctgaaaaagctacggcaacggagcccaggcctctcagatattcttttagatcatcgtatttttcctgtgcagtcattctctgtcatcctttaattcgccggattcaaggtgcctgtcgaggatctccttcgttatctgatagagatcctttgaggcattctttgtaccatcctgccttccacggacctgaccatatgagacgccgtgttctacccagtcgcttccgccgttcgaatcgtttaaaagcagtggctggaggttgtccatcgccctcgcaaatctggcctccggggtctttttttcctgaaattcctcgaaaataccgcgcaggtcagcagcctggtcttcaggcagcagcgaaaaaatccggtcagcggccttctcctcccttgcttcctgcgtcttcttcccctcttcgtcgtaggcataggtgtcgccggcgtcgatctcaacaatgtcgtggataaggcacatgatcatagtccttgcgacgtcaattttttcatcggaatattcgcttaaaagataggtcataagagccatgtgccacgcatgctccgcgtcatcctcatttctgccgtggttcgtcagatgagtctggcggaaaaccgtcttctccttatcagcttcaagtataaaatccttctgtttttcaaatctttctctgtccatatacgctcctttaaaaatgcagatctaattgtaatcgactcttatccctgcgatgatttctgtcaccttaccccgctctgctaaaaatgtgtgaatcctgccaagctccctcatatattcctcggtaagaggatcgtaatctgttcccgattcaaaaatatcgtcggagactataataaggcgtttcgagcgtttcatcagaaattcaatgtcgcttacgactttttcgtatgcatcgtggcagactcctccgtcactaagaaacatcgcatctgcaagcaggttcggaaggtcttcgagcagcacgtcagatccttcagggattcctgcctttgaaaaatccccggtggattctattgtcgtaaatcccttgtccgctcttcttctgatgtgcctttcgatccgcctgatggctgacttatcccgcctcatagtcgcaagatatattttttccggggaatcggataacaggctctccgcgaagtcgctttttccgcttccgctccctccaaaaataagtcttatttcatccatgattcaaatattataacacaaaaacgccccatgccaatggcacagggtgttttgtaaaaaaatatatatccgggagtggacttattgattaagcagatgtaacacgtgtcgggcgatgctctccgaatgatctcccattctctcgaagtactttgctatcatcattatatctataccaggggatgcatcctttttcttgtcgccgcggattgcttcgatcaccgaagctttcacctcgtcgaaaagatcatcgacctcatcgtcataggctatgatctttctggcctgatcagaatctctgtttacaagcgattcgacactcttcgaaaccatatacgaagccgcgtcagccatcataaggatagggacctgggttttaagctgcgagtcagccacatacggaatgatctcggcaacgtcgtaggcatttacaccgatgcgctgcatatcgattatgacattgcttgcagtgtgtatcattcgaaggtcgcctgccaccggctgttcttttatgatcagactgtaacagagatcctcaatttcctgctgcttctttgcgatattttcggagactttcttaatctcctcaatgtccccctgcttctcgtcggctaaggcatcgacatcccggtgaatcgcgtccacacacatcttgcccatctcgacaagctcggagttcagctctttaagctctgcattaaaattatctctcatatcaattaacccttctggtcaaaaatcaaccgaatctgcctgtaatgtaatcttcagttctcttgtcagccggatgtgagaagatcttttcggtgttatcgtattcgataagctcaccgagaaggaaaaaggcggttctgtcggcaattcttgcggcctgctgcatattgtgcgttaccatgatgatcgtgtattttttcttaagctcgagaaggaggtcttcgatcttagaagttgatacaggatcaagtgctgacgttgactcgtcgagcagaagcacctcaggctttacagccagtgccctggcgatgcacagtctctgctgctggccgccgctcatgccgagagctgaagttttcagtctgtccttgcattcgtcccagatggcggcctgctttaaagaagtctctacaatctcgtcgagctctttcttcttgtggacgcccagaatcctcggaccatatgcaatattgtcatagatgctcattggaaaaggatttgccttctggaaaaccataccgacacggctccttaaaacattggcatctaagtttttgatgttctcacccctcaggcttatctctccctcaatccttacaccttcgatctggtcattcatcctgtttaaggtacggagaaaagtggattttccacaaccagaaggtcctatcagggctgtgatctgattctttggaacagccatatttatatccatcagtgcatggtgtttaccataccagagattaaggtctttagtttcaattacgctactcataaaatcaccctgtcttttttcagtaaagatcatttcttaagcttttttccaagaagctttgcgctgatatttatcacaaatgtgatgataagcagaattactgcgattgcaaaggcaacatcgaactgtcctctctctttcgcgtacatgtaaagagaaaccgtaagggtcgcgccggcatttcccggtgtgatacttttaagcggtgtaaggatctcgtttgccatgcctgctgtgtagagaagagctgccgactcaccgacgatacggccgattgaaagaatgatgcctgttacgataccatccattgcacttggaaggactactgtgcggaccatgtgccatctgccggcgccaagggccagagcaccttccctgtaactgtccgggaccgtctttaaagcttcctgagtagtacggataatgatcggaagtgtcattactgcgagagtcagggcacctgcaaggatcgaagttcccatattcattgcctgaacaaagatcagcataccagcgagaccgtagatgatagaaggaataccacttaaggtctctgtcgcaagctcgatcacacggacgagttttttattcgtagcatactcgttcagataaactgccgtgccgaccccgatagggagtgcaaataccagagctattataatgatatacagtgtatttaaaatattaggaagtataccgatgttgtcggtcagaagtgatggagtcgtcgaaaggagattccaggtcacatgaggtacacctctgaaaaaaatataaccgatgatccccacgaggagcactgtcgtaagtgctgccgcaaaatacatgagtcctttaagggcgccgatctttgcctttctctttgctgaaatccctgcctttgcggtaaggatagcgtcgcttgtgttagtccctgaaatatccatcatttaacctctcctttcgaagtgagctttctaagcaccacattgatcattattatgaagaagaaaagtaccagtgctattgagaagagtgcctgcctctgaagtcctgaagagtaagacatctcacttgctacggctgtagtaaggaatcttacgctcttgaaaattcccggcatgttggcaacatttcctgctaccatcattactgccatcgcctcacctatagcacgtcctgtgcccaggattacagaggtaagaactccgctccgtgctgccggaagagacaccttaaagactgtttcagtataggtggcgcccagtgccagcgaaccttcctcgtactcctttggaaccgctctaagtgctgtctcagactctgagatgatcgaaggaaggaccataatagcaagaactactgtggctgaaaagaggtttgctccatcagggagattgaaaagtttcctgacgctcgggactatgattatcataccgaagagaccatagactactgaaggaattgcagccagcagatcaactgcctcacggactgcagcagccaccggtcctggcgccatctttgccagatataccgcacagaagatgcccaccggaacactcaccaggagagctccacatgtaccataaactgatgtaagtatgaacggaaggattccaaaggacggttttgcagctgtcgacgcccatttagttccgaacatgaacttgaagaagccgatctttgtgattgccggaacacctgagataatcaggaaaatcgagataaaaattacgaaagctattgaaaacattccgaagatcaggaatatcgtcttaaaaatattctcgacgctcttctgtttcttcagccttgatttttgtaaagtcactgtaccgtccattgttgttgcctccctggataaatttacttgtgaaatcctccccggtcaattcttttagttcttggaaacagctcctgcctttgaaatatactgtcctgcctctgagccagtgcagtaatcgaagaaagcctgagccggtgcacttaacttcttgccatcttttgtgatcaggttgaagttacgctggatcttgtaagaaccatcctttacagtgttttcagaaggtgctactccgccgaccttgatagcttttacagagttgtttaaatctgcaagtgaagcatagccgatagcgttagggttgcttgctacagtctggatgacatcacctgttgaagtgagctcctgagcgtacttgcacttctcttttgtattggtgatcgtctcgaagccgtcacgtgttcctgatgcagcctcacgtccgattacaacgatctgtccatctgagccgccaacgtctttccagttcttggtctctcctgtgtagatctttgaaatctggtcgatcgagaggtcctttacattgttcttcggatttatgatcattgcgataccgtcgattgcgatcgtagtctgagtaaggcctgtcttcttctcgtcgtctgtaaggtcacggcttgcaagtccgatgtcgcagcttcccttgccgactgcttcgatacctgagcctgatcctgtagggttgtaagtaacctttactcctgaattcttctgcatgaaagcttcgcttaagtagccgataactttctccatggaagtcgagccatcagttgcaactgttcccgaaagtgatccagatgaagctgagcttccagatgctgaagcagacgatgcagtcgcagttttttcgctgcttcccgatgtagccttctgtgtgcttccgcagccagtcataagtgtcatagctgccattgctgaacagagaataagtgataagatctttttcttcattttttactcctttgtttttagcttatcaaaatatttttcccttgctacgcatattatgttagaccagccaggtaacaaaaaaataacggaggcgttaagcctccgttaagatttgtaaatctaatgtaaattgtacttccaaatgtaaaatttattttatttgtcaaaccggaccgtgatcgtcgttcctacatccactttggatgaaagagagatctttgcattgtgaagctgagccgcgtgctttacgattgaaagaccgagtcccgtgccgccagtctccttcgagtggctcttgtcgacgcggtagaatctctcgaaaatcctcttctgcgcgtcctccggaattccgattccggtatcttttacagtgataaaaggatttccgtcgtcggatacttcagtcgttaccgtgacctttccgcctggtttgttgtatttgatggcgttctcaatgatgttgtggatcatctcatccagtatctgcctgtagcctgtcacaaccgcggactttccgactaaaagcactgacacttcgtactcaccggcctttccggaaagcctctttatgatctcatccgccatctcatacaggtcgcactgctctttgtcgattccgatcttgccctcgtcgagcctcgagagcttaatgatatcctgcacaaggtttaaaagccgctgcgcctcattgtagatacgatttgaaaaatccgggatatcctttttctttacgattccatctcttatgatctcggcatatcctgaaatcgaggtgagcggagtcttaagctcatgcgaaacattcgcggaaaattcctgtctcattgccgacatcgcagccttctgcttgttcgactcgtcaattcttttaagcagcggagtaagttcctcgtagacatcgttttctaaaggcttgtcgagattcaggctgtttacaggttctacgaggtctcttgcagtcttgtgtgaaagccagtatgaaaagaacagaagcgccaccgcagagatgattatcactggcagaagttcaaggatcgtcgcaaagatcgactttacggaaaccgcgacacgaaggacctgcccattatcaaggcgcaccgccgaatagtacatgtcctcctgaagcgtatcggaatgcctcttgtccattcctcttccatatttaaaagcggctgcgatttcaggcctcttcttgtgattttcaagtgagtggctgtcctccttcgagtcataaagcactgaaccatccttatcaataagcgtgatccttgtgcccggctccagatttttaagcagcttcaaaaaagacgagccgtttgtatttaccgcctcagccaggtaattcgactcgtacctgacatttttttcagagaggtgttcaatacttctgtatacgaaaaaaatggtgacagcatacgctatcaaaagcgccagtgctatcacctgtatcatccgtgtctgtatcttcttctgcatatcacttttccttgatcctgtatcctactccacgaacggtctcgatgcggttcccggcttttccgagcttctgccttagcgacctcacatgcacatcgacagtccttgtctcgccgtcgaagttgtatccccagatctcctcgagaagctgctcacgcgtaagtactatcccgctgtttaaaataagcatcttcaaaagctcgaattccttcaatgtgaggactacttccttaccattcactgtgacggcgtggcggagaacatcgatctttatagaacctgagcttatcaccggctcatccgtgttcttcccgcggccagatctcctcaaaactgccttgatcctagaaaccagctccatcattccaaacggtttcgtcacatagtcgtccgctcccatgtcgagtgccgagaccttatcgtactctgctcccttcgcagtcagcatgatcaccggaatgttcttcgtcttcggatctttcctgatatccgaaagcagctccatcccatcctctcccggcagcatgatatctaaaagtataagctccggcagctcgttcttaagcgcagtcttaaactctactcctcccgggaatcccttcgccggaagcccggtcgaatccagggtgtagacgaccagctctctgatattgtcatcatcctctacaatgtagatcatggacttctcctttcacactacctataataaagggcccttgtaaattgtacaagagccctcatgtaaaatcaatgtaaaatttgtgttacagtgggacagtggggacggttctttttgtcccacttttttcagtatagagcctggcggggcgaaatttctacaatggctcgcttttagtttcaatatgtatctgggtagaagcaaaaaacttaaaaggctttcgatctttctcaatatgaatgcgattttgtgtaaaaaaataaacccctggattcacactttcaatgtatgtccaggactaaactattttatacaatgtatttattatttctggctccgtataagcttatattgaaaccgtcaatcatgcggagccggaaatatttcgcccgaagtaggcatcgggaaattcgacggaaatatgcctctgatcgcctccatcgcctcaggcaaaagctacaaaggctacaccgtgtatcaggttccaaaaaactggaagacattaaaaatatcctacagagattcgataacaggaaagaccagcagcgctttttcgatcaagtcgacggagatcaagtgaactaattcaatgcaaataacttactaagctcatcctccagtgttccctctttagcaaactccagcgtatcgcagagcttgatattgtgcttttcgatcctgatcttatcgctgaatccaaggatgtagcgcaggcagatcctgtagatgatctcagtcggcgcgcagccgtagacctgctttgcaaaaatgtgattcaggcgctctgtgtcatccgggaagagggccttcatgcgcctgctcaagaagaggcgttttacgatctctgtgatgtacattccggatttcatgtagaggtctgcaaatgtggcatcgggatcgtcgaagcagcccgggttctctttttcaagcatgtcgaccatttctttaacaaccttcttcggcgtaaagatctggttcgttctctgcggtggaatgtaattgaaaatatcctcgtcgtgttcgccgctgaaataatccgataagtctctgcgctttttcataaactcctgaacagcgtcgttaaacactacctcatcaaataagtgaccgtcgaaatgttttgttactggatttccattgtcatcaagcacagcatttccattgtcatcttttacctggtaatcgccgccgtcgcgcagcattctgaactgctcgagcgttacgccgactccgttctgaggatttacagtgacttcccagaagacattttcagggacaagagaatcgaagttttcaagcgtcgtgccctcgtcgccataggccataagaaatgccggaatcgtgcgcgaaaagccacggagatggtcgcggacccttccttcgatcgaatccttctcggcattgagcttctcggtctcgacagtatttacgatcttctcggctgcatttctggcagtctcttcgctgttcagcttcttatggatgttctctaacatctgctgatagctctgctgcctgcgcttttcgaattcttcatcaatacttgaaatctcagccattgaggctccggactttttagcctttttaatctcatcatcacgcttctttttaagctggttgtcatggatcgtataatcaccatattcgcggttaacaacattctccgtagttgcctgaatatcgcgttttagctgattctgagtcgacttctttaactcatctccgtactgctttgtcgccgtctccataagagtgtcggcgattggttctgaaaatttttcacggagagattcgagttcgtctttcttcgggtcaggatgtctggcatgttcttcggtaagatccgagacagcctgtgccagcttttcatcaacgtcgccatacactttttcgccgaacaggtcactggccaggccaatggtcttctcggttggaatatcgactttgccatcttcgtttaaatgaaggtcatcggcagtgttttcatccacacccacatccgagagtttcttcggctgctcgagcggctgcatatcgtttatcagcttgattatctccttcggcgcgccgaaaataccggaaatatttgcaaagaggaaatttgacatgaagccacggtccacgacttccttcgcatggatatgacgcggtatcgtaaggactgattcagcgtcgagctccaccatctccccgccatcgtcttcaccatagacagggaagaaattgaggagctgccttacgttattcctgcgctggtccatctcacccttatcaccggaagtctccgggatcaggtcatttgcaaatttttcaaaaatagtgagagttctcgccggatcaaagtcaaaaatataggcatttttctttcgataagagttgccatccctatcatgaaaaaggcacggattctgggcgcggaaagccgcctgcatatagagcgccgggctcttcatatttgaaagcataagcactgccgtccactccggaattgtcacaccggtagtcagctggcctacggacagggttatcgtcttatcgtaattttcaatagcctcgactactttgtcataggatttcctgttctcgtcatcgtcgtcgagcctcccgtcgcctgctgcaagaatgatatgataatccttgaacaccggatgaatacttaatttcttgtataaggcctttgcactcgcgacacggtttaaaatccagaatgtgtgctttaactcatcccgaagctccggcgttgagaacggaaatttctcctgagtcgtaagagcatcgagaaatttgtctacatccttgtcgtggacaaatctgccagactcattcgtcttgaaaaattcgttcagatcgaaggcatactcctcgacatcatcatccgcgagctcaatgccctgccttaccttgtcacggatgatctccgacatctgatatgtaaaaagtgagagtctcggcagattctcatacggattttcaatctcgctcgaatcgtcccagtcgcgttttttcttctgttcgtcggcatatgtccagttgtaaatagcctcctggggaaatttgtcattggccagagccttgaacggtgtacctgaaagatgcagagtacatttgcggttgatatggttaaacgcggtgtcagtcttataagtgtctacaccttcatgagcttcatcgatgatcaggacatcccaattcaatccatgctcggcactgacttccacaagcttatcgtacctgccgccgaaatagatcgagcccttcagatcctgaaggctgacaaattcaatgcagcctttgacctcgccttcatcggacgatacaacttttttcatgtactcatcacggctcaggacatattttctgtccctgatgccatctgcattgcttacgaaaaaatagccggactgcggcccgaagaatgtctcatagtcctgataccatgaatttgcgatcgccggccggttcgtaacgataagaatatttgtcgcctgaaggcgcctgcagagatcgtatgccgaaagtgtcttgccaaaacgtggcttgcagttccagagatattctccatctttatgagacttgaaataatcgtaagccctctgcactgcatcttcctgctcgtcgcgaagcttataggggatcaccgcatccgcatcgtcatccgaaacgactccatgattctgcgtaaaatccatgaaatctgcacgggcggtatccggtgctatctgaaaccactcggtcccctcctcgcgcggaatgccaagcttcttcagatacgcgtgaaaatttttgtcagtgaaagtaccaaacggttctgtcataaatacagcccgcatatgccaccatgtcttatgctctacgccaactgtatgagtctgctcatttatacgggtctcaacatcccgctccgtaaatccgatcttggtccagccatcgtgcttcggcacacccggagtcgtatacgcatagcactgagggataaccttggtggctgtcttaatattgatcttcgccattatgccatctcctttacatgcgtctcaataaaattgatctcgttttcgtcaagaccgtactttctatagagctgaaggtcaatctcgtgaatggatttggaccagtcgatgtcggactggttggtaaaattctggagagggacatatttccacacagattttgcagtatgttgtgttgctttttttacacctagcattgctctgcaaaacttagtctttaaatattttttggcattctcagactctgataaagagtcaaagaatcctatacttataaaagtatcagtggctccttcagcaggactcgctacttgaggttcaacaagagtttcaccaaatttgccagtattatttgcctcagaaataaggacattatatgtataaatataaccgttatctattaaatattttgcatttataaatttgattgttcttctatttttttctctcccaattatttttacatatttgtcatcattaggttttgtattataaaatgcttctggaactttttcaaaaatattagaaacaaccatatttcctgttccttttcctactttcgaagcagcatctgggaaatcagaaaaaaagttatcatttagtctatagcatcctcttgcagatactatagagtcgatagacttagctccagattttataactttagatagaatagagtttagttcttcaaattttgtaaaaaccttaattggagaataatccgaatcaaaattatgatatgttactgctactccacctttaatgtctgtattaggaaatacttttgttgcatcagcttcatatttcaaaactttaaaatgcgaatcatcaagcattttacggttccagtcctttggtgtctgacctgcatcaaaaagaaatcgagctggagtaattaattctaccttatcagctacacaatacgctccatccataaaactgttataaacaggtctttttcttgttgattcagttgtatcttcctgatacggcggatttcctatcacatagtcaaacaattttttttcgctcatattagccctccttcagctccgtaaacaggagcgactcattacttctccaattaaatatcctgcacggtattgctgcttgctgcggctcttctttctgatcggcgctcgtctcgaaaaatgacatctgatggaactcttcaaatggcttgccaagtgggacggtatctttaagaccgtccatctgccagatgttccaggcaattttatttgcgagatggcggagcagttttttatcgggatcttcgccacagcgttctctgtaatagtccacaaatgtcagcagcagatttattctcgctatcaggagattgtcgccctgatattcatatccgtatgaagcctcgaatgcccggatcgtccacttgagccaatcgtcataatctgaagtattttcatttacgatgcgaagcttccgatccagctgtccgatccggtgcttcggcggaacgatcagcccgccagtcgaaacgtcatatcgcgaaaccaggtacggcgcctcgccacaggtgatctcaagtctgcgggaatctacgtattgcttccagttttttttatcaggaaactctatgctgccatcgacggtcgtccaggtatgatcttcattttcaatattgaagacattttttcttccaaaccattcctcatcgcagtagttgttcatctggttgcagagccaggccggagtaaagacttcggccttttttcttgtgcgggccgcctgcgcctcctgcgattttaaaatacgcggtttgataatatccgaatgcaccagcagcagatctttctctatctgctctctgtcactgaatccatggccgaacccggcataggtgtccgtcgcccagataatattcttccctgttgacttatccttcaggagcagatcgagtagctgtacaaccggagcacttccaatatctatcagcttacacataaggataagtaccccttctatatctaatttctggttataaaaatattttatcacaacgggcagctattatcgataagcaatttcttgttaaataatagaaattttccttttgttaaacattatgaagaaaagtactgtgggcattttcctatctgggttactgctgaactgatgacgtttagtaatctttttcaactatataaaatcatgaaagtcaatgatcgtgacagaatagcctcttattttgccactgaacaatacatattaaagacatggattgctgcccttgttgaagaaggatgggagaaattactatcctaaatactaaatgtctacaatgaaacttgttgacaaaattcattcaagtaggtattataataatattcaaaaattattatttcccatcgacactgcgatcccgatcatttcttccggtgtctcacgcatatcgtacgaaaaccagaggagcaggcaggcatagattccgccgatgcggtacgccgtgcggtaattgttcatattttgagcgccataatctgtgctgtcagaagcatcactagaatcatcccgcgcctcactcgcatggaagtattcccgcagcgcgtcgagaagcacgggcgagaagccagcacggtttaaggaaagcatctgctcgcggttgtcatatatggcctggaaggccgggcggatgaatgtggcgaagtccgtgttgccaaggctcagcagttgataaaagcgacaccagtcgctattattaatatggttatattttaaatcatattcaaattttatcaagaggtatcaagatgaagacattttttattcttttggtgattgccctggcagcgagcgcctgcggtttcaaaaaatacgtgtggttcatttcactgggctatggttttgcgatcgcagccgttggcgccggctcgctgatcatttttcacggaaacctgaccacaggggccgtgattcagtgcgcgctactcatcatctacggcatccgtttgtccggatatctggtctaccgcgacgtgaaaaccgcctacaatcgccgcatgaaaggcgaagtcaagaccaacgatgaagtttcctttggtgtcaaatttgcgatctggatctccgttgctctcctctacgtctttcagacttctcctgcctggttcaggcttatggacaaccgcggaactgacgcgttctgcgtcgccggcgtgataatctccgctttcggcattatttttgaagcgaccgccgacctccagaaaaacagcgccaagaaaaaaaatcccggccagttcgttagttccgggcttttcagcttcgtgcgctgcccgaactacctcggcgaaatgataaattggacgggtgtttttatttctggtctcagcatttatcataacgccaccgagtggatctgcgctgtgatcggttacgtcggcatcatttacgtaatgttcagcggcgcccgccgcctcgagatccgccaggacaaaaactacggaagcgacccgaattaccagcactataagtccacgactccgatcatggtcccattcattcctatccttcctataatgtcaagccccaaattacgatttttagggattcctttgacaggttaccctcaaaataagagtcaacggtgatggatatcgttgcatcaagtgctgatagtcgatttttgggtatggttcgcaaaacgtcccacatgtcctttgttatcaaggccattttccctcagatcaactatggcagtgaacctctcgtggctatggggatctgtgtcccaacctccttcgtcccacctatccatacaccgagtgccagccaagctttcttacgagttcatgcctcacggagtgaatcctgctggctacggctcctatttgttcttgaatctctactgctaggacattcctgtgacagtcctgatttactcagtggacgctcaactgccacacctgatccaatagtaggtgctgatgataccgaagcatcatcgtttacaggttccttgttccagaacctggcccagcatccgtgttaccagatgttcggcaaggctctggaaatgtatacaatgattttttcggtttgagttatgctgcctttgttctggaagtctctggataatgtatatcactgagcattctcatcgaatcatacttacgtcctgtcgcaggagcgtatatacgaccctgagcagcttgcaggctatcacgatcaacgactgcatcttctttaacgggttctccgctcgtgtcgtgtagtgctcgtgaggctcttaaacgcctctgaatgaactactacagattttgctccttggaacagccatgtctcagtttcttgcgtcctctgtgactgatcttgtctgtccctatgttttcctgagctgcattctacaagcccgagccgctgatcttctggatctccttcacatcatcgaacctggagatgtctcccatttctgcaatgatgcctgacagaatgttctccccaaggccttcgatttcaagaacattttcaacgttcgggatctcatggcacttctggtgaagctcgtcctcaatcttgctgagttccttctgtatttctgttatctgctgtgtgaaccatctcaccgcctcctttgcagccttgtctccgtccttaagaccgacgctgttttcggcatagctgacaatccgctcagcgtttctgtatcctgcgccacggagcttcgccttatgccacagttcttttattccctcagttcccagcctgattatatccgcaggaaatggcgcgttcatcagaacttcaagggtaaatgctccgtccatttttccgaatgcatccttatactcggaaaaataaccttgagctgcttatgaagtctgtttactgcctgtatcctgccttccataagctgatcgcggagagaagaaagacctcttatctctgcgtatacccttcaggtatatatggattccgaaattccccgtctttcaccaggttcgctataggcttcggatccttgcggtcgtccttcctggctgttgtcctcaatctcctttgtctgcttcactgcatagggatttacctggacaacgctgataccatgagatatcatccaacacgctatacagaaccagtaatgacctgttggctcaagtcccatcacaatctggtctttattattatggcagccagttcgagcatccatctcctggcactctcaaagccttccttgctgttacggaaagaaaacggttctttgctcagctcgcgtcctctggtatcttagctctcacataatagttccactacctatatcgcatccaactataagcatgttttcacttatgaatgagagcttgtcattcttatcgaacttccctgagtctccagttccttccactgaagccttgaattttccttgatgacagtaattctcttttcgatttcctccattgaaaacacattttttgctgtgctgttgataagtgcttgattttctattcttttctgtttacaattcatcgtagatacctcttgttcttttgaattttactaacgtccaggtcagtaatgattcatctacttgaggtattttttatgtcaaccccctgacactttatattatacaggaggctctctactccgtaaaaaaacacaaatggctcgtcgcctgaacaggtagcaaatgaacaaaaaaaatttttataattctgctgattcagtcaagcagtgcggctcggctccggttccggagggctttactcttgggatggccatattagatttcatcccggtgatattttttataataagctcatttgtcatcgccatgcgctttgagagcgtccttttcaggattggcgtatttttcgtaattctagccggaattctgaaagtcctctggaaatttattatcgtgctcgcccacaaaaatatccgttttttcaaccgccagatgcgctacctgatgccgaccggtttcctgctcgctttcattgcgctcttcgttgataaaaaccgctggtccttcccttccgtcctgcatttcataataaccccaccgtccctgatttttttcatcgccggtgcgtgcggcatcgccactctcgcgtggtacgcccgccatctgaatggcaacgacgcgaaggcgaactggaaagaacaggcgataaacagcgccacgcaattcttaataatgctcggaatcctgttgtaaaaaggcttccggctccgcgtaagcctatattgaaaacttcccgctccgcggagccgcctgcctcaatcatccgcattgaagtccgtgatgatctggtttttcttcagtctctttgccttgtacatgtagctgtcggcccttgacagaatggatgagatatcatcgccctctctgacgcaggtgatgccgatggctgtctggcacatgatatctgcgccgttgacggcgactttggagctgttggcgagttcatggaatctggcggccgcttttttgatgtcttccttttttttaagctcgagaagacctacaaactcatcaccaccccagcggcagaatttttcattgcgacggctgtatttccgaagggaaaggccgaggtcgtttaagatgctgtcgccagtgttgtggccgtaagtgttgttaatgtcgtggaagttgtcgatgtcggcaaagaggacagcaaagaggttgccggttctctcgaaaaccgtaaacgccccttccagacattcttccatatacttcctaccaggaagaccggtaatagcgtctctcgtcgcagtctcgtagatgctttgaacaagctccctgctgtaagtctcttcggccagcggtgaaaagacattaataagttcaagaacttttccgctccggtctttaagcgggattacagagttccgaaccagaaggcttccaccgtccttcttgttcataaacatattgatagagtcaggcctgcctgtcgtgaagcttacaacggccggacagttgctgtaggaaatctggcagccattcgtatagtggcagccaaaagccgattcgaagcattttttcccgagcatatcagaagcagagaagccgaggagcttttccgtttccctgttccagtaaacgatcgtgtgatcagggcgcatgataaagcacgcgataggcgcctcgtctataagagactggataaggcggtttgttttctcaagttcttcggtattttcgcccgaaatccacgagtcattatcaaagtcaaagagccttgcgaccagattgtcgcggagcttcaagagctttaaaacatcatctgtgtagaaaattttggtcttggcgtaaaaagataccggatggtctgcgacctgatggatcgtgttgatcgagtcgcggatcttctgctctttcgcatcgaattcagcagtcgaggcataggacgacattataacaaaccgcccgagaccgatgtaagtaaacgaagccgaatttccgatgactttcgtaatagcttttatacaggcactgaccgcagcgtacattgtacttttgccatagttctcagagatcagagaaatatccgaaatctgtatggaaataacgccgaatttgcgcttattcagctggtaatctgaatcaaattcagtcagatcctccagaaattcagaaaccgtctctatcctgcgcgagtcgcttgaaccggaatcaaccgcatcgtctctcaaaagcttctggaaataagctttatctataaaatagcccatcaggccggaaatctgcgtgccatcataggtaggccatttcgtcgcaaaaatgtcccgcgccacgccattcgaaatgcatctccccttgacattatcctcgataacgccgtttgtaaggacatcttcctctgcatccctgtaggtgtcgttatttgtgtgccactgcagatcctcgtccgtttttccaatgatctcattcacatcggaataaccgtaatagtcgaggaatgactggttcgcgccaaggaacctgcgctccttgtccttccagaaaattggccgcggatcgtgacgcatgatttcgtcaaagagattcgcctttctttgaacttcctggctggtaaccggtttttctctctcctgatgcggaatcccgctcctctcatccgccggacggaccacatagaaggcatgcttcccgtccgaattcggcgcgagcagaatcttgtgcgtcatccagacatatctgccattcatatagatcgtgcggaattcatccaccaggaaaccattcggtgcatttttgagacggtccttaagtgtcgccggattcaggaattttttaaatctcttcctgtcatctataaaaataagctgaagaaggagcttgtctccctcacccgatccggtgatcggaagcacgccattattttctgcactgctgccggattccccgtataatcgcagattccggatggtcatatctttcagatcaatactgaaaaaattcctgtaaaaatatgagagattctgcataaattcaaatttctcaggatatttttcatgaaaagatttaagctcgacagctctgatgatgaaaatactcgtcccttcaaaactgccgattgccttgatcttcatcatccgctggtggccattaaaacgggcaagcacgtctcccgactgccccgacgtcagcacatatgtcatctcggacatcagttcctggcttgctagattgttcttatcattgacatttttttcaagctcgataaggtcagaaaaaccgtcgtcctttatcagtttcatggctctgtcattcacatagatgatatgacttgtaccgtttttcacctctgcgatcgtaaggggagatgactgaaaatcgacttttccaagcttgtcatacaggactctgtgctttgtactctcaatgccgagaccttttttaacacagcttttaattgtgtcattgaaaggctgcggttttccaaagtaataaccctgcattttttcacagcctgagttgatcagaaataccgactgctccttagtctcaacgccttccgcaagcgtgcggattccgatctttttgtccatcgagataacggaagcgacgatatcaagtgccctcttcgacccgctcctcataaataccatgtcaagcttcagcagatcgaagttatagtctttaaggagattaagcgtagaatacccgctgccaaaatcatccatccagagctcatatccggcttcgcggaatttatcaagtgtgtccaggacaccgctctcattcgaagtcaggatgctctccgtcacctcaatatccagaagacgcctcggtatatcatacttctggacaagtgtttcaatctccttgaacatatcgcagcacgggaaatctgctttcgataaattgatagaaatcggaatctccggctcgtgatttctgcagcgctcagcaatccctgaaacgacctgacggatcacgcagagatccagtttgtatataagccttgcatcctcaagcgaattgataaatgtggccggcggcatcagcccccgctcgggatcattccacctggccagcgcctccatcccgcacacttcattcgaaatcgtcctcacgattggctgataaaagacctgaatccacccctgatcaacagcctcatcaatatgcccgatcacatattcactctcctgctttctctctatattctccaccataaaaccttacccttttatatccaggaaaataatcaaacaaaatcccactcatgttgaaaatcgcaaaaatcgtttgtcacttttaatttcctccccgactcatgttgaaaatttatcgaaagcctctgtcccgattcgctaggaaatcgttctatgttgataatccgcgtttccgcggagccgggatatgatgcttctgacagaccgcgatatttgcatcaaatatcaggatctctcctgtcctatctcactatcaaagaaaaaacatctgactgttcagataaactgcttcgcaaaattcttcgcatcttcaagctgtccggcgctcggcgtgttcttcacataaaaataatcttcagccacatctatgcccctggctttcaggccattttttataagatctactgaatgctttgaaatccaggaagttgaaaatacgacggccttcctgaccttcgtaccgtcgagattttcgatgtaatttttcaggtgcttgtcaatcccgtaagcgtacagcgcaccgccaatgaaaagtacatccacatcatcattcgtccatgcctccggcgcatcgacagaaaccgccttcaccccacaggcctcagcaatcgcctcagcgaccatctttgtatttccagaccttgaaaaataacgaactaaaatattcataaggagcctccctttatttaatttaaagtatttactgctatttattagtaaatggtaaataacccgtcaccttccttgttccggatctctttgttagaataactttaaaaactcagaaaaccttttctcagtttttcaagttatcaaacattttcacgggaggtacaggcaggatgttaatccaaacgaagtgtaaaacaggttcgcctcaaagattggtcaaacataattcaggagcgaaatcaaagtggtgacgattgatgagttctgcaaaaagaatggctacactagaaatcagtactactattatctgcgcaaactcaggaggaaagtcatcgaagactcaggctttgttgagctgcctcaggttcaatcacaggccactgccgtctctgaaccggatatcataaaaaagtctgatatttaagcggcagttcaatctcagatgatcatcagaacaggaaactgagatttgcataaacgagtctactcctaagtctctgatagctgaagtccttgagggattgaaagatgctgagtgacgctaaaggttttacgcacatctatctctgctgcaactataatgacatgagaaagggcattgatggcctcataaaactgtcaccaatactttcggacttgatccggctgagcctggttccatcttcctgttctgtggtcgccgttcagaccgaatgaaagctcttctttatgaaggcaacggggctcatgggttataagcgttttactaatggaaagctgcaatggcccgtactccagccgaagcaaaagtgatctcgcagcgacagtacgagtggcttatggagggactgaatatcgatcagaaaaaagttatttcagatgctcctccagggatttactgaacaggatcttactatatttatgcacctgaaaacatacatatcaaggtgcctgaagcgctgtatttatgcggacttcaggctctttttgtgataaaatatatagtatgaacggaccagagatcacgactcagaactgaataatctcccaaaggaaacgatcatttttcgtaaatggtagataacccgtcaccttcaaaaaaaattcttgacgcgttactattaaactttgaccttcttcaggttccctaagtttcaaaaattagccctttcgggctggtttattcttgcttattttttctttcggcagatctccggtattgatttcgaccacggcatgagtttttcaagttcatcgcctggaaccttttctctcggatacttgatcagttctgagatcaggtatcatgtattgtaaggcttcaggccgttcgcttttgctgtctctgctatgctgtagtagagtgcgcttgcgaagtccattgactgggtctatgatgtgccagttgtgctttcctacgcgaaattccggatgctgcgtttgcatgttgttgtcaagtggaacttccggatgatcaaggaaggtcttcaggtagtattcctgattcttggcatagttcaatgcagcgcgaagcttcgtactcgatatcgttttgctgtcaaatgtttttacccacgcaaagaagtcctctacgagtgggcctgatgtttcctgccggttctttagccttccctcatcagaagattcttgaacttattgtcgaggtggtaaaactgatcgatccgctttactgcctcggcggctatctcttgtgccggtgtcagttctcgcctttctttgcagcctttacgatttctgcaaacttcgtctgacgtggctgtaacaccggtactgtgtatcatgctgtttttcatgatggtgtgatacggctgatatccgtccgttaccaggatccttgtagcctcaaggtaatctgtattacctcaccattcctcgctcccagatattcataaagatatatcggaggacctccgccttttcccggagaatgaagcacccacatgtactgctttgattctttggcattacgaatggtgtctcatcacagtggagcagcttcgatttcatcagctgcttcttcatcgtcagatgaacaggtttcagataatacctgtagactgatatgaaccatccggccatgtcctgccggtcaagaatgacatcataccttctgatctcctcagagaggcgggttcagtgggatggcattccatacttcatgttgaagatcatggcaaaaagccctggagtgagtatgctgtgagacagaattcttgcaggatgatctgcccttatcacactgtctccatcatggttcccaccgtatacctttacatgtgctcaaggatcttaatcttgctggtatgcattgcagccactgtaacgtcttcggtgagctctgccatccgtgcggaaatgcagcatcaagcttcttttgagcattcgtgtatgactatctcccgctcgacaccacttagatttttctttctctttcccttcttacgggtatgctctttgactttgacaacttcatctatgtctttttcaggaggaacaccgttttcagtgagagattcaggctcgtttaaaatgttattaaagagatcggacatagacatctgtccttcaatctgatttctgtttcagacttttgccaaaacggttctgggtaaggatatcgatattgctcggtaagatcttcgatctgcttaacaagcttttcattctgtgccagaattaggtcatttgcgctcagctggcgatacgcttcacgcagctgaaggaacagaaaaatgatcgtttcctttgggagattattcagttctgagtctgtgatctctggtccgttcatactatatattttatcacaaaaagagcctgaagtccgcataaatacagcgcttcaggcaccttgatatgtatgttttcaggtgcataaatatagtaagatcctgttcagtaaatccctggaggagcatctgaaaaactttttctgatcgatattcagtcccctcataagccactctactgtcgtgcgagatcactttgcttcggctggagtacggggccattgcagcttccattagtaaaacgcttataacacatgagccagccgttgccttcataaagaagagctttcattcggtctgaacggcgaccacagaacaggaagatggaaccaggctctgccggatcaagtccgaaagtattggtgacagtttttagaggccatcaatgccctttctcatgtcagtatagttgcagcagagatagatgtgcgtaaaacttagcgtcactcagatcttcaatacctcaaggacttcagctatcagagaattaggaggagactcgtttatgcagatctcagagtttcctgttctgatgatcatctgagtattgaacttgccgcttaaatgatcagacttttttatgatatccggttcagagacggcagtggcctgtgattgaaccgaggcagctcaacaaagctgagtcttcgatgactttcctcctgagtttgcgcagataatagtagtactgatttctagtgtagccattctttttgcagaactcatcatcgtcaaaccactttgattcgctcctgctttgaggcgaacctgttttacaacttcgtttggattaacatccatgcctgtacctcccgtgaaaatgtttgataacttgaaaaactgagaaaaggttttctgagtttttcaagttattctaacaaagagatccggaacaaggaaggtgacgggttatttaccatttactccctttatttaatttaaagtatttactgctatttattataaacgattctctatgaattttcagcaaacaatatgtaaaatatgcatcaaaaaagacacctgatatattttgatccatcaggtgcccttccgtcaaaaaatcacaattctgttattttttcttgctcttcttggatgatttattacttttatcttttgatgactttttagctttactcttagtggaagatttcttggctttagctttactcttagtggaagatttcttggctttagctttactcttagtggaagacttcttggccttggctttactcttagtggaagatttcttggttttagctttactcttagtggaagatttcttggttttagctttactcttagtggaagacttcttagatttagctttactcttagtggaagatttcttggctttactcttagtggaagacttcttagatttagctttactcttagtggaagatttcttggctttactcttagtggctttctttgccgatgtggtctttgttacgacgcctttcttatttactgtatatttcgtctttcctactgttacggtcgtattcgtgtagactgtgccgtctttcttagtgatatacctgctctttccgacagtaacaactttcttcttagaaactgtgtttccattcttatcagcatagtaatatgatttaccaacctttactactttctgttttgcgaccttattattgcagtaaattactttcttattgccttttgtgacaaccttattgccggcggatttctttgctttatcaagctgtttcttaagttcagctatctttgtaagtgacttgcaatccttgaacatatcgctcatatcagtaactttacttgtgtcaaagttgcttaaatcaagtgatgtaagtgaactgcaaccagagaacatgctgtccatatcagtaacgctacttgtgttaaatttgcttaaatcaagtgatgtaagtgatctgcaaccacagaacatgtagctcatattagtaacatgacttgtgtcaaagttgcttaaatcaagtgatgtaagtgaactgcaaccagagaacatgctgtccattttagtaacgttacttgtgttaaatctgcttaaatcaagtgatgtaagtgaactgcaaccactgaacatatatctcatatcagtaacttgacttgtgtcaaagttgcttaaatcaagtgatgtaagtgaactgcaatcaccgaacatgctgtccatattagtaacgttacttgtgttaaatctgcttaaatcaagtgatgtaagtgaactgcaaccactgaacatatatctcatatcagtaacttgacttgtgtcaaatttgcttaaatcaagtgatgtaagtgaactgcaatcaccgaacatgctgtccatatcagtaacgctacttgtgttaaatttgcttaaatcaagtgatgtaagtgatctgcaaccacagaacatgtagctcatattagtaacatgacttgtgtcaaatttgcttaaatcaagtgatgtaagtgaactgcaaccagagaacatgctgtccatattagtaacgttacttgtgttaaatctgcttaaatcaagtgatgtaagtgaactgcaacatctgaacatatatgtcatatcagtaacttgacttgtgtcaaatttgcttaaatcaagcgatgtaagtgaactgcaaccatagaacatgtagctcatatcagtaacttgacttgtgtcaaatttgcttaaatcaagcgatgtaagtgaactgcaaccactaaacatgctgctcatatcagtaacttgacttgtgtcaagattttcaaggctaatactttccacatttcctagattataaaaagcacggctcatgtcaggaatggctttcgttccagcttctatatctactgattttacttcagaatacagtccattgtcatcatcatattcgccacgtccacactgactaacatcccaatataagtattctcctgaggtaacaaacctatatttattgttgttttctttcggtgtatatgaattgccatggacactcttgatggttccaacaccagaagcatcttctgagtcaatatcagtttccttttcattagtattaaagacatgtaagacgccatcattgtcggtgacataagctatctttaatccatcagtagtattcgtggtgtcgttttcttctgccttcgctgttatcgcgctgtttcctcccatatatacaccagtcagggtgaatgtcatggcgagggcaagcatacacgacgcggctcgtttcaatacggttttcattttgttcatatctgccttcctctctaaaaaatgagataaaaaagtttcctcgtgtacttaatcagaattcacacactaaaataattttatcacaataaaaattaaaaagcaacgccagattgttataataaatttcatatctgccattaccgtcactagtcggtcctgtaagatgtgaatctatatcataaggattttcgccccaggttaacacaattctgatcaagccatcattcggatataactgctcaggtgacatagctacattaagtgtctgctctgaattggacacaacagctacattcatctcgttatctatatagccgtctttctcaaactgaatcgtataatttccaggcttcagatttaattcaaaatttccttcatcattgctttcaattgagccctgtgcgacgatattttcatcacctgttatggcgttccaattctttctgactttatagcttactacatctatatcatctccggttttgaattcctcaaatgaaaattttccgtcatcatctgtatcggtactataaatttcaacgccatttagcttggcaattactcttgtttttactggattgttatcactcgctcctattacgcttccagtgatctgtccagttgcatatgtacatgttggaacaatactaaattctttaccttctcctccttcaatatgtaagttctttctaaacgggctgttattttcatcaaaaacacgtccgctccagcttttatgcacggcatgatctttgtattattgtgtccgttgatgccgttataaaacttgatcccgactccgccggcagatatccattcctttaagttctttccaaagtcatctacaaggatgcctttttttgcataaatatgcacggtacgtgcgccagagcccttgaattcagggcctatgcatgtccgtgcatttaaaagtagtggagtaggcgggagtcgaacccgcgtccaaaaatctattcactctccttctacgagcttagtgatctgtttgtcattccctctgccggacgggagagcacgcccttccggggtcagtagcttcatgatacgtactggtgcgcaaagcttagcacaagccgtttcccatgtgtttgaagccggtgactgaatgcatgggtacaatcaggcgacttacgctgcgatcaggcagcgtatgctaattcgttattgttagcgtttaaatttaatttgagatttaacgcatcatcctgcggctcgcttctaaagtttcaaaatccctgtcgagacctttactaccccgaaactaactatataataacacctggagtcaaatttttcaacccgcctatatattctggcttaaaaaggcctctgttttagaccagtatcaacatagagccaaaattatgccattacctccaagacgttctcaacataaggcttccgcggagcaagatgctacaattgtctaaaagccatttctacatagagcttcctcccggtaatttgtaacaaactatattgtcttaaagcccacttcagccggaattttttgccttaaagccctcctcagctgaaattattgtcttaaagcccgcctcaaccgaaatttcttatcttgaaatccctctgggcctctctctcctggtcgcgctttgccatgtcggcgcgcttgtcatagagctttttgccgcgggccagggctatctctatttttacacgggagtctttgaaataggcttcgaccggaacgagggtgtagcccttctccttgatgcgctgcgaaagcttgcggatctcgtccttgtgcagaagcagcttgcgcgggcggagcggatccttgttcatgatgttgcccttttcgtatggagcgatgtgcatctgcttgatccagacctcgccgttttcgattgaaacccaggcctcctttaaggagcagccgccgttacggaggctttttacctcggtgccgacgagctctatcccacattctatatattcatcaagaaaatagtcatgccttgccttgcggttagtggcgatgatttttcttccagtttttccctttgccatctttaaacctttctccagaaaacttcttcagctgcttcttcgctttctttgaaaatctgccggaatgatcctgcttctcgaggccatacggcttcttcttgtgtctggtgccgccgcccatgaaatcgtcgacaagctcaaagtcaataagacgggtcgtcggctctgcgtcaacgagccttacacgaagcatcatcccaagcgtatagtgcctgttgaagctttttccgatgagctcataagtctcctctgagaactcgtagtagtcgtcgttcatagtgcgtacagggatcattccctcgatagagttctgaagcgccacataaagtccccatgaagtgactccggaaatccttccggtgaattcctcgccgatatgaggaaccatatactcgactttcttcagttttatagagtcgcgctctgcgctgtccgctcttctctcaagtgtggatgtgcggtctgcgatatccgggagagcctcgtttaattccctgatcttcttctttgtcagcttgtggtggatatcaagctttaatacccgatgtataaagaggtccgggtatcttctgatcggagaagtgaagtggcagtaataacctgctgcaagtccgaagtggcctgtgcactctgtcgtgtactttgcctgctgcatactccttagagtaagtgtctgaataagcccctcctccggtgctccctcgactctgtctagaagcttctgcagctccttcgggtgtatctggttcacatttccctcgagtgtatatccgaagccgccgacaaaagacttcaaagtctcaagcttctcaggatccgggaatccgtgtgtcctgtagaggaacgggaatttgtgatcgtaggcgtgcttggctactgtctcgttggctgcgagcataaaatcctcgatcatcttctgggcaactcccctgtaatacgggtgaacgtccttcggattgccgtcatcgtctaactctacgactgtctcaggaaaatcgaagtcgatcgagcctctgtatgtgcgccttccatggaggatgaatgcaagctcctccatctgcttaaacatcggaactacatccctgtacttttcgatctcatccgggtcgttctgctcgaggatcttatttacagaggtgtatgtcatacggtggttagagcggattatcgactctgcgatctggtgatcctttacggctcctgtgtcgtcaattctcatgatgcatgacatcgcgagcctgtcctcgccttcgtttaaagagcagatcccgtttgaaagctcgacaggaagcatcgggataaccctgtccggcaggtagaccgatgtgcagcgcttgtaggcctctttgtcaagctgtgagccctctttgacatagttcgatacgtccgcgatatggactccgaggatataatcccttccgtccatcctaagagacaccgcatcgtcgagatccttcgaatcctcgccgtcgatcgtaaccatcgggacattacggaggtccatgcggcccttcatatcagactttctgactctgccacggcctgagactttcttcgcctcagcgagcacttcgtccggaaaatctgtcgggatatcgttttcttttacaatcgataagatgtcgactcccggggctcccttgattcctatgatctccttgatctcaccctcaggctttctgttcgcgctgccgtaatatgtcaggtggcagaccacctttgcgttgtcaggggcgccattgagcttctgtgccgggacgaagatatcgctcgtgaggtgcctgtcatcaggcactacgaagccgaaatttccgctccgctcaaatgtgccgactacatctgtgtaggcgtgctctacgatatctacgactttggcttcctgcctcgtgccgtcgcccttcgggcggccgatcggctctatctttacagtgtccttgtggaaggccatctgtgtgtatctctcaggaataaagaagtcctcgtcgaatccctcgactgtgacgaaaccgaagcccttggtattgcttgaaaaagtaccgacaaggtacttatcctcctctctcctctcctcggcagcttccttttgatcttctatctgcttttcaactgacttctggcgctcttctgcttcaagagcctcatctgtctctggattcccagcatttttatcagattcagtctgactggcttccgtgaaaagctcctgatcttctttttttactgcgtaataagtgccgtccgaagacttcatgattttcttctcggcgactagcgacgacagggcattcttaagctccctgtcatcggcggccataagaagggcacccaactcttcctctgtcatcggcgaataagaggcatcctgcagaactgccagcagggcgcgcttctgattcgtccatctctctttattgttcattctatctgacctttgcgaaaaaataataacctgacttctgcgaaaaatcggctttacacgacaaaaggccaccgccgaagcgatgaccttgtttgttaaagtgaaaaggaattcatattcagcactgctgctaatacgaaaaataccgcaacaagaatggcagtaacccttactataacgccctctctggaacgtcccttgttcttgccccagtatgtattattaagactctgtccgctcagtgagcctaagccttcatcagcactctcctgcatcataacgacgatagtcaggacgatggagactatgatgaacagtgtcatgaataaatacttcaaaacagtcatcgtgttttacctccgatatttttgtcatgcgtaagtcacaactagtatattatacaatatgtagttacgctttgcaagtattttcgcaagcctgtgcctgctgcattatttcttattcttaaaatatgcatcgatgcccttggctgcggcttttccggctcccatggcaaggattactgttgcagctcctgttacggcatctccgcctgcatatacagcggtctttgatgtctctccatcctcttccttcgcgaggatgcagcccttcttgttcgtatcgagtcccttcgtagtcgatgcgataagtgggtttggtgaagttccgagtgccatgatcactgtatcgcagtcgatctcgtactcagatccttcgattggtaccggtctccttctgcctgatgcgtccggctcgccgagctgcatctttatgacacggatgcctttgacccagcccttgtcgtctgctaagatctcaacagggttctggagaaggtcaaagtggatgccctcttcctttgcgtgatggacttcttcggccctggccggaagctccttctcactacgtctgtagacgatatgtacctcagctccgagtcttaaagctgtacgggccgcgtccatagctacgtttccgccgccgacaactacgacctttttgccgtggatgataggtgtgtccttgtcctcgtaagccttcataaggtttgatctcgtaaggacttcgttggctgagaaaacgccgtttgctgtctcgcccgggattcccataaatcttggaagccctgcgcctgagcctatatatactgcctcgaagccaaactcttccatcagatcatcgatcgtaagtgattttccgatgactacatctgtctcaatgtctactccaaggccctttacgttgttgacctcggccgctactaccttgtccttcggaagacgaaactccgggataccatagactaaaacaccgccggccttctgaagtgcttcgaagatcgtgacatcgtagcccatctttgcaaggtctcctgcacaggtgagtcctgaaggaccggatccgataacggctaccttgtggccgtttttctcctttggaggctccggatggattccattctcacgggcccagtctgctacgaatctctcgagttttccgatggctaccgcctcacccttgattcctctgatgcagacgccctcgcactgtgtctcctgtgggcagacacggccgcagactgccgggagtgatgaggaatcgctgatgatctcgtaagctttcttgaaatctctctctgttaccgcgtgtataaattcagggattctgatagatacagggcagccgcctacgcagcgtggatttttgcagttgagacatctctttgcctcttccactgcctcttcctctgtatatccgagacaaacctcgtcaaaattatgtgctcttacctgtggctcctgctctgcgataggaactctctttgtcatatctgccattacttgtcacctccgcatacaccgcagccgccatggtgtgtatcgccttcctcgtactcgagcttcttgcggccctcttcggtcttgtactgctgcattctctgcattgccttatcgaaatcgaccttgtgtccgtcgaactcaggtccgtctacgcaggcgaacttcacttcaccgccaacgataagtctgcatgctccgcacattccggttccatcgaccatgatcgggttcatcgaaactacagtgtggattccaagcttctctgtcagcttgcagacaaatttcatcatgatcatgggtccgatagctacgcaccagtcgtatctctttccctcgtcccagagtgcctgaagtctgtctgtgcccatgccgtggaattcgtaagatccgtcatctgtgcagacatagaggtttcctgctgcctctctcatcttgtcttcgaagaaaagaaggtctttatttctagatccctggataacgtcgacatctacgccgtgctcatggagccactttacctggcagtaaaccggagctgttccaacaccgcctgagataaatacgatgtgctttttctttgtctcctcgagattctccgggatgcagagctctgaaggcttgccgagaggtcctacgaagtcgtggaaggagtctcctacattaagcttcgcaattttttcggtggattcaccgatcggctggaagacaatagttacaagctgtttctccctgtcgtaatcacagatggtaagagggattctctcaccgtcctcctctgcgatggcgatgataaactgtccaggaagacatgagtgtgtgaccatcggcgctttgacgtccatcagaaggatgttagacgcaagctgttcttttcttacgatctcatacatactttcttttttcctttcctaacttaaattagttgaaatataccagttcgtcttcaggcttctctgccttctcgatactgataggatataatacaggacctttgcccctatattctcttgcgaattcgtccttgactctggcgcggagctttatccagctcttgtgcggtacgttctctgcgtcggcgtatttgcacttcatgccgaggaactgtatatcctgtacgcagcaggtcatcgcgaatcttcccggaattattacgcctggacggtttctgcctttcttgtcggtcgggttgtagacaagtccggtgaaatcgacgatcttgccgtcatatttcttaggattgtccatgcagtccataaaccagagtgcgtagtctgcatcagtgatatttatctcaggctgattgatgtcgaatggcagctcgtcaggcgtattgtcgatcgtgccgtcttttctctcgtagacgatctgtgccttgcggtttacacccttgacattggctctgaacttcgccttgttggtattttcgtcgcatctgttaaaaatgacgacgtcggcccgaaacatctgctccttcatcatcgtacccatgttcttcatatacatctcgaaggtagtggcatcgactgtgcagaggctctggactatgacccagtcgtccgggccgtccatctcgtagagaaggcttgactcccaggtgccgttgtactctataaaaatagcctgcggatcgtattctttctgaagcttctccatcttctcgagggtgaagtcattcttgtcgtctatctcaacgaaatcgatcccgttctctttaagcttgtcctcatcgtattcttcgtcgccgtcttcgcatgcaataagaaggcatctgtcgaagtcatcggcaaaaccgttgtcaaaaagtgtctcctttatcagcgtggtcttgcctgaatccataaaaccaaagaatacgtaaacggggatctcgccatcgttctcttctgtattcatttgttacctctcttaaagtccgaaaagctcttcgactttgtcttcctttacgtctgttccaatgactacgagctttcctgtgacatcaggctcaccagtcctgatctcgtactcgccgtctaccaggtcgaaatagtaccaggtgccatcttctccaggaacgatacccttggagcgaacaatatagccgtagtcgtcgctctcggcaaatgcctttaaagcattctcgatggtctctctcttgaacttgtgaggtgtctcgcggccccaggtagtaaagatatcatctgcgtgatggtggtgatgatggtgctcatgctcatcgtgatcatgatcatggtcatgctcgtcatgatcgtgatcgtgttcgtcgtgatcgtgatgatgctcgtggtcgtgatggtgctcggcctcttcctcagcatggtgcttctcagcgagctcgaaaacttcgagattgtcgttgccagtgatggcatccatgatctgctttccgttcagctcgtcccacggagtagtgatgactactgcctttggattcagcgcctttatagaatttactgtgtcctcgagcttctgctcgtccatcttctgtgtacgtgagagaacgactgctgtagcgtgctcgatctgatccttgaaaaattcaccgaaagccttcatctgctttttggccttaaggctgtttacgatcgtaacaagtgctccgacatgaaggtcctctgtctctccaacttcgagaaccgagacttcgatatctgaaagcttagccacacctgaaggctctacaaggatcctgtcaggattgtatctctttattacttcgtggagattcttcgtgaagtctccaacgagtgtgcagcagacgcatccgccgtttatctctgatacctgaattcctgtatctttgaggaagcctgagtcgattccgatctcgccgaactcgttttcaactatgactaccttctcgtcagaaaaagcctcggcgacaagcttcttcataaatgtcgtctttccggctcccaaaaaacctgaaataatatctacttctgtcattgtaaacctcctgtggttttagaacattttctcacatactccggtgctttttatctttacatgcgctctggcgcggaaaatccgagaagatcgattccacactctaaaacctctgatgtaagttcgagaagtgacatgtagccatcctgcttctctttgtcttcgcatgagaggatcttcgtctcatggtaaaaatggttgaatgcgttcgcaagctcgtagatatactggcagatacgattcggcatattctcattgtatgcagcgcgaactgcgtcctggaatggagcgagtgccaaaagaaggcttctctcgctctctgtctctggcgcaaggatctgtctcttctcaagcttcctgccaattccctcgtattttcttatgatagacttcatacgaacgatcgtgtagaggatgtacggacctgtatttccctcgaatgaggtaaatttgtccacatcgaagatgtagtccttcgacggctggttcgagaggtcgccatactttatggctgcaaggccgactatatcggccgtctccttcgcctcttcctccggaagctcgttattctctttgatcttcaaaagcatcttctgatcgacatctgcgataagagtcgaaagacgcatgacaccgccctcacgggtcttaaacggctttccatccttgccgttcatggtgccgaatcctatgaaatcgaggccgcagctgtccggtacgatgccgcactttctcgctgccctgaaacactgtatgaagtgaagctcctgacgtttgtcgaccacataggcgattcggtcagggtgatagtcgtttacacgccagatcatagtggcgaggtcagtcgtgttgtagagggctgcaccatctgactttaagatcatgcacggcgggatctccttcttgtcggagtcctcctttacatctacgacaagcgctccctcgctctcgtgggcatagccgttcttcttcatatcctcgaccatgtcagggatataaggagctgcatccgactcgcccttccagaggtcgaatgagacgtttaatttctggtagttcttctttaaatcagtaactgacacatccatgatgtgctttaagagagcctggtatccgcggcgtccgttctggagctccttcgtggcttcgagagccttctcgtggtatgcctcgtcctctttggactttccggacgctaaggggtagatctcctcgagttcagagatagtaaatggcggctcctcagggtagtcaccagtatagttctcatcgaaataaatgaggtccggttttctctcgtgaagctctgttatgataagtcccatctggagtccccagtcaccgagatgtacgtcgccaatgaccgtatgtcccataaacttagcgattcgcttaatggcttcacctatgacagcagatcttaagtgtcctacatggagcggctttgcaacattcggaccaccgtagtctaaaattatagtaagcggcttctccggcttatcgagtccaaatctctcagatgatgccatgccattggcatagtcagctaaaaatgaggcgctcagattgaaattcaaaaagcctggctttactgcctccacctttgaaaaaatactgcttttctcaaggttctctgctactgcctgagccattattataggcgccttgtggtactgctttgcagccgccatggcgccgttgcactggtattcgcagaggtcaggacggttgctcaccgtaacgcggccataagacgcgtctaatccggctttagtaaagccggaccgtacctcttcttcaataagttctataagttctttcatcagtcaataaccctttgtctgtctttttccggaaagagaacatttctgtaccttccgaggatcttcttaagtgcgaatccgaatccgaatactgagatggcctctcctgctccgactgtaagtacgaggaacggataagctgaatttactccgtatgcgagaatcaggataacaggaactccgagtgcgttaaagagcactggcggaatcgtgtagataaacttctggtttcttaaaagtctggtaacaaaagcagctgcaagcgttataaggcttccgaaaactacatcgtagatggccgagcctgtgataagatttgcaagcaggcatccgatgaaaagtcccggaactgctgccggcgtaaataccggaaggactgtaagggcctctgagatacgtacctgaacagcaccgctcgctaagtcaaagcctgctgcaaataccgtaagtactacataaagtgctgcgataatccccgcctgtgctacataaagtgcgctgctttttttactgaatgacataataaacctcctgtggtaaaaatccggaagctatgtcacctcgcttcgcaattaacattaaccaaaatattctaacatagattgtgtacaattaaaaggcagtccctgtatttaataaaatgcaaatatcagagttctttttcgatcacatctaccatctgatcgacgtatttctcgcagagatcctttgtatctgcctctgccataaccctgatcacaggctctgtgccgctcgcacgcaggagcattctgccgttgccctggagctcctcttcgatctccttcctgcactcctgtaccttagggttatcgaggattgcctgcttgtcagttacctttacgttcttaagcagctgcgggtacttcttcattcccgatgcgagagtgtgcagagaagtcttctcctccattatgacttccatgatcatgatggccgtaagtattccgtcgcctgtcgtagcatgttttgaaaagataatatgtccggactgctctcctccgagaacatagccgttctttaccatgtcttcgtttacatacttgtcgccgaccgtcgtaacatcgtactcgatgccatttttctcaagtgccttgaagagtccgaggtttgccatgatcgtagctacgacgtggtttccatcgaggcggccgtgcttctttaaatatgtgccgcagatatagatgatatagtcaccgtcgataacctgacccgtctcatcgaccgcgatacatctgtctgcgtctccatcaaatgcgaaaccgcagtcgagctccttctcttttactaacttcacgaggttatcgatatgtgtcgagccgcagttctggttgatattgaggccattcggctcatttccaacgacatatgtctttgcgccgagagcgtcgaaaacagactttgcgatattaaacgtggaaccattagcacagtcgagtccgatcctcttgcccttgtaggagcgggtcgcaagtgagatcaaaaagcctatgtatctgtttcttccgatcgcatagtcgatagcgactccgatattctccccgatagcaaatggcaccggatcggtctttccatcgatgtagtcctcgatctggctctcgacagccgcgctcatcttgtggccgttcgaatccatcagcttgatgccgttatccgtgtacggattgtgggaagccgataccatgactccgcagtcgaagtcgtcagtgcggactacatatgcgactgaaggtgtcgtcgtaacgtggagaaggtacgcatcagatcctgaagaaataatacctgctacgagagcatactcgaacatgtagctcgatcttctggtgtcctttccgataacgatcctgccgcgcttctcacgtccatagtaccagccgagatagcgtccgatcttgtacgcgtggtctgctgtcagaacttttcctgcttctcctctgaatccatctgttccaaaatacttcatattttttccttttcattaaaaaaattatgtttttaaaagtccatacagaaagttagtatagcacatcatgtattttttggatagagagaatacttgaaattgatgagatttttttctagaatgaagtcatgaaaaaaatagaaaatacttttaattcaagtgaaaagataaaatacccttcgatcgtaaatgagtactcatctgatggtgacatcttcttatcaatcgagacgaccggtctctctccagagcgccacaggataagctctgtcacattagggaggcttgcggcctcgaaaacagagactgtgacttatttttcagagagtgaaaatgacgagcttactataatacaggctgctataaaagacatgaaggctttcaagcgtctcgtcactttcggcggcacgaacttcgacctcaaatttctctcgaaacgcgcagaggtctacgcgatcagattcgacttcaacagctcctctgtaaaatttgcccgccacgaattgaagaacttcgatctctcccagcttctccgccctataaggagatttctcccttcagagagcctttcgatctactctcttctccctgagatgggcctctcggacaagtcacttcccaaaggccgcacagtcacgaccctctacaagacctacctcaccacaggcgaaaaaaaatacgctgagccggtaatcgaccacagcgtatacaaagtgacgggaatcatgaacgctctcgcgcttttaaactgtctgaaaatcaataaagcgaatccgtctcttctggacatttcgcgggatgaagaagctgtcaccgtaaacggcacaactgatattttcttccctgtagagcttacgttcaatctcccagccataagtctctcttttaaagagaactcattaaaaggaatcttcgcttcaaacttcccatcccacaacggctgcatccgcatctaccttcccgactggaattcctatgtcagattgaaagagaacggccagctgattccgaaggagctcgcgaagtctctccctaaggaatcttacgagaaagtcacacaggccgactgctatatgctttcaccaatccctgaagactctgccaaagcgaaagatcagctcgagaagtacatcaggcagctgataaggatgtgagattctcactccttctcatagaagaacgagcttctcctcttgaatccgagctccctgtactccatgatctgctcggtgcttccgatgaaaagcaggccgccctgctttaatgacttcgcaaacttcgaatagatgtcgtgcttcgcctcatctgtaaagtagatgaccacatttctgcagacgataaggtcacagttcgaaggataggcgtcttttaagagatttccctcgtggaagctcacccgctttttgatgtcttcagagatctggtaagatgttccgaccttagtaaagtatttcgccttcaggtcattcggtactgacttgatgctcttctcattgtagagaccggtcttcgcctgggctaatacctgcttgtcgatatcggtcgcatctatcctgatatttgacagagggacgtgctttgagagagccataacaagagaatacggctcgtcgccggtcgagcaggcggcgctccagatctttaagctcctgccaaatttctgaatcaggtagggaaagtactccttgtcaaggagctgccactggtctggattgcggtaaaattcagagacatttatcgtaaggaaattgacaaattcgccaaatacatccttatcatcccgcagcagcttcacataatccggatagcttacaaggtgatgctttgtgacaagcgagtcgatacggcgcctcatctgcttctccttgtaaagagagaggtcgatcttcgtcatctgataaacctgctttttaaattcctcatatccttccatagtaccgctccttttatttaccactctttttaataaaaaataaaaaaagagcgaacggcataaccgtccgcccctgaaaattcaattagtcttctgacttctgattatcgttgtccatagccttgattgaaagagagatcttgtgatcagcctcacggaactctacgatctgagcatcaatctcctgaccaaccttcagtacgtctgatggcttgtcaacatgatccttagatatctgtgaaacgtgaagaagtgcatctactcccggctcaagctctacgaatgcgccgaaatctgtcatacgggcaactctgccgtgtacgatagtgcctactgcgaacttctcagcagcattgttccatggattctgatccgggaacttcatagaaagagcgatctttctgtcgtggatatccttgatgaataccttgaccttgtcgccgttcttgaataccttgctcgggttgtcgatacgtccccagctcatctctgagatgtggagaagtccatcgataccgcctaagtcgatgaatgcaccgaagttggtaacgttctttacagttccctcgataacatcgccgaccttaaggttagcgagaagctcatcctgcttcttcttcttctcagcaacgagaagctgctttctgtcgcctatgatgcggcgcttgcgaggattgaactctgtgataacgaactcgatctcctgatccttatacttattaaggtctctctcataagtgtcggatacaaggctggccggaatgaatactctggcaccgtcaacctcggcagaaagtcctccgttaagaacctgaacaaccttagccttcagtacctcgttgttgttgaatgcctcctctaagcggcgttttcctctctcctgagcaagacgcttgtatgaaagcgtaacctgaccctcagtctcgctgtatttgactactactgcctccatagtggcgcctacagatgtaactgtggtaagatcgaggtttgagtcgtttgagtactcgtttctggtgatgacaccgtcagcctttgtgccgatatttaaaataatctcatccggctttacgtcgagtaccgttccctctaccacatctcctgcgcggaccgtcttgaaagacgcatccagcatttcgtcaaaactcatttctgacatttactaatgacctcctgaataattttcgctggtgtagatgctcctgccgtaataccgacactgctggcagattcaagagcctgtgggtccaggtcgtccgcggtctccagaaaatacgtatccggacatttctgccggcagatatcatagagtttcctggtattcgaactgttcctgccgccgatcacaagacacacgtcgacttccccagcaatacgtgcagcctcatcctggcgttcctgtgtagcattacagattgtatttagagcattaatatcataccctttttggtttaagatttcaactaattcgtgaaatttcttatgattaaatgtcgtctgtgaaagaagcgtgattttcctgcttttgtcttttaatgtgaaatttctggcctcttcctcagtctggatgcaggagtaatcgttcccctgaatccagccgcagactccctgtatttccgggtgattgcggtctccgatgattattatataatcaccatttttcgaagcctccatggcgaggttgtggattttttttacaaaagggcaggtggcgtcaacagtggtatgtccggcgttttcgatgccctcttgcattttttgagatacaccatgtgagcgtaagattacgatgcccttttcatatgaagacgcatcctctgtctcatccattacctcgacaccctgctttttaaaatcattcacaactgtctcattgtggattatcgggccgtccgtataaattctacgtcccggatttgcggctatctgctcctctacgatcgagacggcgcgctttacgccgaagcagaatcccgcatgttctgcaactattatcttcataaaaccgaatcctttaacgggtccatcctgtccactcctgagaaatcgaattcgtttaaaagatcttccatctttctgtttctctcgcggaccttgtcggacctcttagagaggacgcccatcacgagggctcctattacactcatgccggccactggagaggacgcgaacgcgttcctgtcgcaggaggccgtcaggttcactgtcgagtacatattaagcggcgagtgcacgctgtctgtgatcgttatcaccggcgtatttttcgtctgtgagtactcgagaaggcggagcaccgaaagcgaataccccggaaaactgatacccaccatcacatcattttcatttaagtctatgacctcactgaaaaaatgctgcatgctccccttcgagagcaccctgacatccggcagagcctgccgcagatacattgcaaaatagtcagcgagcggcgctgaaaagctcaccccggcgataaaaactctctttgcatttaaaagcatctcgactgctctaaggtaggcgtcgtgatcgatcgagtccttcgtgctctcgaggttttcaatgtcctgttttaaggtgtctgtcagcgtatcctttatctcggcagaaatatatggtgcttccttaggccccgatgggacgaggtggttctttacctcagatgccatcgcctgcgaaaattccttgtagcccttgtatcctaagaatgtggcaaagcggactactgtcgactcacttactccgacgcggcttccgagctcgtaggcgttcataaaggctgccttgtctatgcagtctgtgatgtaggctgaaagctgctgctggcccttcgacatcgaagagtatctgtcgtttattctcgtaaaaacatcatcacgcatataaactctttatcttatctactacctcatcgatcgtcatatcagatgaatcgacgagcactgcatcgtcggcctgcttcagtggcgaaatctcccttgtcatatcggccttgtcgcgcttttttatgtcttcgattattgtgtcgaggtcaggattctcgcccttggccttaagctcatcgaatctcctctttcctctgacctcggctgaggctgtgaggtagatttttaaggtggcattcggaaggacacaagttcctatgtctcttccatccattacgacgttctcctcttcggcgagcttcttctgaagagccgtaagattcgacctgacctgtccgtactggcttacaacgcttgctgcctttccgacctgttcctcgcggatctcctttgagacatcggcaccatttaagataacatgctgtgttccatcgatatattttaatctgacatctgcattctgtgaggccttctcaacagcggccttgtcataaatatcgattccgtgctttaacatataaagcccgatgcttctatacattgcgccggtatccacgtagacaaatgaaaggtcacctgccagtttctttgcgatcgtactctttccggctcctgccggtccatctatggctatctgtttactcatctttacctccttttgctgccgaacagccggcaagcgctcccatcgaaaatgcgctctgcaggttgtatcctccggtcagcgcatcgacgtctaacatctctccgcaggcgaagagccccggatattttttaagctgcatggtcttcgggtcgacttcttttaccgatagtccgccgcctgtggaaatcgcctcattaaagcctcttgtgcccgttatagtaagcgggaagtgctttaagagcgtaagaatatgtgccctctcctgctttgtgatcgagttgagcttcttctcgggatctatctcagttagtccgaccatgacagggatcattttcgaagggagaagcccgtcgaaaaaatgcgagaagttcttattctcaccttcctccactgtccttatcagtctcgcgttaagcttctcatcagagagagccggcttaaggtcgatctcggctttaagctctccttctctctccaatacttttgcgacctttgatgatgccgagattactaccggccccgaaattccaaaatgcgtaaaaagcatctctccgaactccgagtagattggctttttctttttcgatgagaaaatcttaaactcgatatttttaagtgagaggccctgcatcttcgggatgtattcctcttttgtctcgaaaggcacaagcgccgggtagcacggctttatatccagtcccatgtcttttaagacagggatcaggttcccatcggaacctgtcgtgggataggactttccgcctgccgcaaggatcacagcgtccgccagatactccttctgttcggagaggtgtccctcctctgcggctcttaccccggttacttttccattttcacagaggatgcctaagactctcgtgttgtaaatgatctttacttttaatttttttagagtgtcggtaaaagccctcgtgatgtcggaggcgtggtcagactgtgggaacatcctgcctcccctctcgacctttgttggcactccagcgtcttcgataaattttttcaggtcctgattgttaaaatatgcgaacgcggaatagagaaatctcgggttcgtaacgatattctggtaaaaatcgtctataggcgcagcatttgtaaaattgcagcggccctttcctgtgatgtagatcttcttgccggctttctcatttcgctcgagaatcgtcacgtccgcgcctttctctgcggcagagaccgctgctgcaagcccggccgcacctgctccaacaattattattttcatatttttattcaaaaaatgccacaggcagatggcggacatttttcaatgagccaacgcctatggcagcttatattaaggccttatcggaatttagtcttttaatgcttcctttggaacatcctttatcgagaagctcatacggcctgtcttatcttttccaaggcagataactgtaaccttgtcgccgagtgtcagtacatcctcaacgtgtgcgatacgctcattggcgatctttgaaatatgtaccatgccctctttgcctggagcgaactctacaaatgctccgaatggctttatggaaacgactgtgccctttaagatctgtcccttctcaaagtcggtaacgatagtctttaccatgcggatagcttctgcatttgcgttctcatcgagcgagcttacagatacgcggccgtcctcatcgatatcgacctgagcgcctgtgcggctgatgatctcgtttatagtctttcctctctggcctacgacatcgccgatcttatcggtcgggatctgaacgaatgaaatctttggagcgagtgctgcaacgtgatccctaggctttgaaatagccttgctcatgcaggtatccatgatgaagttgcgggcctcgtgtgctctgcggatagcttcctctacgataggccttgtgagtccgtggatcttgatatccatctgaatggctgaaattccgtcgtgtgttcctgtaaccttgaagtccatgtcaccgaagaaatcctcgatgccctggatatcggtaagtacgatgtagtcatcgtctgtctcacccgtaacgagtccgcaggaaataccagctaccatatcctttatcggaacgcctgctgccataagtgacatgcacgatgcgcaggtagatgccattgatgtcgagccgtttgactcgaaagtctctgatacggcacggatggcgtatgggaactcctctactgatgggattaccggctttaaggctctctcagcaagtgctccgtgtccgatctcacggcgtcccggtcctctcgaaggcttcgtctcgcctacggaatatgatgggaagttgtactggtgaatatatctcttctctgtgatgttcgggtcaagtccctcaactctctgaacttctgagagaggagctaaagttacgatatcgcagatctgagtctgtcctcttgtaaacatagatgaaccgtgaacacgagggatcaggtctacttcagctgaaagaggtctgatctggtcaatggcacggccgtccggtctcttgtggtctttgaggatcatctttctgactgtcttcttctgatactgataaacagcatccggtaagtgtgtcaggtattcttcattgtcagcaaaggcctctgtgagcttatctgtgacagcggctacatttgcctctctggtctgcttgtcgtttacaaatactgcctcttccatctcatcaggagtaacgatcttctcgatatcctcgagcatgtgctcaggaagtgcaaagctctggtattcgaacttctccttgccgacctctgaaaccatctgatcgataagatctatgatcttcttgtttacatcgtctgcggtgtagatggcatctatcatggtctgatctgagataagatttgcaccggcctcgatcatgatgaccttctcgcgggtagatgcgactgtgagctggaggtcgcctgtatcccagtctttctgagacggattgatgataaatctgccgtccttcatgccgacctgtgtcatggcacaaggtccgtcgaatgggatatcagaaatgcaggtagccattgccgtaccgatcatggcaacgagctccggtctgcactccgggtctactgaaaggacgaggttgtcgagagtaacgtcgtttctcaaatccttagggaacagcggtctcataggacgatcgataacacggtctgtaaggacagcgttctcagaagcttttccctcgcgcttgttgaatcctccaggaatctttccgatagcgtagtacttctcctcaaactcgactgagagtgggaagaaatcgacgccctctctaggctccttcgatgcagtagcggtagaaagaactgtagtgtcgccgtatgaaataagaacggcgccgtttgcctgagctgcgaccttgccgacctctacctttaaaggctttccggcgagatccatctcgtaagtttttctaagcataatgatcctttctgcgaaacagtcacaggataaacagatcagaatacactgatcagtctggttctatgactgtttctaaaacacaaaaacagaggccttgtatacaaagcctctgtaaagttactaaattacttacgaagtccaaggctctcgataagcgtacgataacgatcgatatccttgttctttaagtattcaaggagatttcttctcttacctaccatcttcagaagtccacgtcttgaatgatggtctttctgatttaccttaagatgttctgtgagctctgcaattctctctgtaagaactgctacctgaacctcaggcgaacctgtgtcgccctctgaacgggcgtacttcttgatgatctctgtcttcttctcttttgttatcataacaaaatcctttcttaaaaaaaattacatcacataccatgcagccgtcggattgctcgaactacagggcatggaaaacacaacccaaaaataatatcataatcccgcacggttgtcaatcacgattgaaataatctctggcctggcggatatttttttctatctctcttttaaggtcctcaatgcttttgaattttttctcaggtcttacatacttgtaaaaagcgacagacgccttctctccgtaaagattgttcgtaacatccaaaagatttgtctcgactgtgaccctgttatcatcggagatcgtcgggttgtcacccacatttgtgataccgtgaaaaatcctgccgtcaatatccaccgttgagatatagactccgaatggcgggagcagctttttatctggcgggacgatatttatcgtaggaattcccattcctgtgcctatgtgctttccatgaactatcggcccgtagataaagtacggcctgccgagaagccttgcggcctcttccacgtcgccgtcttttataagtcctctgattcgtgtcgagctgatctcagccccgtcctcacggatcttttctatgacgttcaattcgaaaccaagctcttcggaaagtttcgaaaggaggctggcatttcccgctcccttgtagccaaatgtaaaatcgcttccgaccgccaagtagcacatgtttaatctccgatagagcatcccgataaaatcttccggcgactggtgcataagcgaatcgtcaaacggaaggatcaacaggacatcgattccctgcttcgcaaggatagcatttctctcctcctccgtcacgatgaatttcatgtcgggatcgaagaggacctgcttcggcgacttttcgaaagtcaccatcacgctcttaaggcccggctgcttcgtgataagagatacaagggcctcatgcccctgatggatcccgtcgaattttccaacagtgaccgcggtcgggaatttatgaagatagttttctattcctttaataatttccattatacttccaccggatgaacgagctcccacgggtcttctgccgcctcgagctcttcaaatgtcaccgcctcatctattgaaaaatcaccgtttttcagtcttctcaagctctccatcgtaccataagtcccggccttttctgaaatatcctcgataagagttctgatataagttcccttggaacagtgtaccaaaatctttgcatgcggatatgaaaagtccagaagctcaatagtaaaaatatgtatgtgctccggctctctctcgacctcgatgccctctctggcgtattcatagagccttttgccgtttactttcttggctgagtacatcggagggatctggtcgatatctccggtaaatgctgcggcagcttcatttaactctccggccgtgatctctctgtctgaagtctctatgactttacctgtgatgtctccggtatctctcttttcaccgaagagaatccctgcctcatagatcttatcctctgctgtaagcttagagaccagtttcgtcgcccgtccgacgcagactaccagaactcctgtggctatcgggtcaagagtgccggtgtgtcccatttttctggtatggaggatgccccttagctttcctatcacgtcaaatgacgtaaagcccgaaggcttatccattacaataattcctgcgtcaagcatcacttctcctcaaatgccggagcgaccttttcggcaagcatggaaaccatagccttcgggtcgtctccgtcgagcgaaaaacctgctgctctcttgtggccgccaccgccaaattctgctgcaagcttagagagatctacagtgtcgtctgcgcctctggcgctaactttgtattctccgttttcagtcggatacatgaaaaatgccacgacaacgcctgatacagagcgaagagtgcttaccacgccctccatatttttcggagcagcatcgtactttttcatctgatctaatgtcacatagcttccgatgacttttccaccgtcgaaaagctcggcgttatttatcgcaacgcctaacatccgaaactgcttctcgcttctctcatagaagacatgatctacgataaatgagtagtcgatgcccttctccataagctcgccggcgaattccatagtgctcctgtgagtcgagttgtactgaaagcagcctgtgtctgtgacgattccagtgtagaggcactccgcgatgtccctgtctatcttgtcattgtcaataatctcgcctatgagctcgcaggtacttgatgcctcaggaaatacataattaatatccgcaaagtggccgctggtctcgtggtgatctatgcagatagtctttacagcatttgtaaaatagactccggaatcgcctaggcggctgatatctccgcagtcgcaggctacaaacaggtcgtagtttgtcgtgtcaaatttgttcgccctcttcagcttgtcaacacccggaaggaaaagaaaatctcccggaaccggctcgagataagggatgatctggatatcagaatgtgttttcctgatgtagttgtagacgccaagaaccgacccgatgcagtctccatcaggccttatatggcctgaaactgccatcgtctttacgtcttttaagtaatcgtctaatttcattgctgatctcctctttttttctcaatctcctcgtcgtgctcgatcacctcgtcgatcttgtgtgacattccgacgccgtatgctatcgatctgtcgagtctgaaatcgagtacaggcgtatttctgaggttaagtctcgtggcgagctggtgtctgatatagcctgcggaagacttgatgccttccatcgtgcgttctccgtcctcgtcactgcctaaaacagagataaagatctttgcagtctttaagtcaggtgcgactatagcctctgtaaccgagacgataggcgagatacgcgggtcctttacgtcctcacgcaggatcttcgagatgactcttgcgacgtcctcgtttattctgttattttttgcgcttccttttctcatagatatatcctttttttgaaaaaaagccgcgaaaagacaggagacaactcccttgtcctttcgcagccagaaaaatttattatcgctgtacttctaccatcttgtaggcttcaagcttatcgtcttcctgataatcggagaatccctctactacaagtccgcactcatagccggccttaacctgctttgcgtcgtccttgaatctcttcagggaaacaagcttgccctcgtagatctggtcgtcaccgcggcggatacggactgtgctgtctctttcaatataaccgtcgtcgacaacgcagcctgcaataattccagcttctgatgacttgaatgtctgtctgactgtagcatgtccaatgacctgctcctcgtaaataggctcgagcattcccttcatggcgctctctacatccgagatagcgttgtagatgaccttgtaaaggcggatatctacatcctcgttgtctgcaacttccttagccacgttgtcaggctttacattgaagccgatgatgatggcattcgatgctgctgcgaggtttacatctgattctgtgatagaaccaacgccgccatggatgacttttacgactacctcttcgttcgaaagtttctcgagcgaagtcttgacagcctctacagaaccctggacatctgcctttacgatgatgtcgagttcctttaacttgccggcctgaatctggttgaacaggtcgtcaaggctcatgccacgtctggtatcctctacgagcttgtccttatttacagatacgaaggtgttcgcataatcacggcactccttctctgtatcgaatgactttaagatctcgccaggctttggaacctctgaaagtcctaggatttctacaggagtagaaggtcctgcctttttcacgtgtctgccgttctcatcgagcatagcacgaactttgcctgatgatgcgccggctgccacgaagtctccaacatggagagtacccttctgaacgaggactgtggcaacaactccgcggcccttgtcgagctctgactcgatgcagatgcctctggcatttctcttaggatttgccttgagctccatcacatcagctgtaagaagtaccatctcaaggagctggtcgattccctcgcctgtgtgagcagatacaggaacgaatatagtgcttccgccccagtcctcagggatcaggtcgtactcagcaagctcctgcttaactctctctacatttgcgttcggcttatcgatcttgttcactgcgacgattatctcgacgtttgcggccttcgcgtggttgatagcctcgactgtctgaggcatgacaccgtcatctgctgcgacaacaagaattgcaatatcagtcgagttcgcaccacgcatacgcatggctgtaaatgcctcatgaccaggtgtatcgaggaaggtgatcttgtggccattgatatttacaacataagcaccgatcttctgggtgatacctccggcctctctgtcagatacgtgtgtatgacggatcttatcgaggagggaagtcttaccatgatcgacatgtcccataacgcagactacaggaggtctcggtacgagtgtagatggatcgtcctcgtcgtcttttacgagctcagcgatgacatcgaccttctcctcatgctcaaggagacagttgaactcctcggcaatggactctgcctcttcgaatgagacgtctgaatttaaggtgtagatctttcctgcgaggaagagcttcttaataacgtcggctgcggaaactttcatcttgtcagccagatctctgatcgtgatatgatccgggatcgtgatagaaaggatctcatccggatttctcttctcggtcttattgctgttattcttaggcttcttcttgtaagacttcttctcgagacttacgagattctcctgcttctttccgagagcgtcgtggtcagttctcttcttgtggtggttctgcccattgtgacggcttctgttctcctgaaccataggctcagaagatccacctccgcgtgaaggacggccactgccgtctccaaacgaacggcctgtgccgtttctgtctccgcggccattgccattctcggctcttctctgctgtctctcttttctctcttttctttcagcggcggcttctttctttctctcagctgtacgcttcttctgctcctggatctcgtccatgatgtttccgagcttcacaggacctgcaggcttcttatccttgacaggggccttctgggaagtctcagctttggctgctgcctgcggctttggctcatcagctggcttcttctttacgaaagtctcctcaggataggtatcgagtcccttcggacgggccatagccgaacctgtacgcggcttaatcgggcctctgttcgcaggttttctgtctctttgctgtctgtcacctttcaagcggcctctgtccctcgaacctccacggctgtttccgtttctgttctccacatggaagactgcagtgatatttttcttctttttctgctgggccgttttttctgaattcacagccggttttttctctggttctttagctgccaccctggctttttcctccttgtgagtacctgcttctctgttggcttcaggctttttgctttcggacttttccgccgtcggagcattcttcttgagtaaatgcttcttaacctcgtccacctgggcatcttcgaggttattcgcaggcactaagttctggcccttcgaagcaaagtaatcggtaatatccctgctcttgactcccagctctttcgccaggtcgtaaatccttttctttgccatcttaagacctccttgtgtctgctgcattatctataagttccagtatcttttcagcgaagctgtgatcagtaacagccatgctcatccggctttcagccccgacagaacttccgaggcttcccgaatccgaatatatccggaatgggacatgccgaaatgacgccatatcagaaaaatgctttctggtattctctgaagcgtccgaagacactataacaaggcacgcctttccggatttcaacgcatcctcagtctggtatgcacctgactttaatctgcctgccttcttcgacagtgaaagcatcgataagactctgtctgtcactggttagttaactcctccgctaatctgtcatacacatctttgtcaatcttctgtccaaaagagcgctcaagtccgtgattcttcctggccttctcgaggcagcccgcatcacggcagatataggccccgcggcccgcggcctttccggtaggatctatcgtaaaaattccttccggagtccttaccacgcggatcagctcctttttatccttaagctctccacagcctgcgcatctgcgctttggcttcttcttctcagacatcgatctctcctgtgttactcttctgaatcagaagcttcctctgcttcctcatctgccggctcttcttcgtcatcgataaaatcttcgtcatcatctgccggctcttcaccattcagcattctgtagtaatcgcttaagtcaacgaattcaccaccgagctcattgttctgagtctcgctcttgatatcgatcctgaaacctgtgagtcttgctgcaaggcgggcgttctgtccttcacggccgatggccagtgaaagctgataatcaggaactacgactctcgccttcttctcatcagaatctgcgactactgctataaccttggccggagcgagtgcattctcaatgaagcttgctgcgttatccgaccactcaactatatcaatcttttccttgccaatctcagagacgacggcatttacacggcttccattcatacctacgcaggctccaacaggatctacgtccggatcatttgaataaacagccatcttcgttctgtttccagcttctcttgaaatagccttgatctctacaatgccatctctaatctctgatacctcctctgtaaacaggcatctgatgaaatccggatgagtacgtgaaaggcggatcctcgggccatgtctgtcctcgctcacctctaagatcaggactctgatcctgtctgtaggctcgtagtgctcacccttgatctgctcgctctccataagcatagcatctgtccttccgaggttgatgctgatgttctttccaacaaaacgctcaacgacacctgttacgatagtgccttccttagccttgaactcttcgtagatcgaagctttctcatcctctttgagcttctgcataatggtgtctctggcatcctttgcggcgatacggccgaagtccactgaatctgattcgatctgaactgtatcgccaagcttgtaggaaggactgtactctctggcctcttcgatgcttatctgcttctgtgaattcgaaacctcttctacaaccttcttctgctcgactctgtgagtagtctttatctcgatatttaccgtgtcgccaaccttgtaagagccgtcatactcgtgtgcttcgtcgagggtgatctcggtgctcggattggtaacctcttcaactacagtcttctgttcatagatatgatacgctaatgtatcttcattcaggactacagaaaaattttccgatgaaccaaaagtccgcttgcatgcctgcagcagagcctcttttaccgcatcgaggatttcttccttcgatatgtgcttttctctctctaaaagctctaacgcggtgcgtaactcattttctgccattttttcctccttaaatctcaaaagcgagacggatcatcgctatgtctttcctgtcaaagaccctgtctccgccgccttcgtcgactgtaactgtatcctggtcataagccttgaggacaccggtgaattccttggtcccgtctatggctttgtatgtcttgatctccacctcgcgtccgatcgaattgataaaatccctttctctcttcagcgggcggtcaagccctggtgagctgactacaaatgtgtagttctcccggatgtagtcctctctgtcgaggatctcattcatctcgcggcttacctcctcacagtcatcgactgtaacgccgccaggcttatcgatataagccgtaagataatactcttttccctgcttctcgaagacgacatcccagagcgaaagtccctttctctcaaggatcggagtgataaactcctctgtcttcctctcgtattcctttgctgacataaaaaatcctctacataaacacaagagcggatccttctgaaaaggacccgctctctaaatatcagagatatgatctaatagttcctggcaggatcgaactgccgattacgccgtgagagggcgtcgtcttaaccacttgaccaaggaaccttatattgctcgcgcaacaatgattattatactcggattgatacgaaagtcaagcttgtttttgcatttatataaatacaatttgtaaaaataactgcatcagcttattcagccgatgcagccattgttctaaatcaatccttaaaaccgttagggttcttctgctgccagttccaggaatcgcggcacatatctttaagtgagtgctttgcttcccatccaagctctttctttgccttctcggctgaagaatagcactgcggaacatcgccttcacggcgtggcttgaagctgtacgggatctttactccggtagcttccatgaaattatttacaacgtcgagaactgaatatcctattcctgtaccaaggttatagattccgagtccgacgttctcttttatcttctttaatgctgcaacgtggcctgtagcgagatctactacatggatatagtctcttacgcaggttccatccggtgtgtcatagtcatttccaaaaatgccgagctcaggaagctttccgatagctacctgtgtgatatatggcataaggttgttcgggataccgttcggatcctcgccgataagtcctgacggatgtgctccgatagggttgaaatatctgagaagaatgacattccactccggatctgccgtatgcatatctgtaaaaatctgctcgagcatccacttggtccatccgtatgggttagtgcaggtacccttagggcagttctctgtgataggaatctcggccgggtttccataaactgtagccgatgatgagaagatcaggttcttgcatcctgccttcttcatggcgtcgagaagtgtaagggaaccaccgatattgttgttgtaatactcccatggcttgtgaatagactcgcctacagccttaaggccggcgaagtggatcacacagtcgatgtcgttctctttaaaaatacggtcgagaagatcatggtccaagatatctcccttgtaaaacttaaggtcctttccagtgatctcgcgcactctgtcgagtgatttctcgctcgagttgtagagattatcgataactactacctgataatcgttgtttaagagctcaacgcaggtgtggcttccaataaaaccggcaccgcctgttactaaaatagtcatatatgcctcctataaaaatatatgcactttttaaatctggaattattttataccagagagcttcgcaataatagtaaaatattgtgcaaatcaagtagatgcgaacgacgtcagaagcctgttcgtcatctggtagagttcccagcggtttacggctttaaatactgtcgtaattatctgctgcccctgtttgttttttgaaagcaaaacaaggcagtagccggcactgtcggtcgttccggtctttcctccgacaaccgttatattgtctggaactttaaacttctttgtcttgtacaggttcgtagactcgtatgtcactttctcacttctgccatccgcatgagtcaccgttgccttcatcgaagcagcctgtattatctttttaaactcagggtacttcaaggcattgtggaaaataatgtacatgtcgtaggcgcaggtatagtgattgtcatcatgaagaccgttcgcatttacaaagttagaatgcgtggctcccatagaagccgcctctttattcataagcttcgcaaagtcgctcacagatccgcttatggcctctgcaatagctgtcgctgcgtcatttccgcttacgataagcattgccttaagaaggtcctcgagagtcatcttatcgccagcctttaagtttgcagcagatgagcccgcaggcagatctacggcgtttctgcttaccgtaatgacctgttttaagtctccatacttcagagcacaatatgctgtaagtatctttgtagtcgaagcaggatatatcttcttcagaagattctggctgtagactgtctttccgagagtgtcgttaaatgcaccagccgcatagacagtcttgttgtcactaactccggaagagtcaggaacatactgacagtactgcgagcctaaaagtgaagcggtgctctccttgataaggccgtactgcttggcccttgggatcagcgaatactgctgctttatctcagaagagcagccggtcagaatgaatgcagccgacatgacgacagctgcaatttttccaaaagtcttacttgtacatttcacgccaatccaaatctcctctgtcaagtgccagcacgaggacctcggcagtagccaggttcgtcgccagcggaatattgtgtgcgtcgcacatgcggactatgacattgacatccggttcacgtgacttcggagtcaatgggtctcttaaaaatatgcagagatcgatctcgttgtgctctatcatggctccgagctgctgcatgccgccgaggtgtcctgagaggaatttgtgaacccttaagttcgtggcctcttcgataagccttccggtcgtaccagtcgcatagagcgaatttttcgcgagaatgccgcgatatgcaatgcagaaattctgcatcagtttcttttttgcatcatgagctacaagcccgatattcatacaaccgcctccttctttacattttattgcagatcaagtgtgaaatttctctcatcggcgtagaacttctttgactgaacagagacgttcagcacaaaccccattccaaagtacaacgtcacaagagatgttagtccatagcttacaaacggaagcgtcagtccggtatttggcataagtccggtcacaacgcagatgtttacaaaagtctgaaatcctatagtcgatgccatgccgatacagataagctgtccggccagatccttggccttctttgcggtgcgaaggcactcgaaaactatcagaaagagaaggactatcataagaacagtcccgaggaaaccggtctcctctcctgtcacagcgaaaataaaatcggtgtgcggctccgggatatagttgccgttttttacagaattggccccagtgttcgcaagtccctttccaaagagctctccgcttcctatcgccattatcgagttctgctgctgcatggacttagacggatacttatccggctgaagccaggctgcaattcgatcattctggtatcctgccaggacaccgcccgcatggagagtcaggaaaatgactccgaaagcgccggcggcgataagccccagcaccgctccgacgatctttttcgaaagccctgcatagaagagcattgaaaaaataatgcagaacactactatcgtggtcgaaaggtcaggctctaagactataagcccgagaggcacgaggcagaaggcaatcgttgtaagaagcctctttttcttgttcagatcctcctgatacttcatcagataccaggccaggaacattacgataaatatcttcgcaagctctgacggctggaactgcagcggcccaagcttcgcccagcgccttgcaccctttgacgagtgtgaaagaccagggacaaataccagaagaagcatgaggcacgacaggatatagaacagccagtgcatcgacaaaaacgccgaatagtcgaccatagacactgcgaccattacgatgattcctattaccataccgatgatctgcttattctgatagcttttgttagcgcttcctatgataatgattccgtatatagtcagtgctacgatgaagattacgagtctgaaattatagtttttaaatctgtaattcctaaacatcagatactccctgtaaacggagccgcatcgagctcaccgttatttaaggtaattattatcatatcatttttatttgagaaaaatctctttttctttttgatgctgaaattttctccgacatcaccgatcgtgatattcgcattctcgataccgccagcgataacacaggccgctttgccggtccgcctgccgcaggtggcgcttccgcttatatttcccagacagatcagattgccgccgcactctacgcttccgccttccaggatatctccagtgactaaaacgccataagtgcttgcaatgcgctgttcgggcgacacatctccattcactatctttaaatattcattgctcttttcgaaatagaagttgtccttcttctgggccatctccttttcaaagaagcggtccttcaaggctatgacagtgacagtagcgtcgcagttgcgctctatcgactgtataacggcttctatctcttcatcggaaagacgtctgccctctagagctatagccatcttcgaatccccgaagagccttttcgaatcggcgaatttcctgcagatagatgtcagaagctgctcgatcggaatatccggattcatgatcagcctcagtccgttcttataactttttagaactatatcctcagtcaaaactgtcctccttcatcagtcagtgactgctccatttgatgtaatctcaccggcatcagcctttaatctgtcctcagatgacttgacgtggaagtagcacccgagtatatccttagaaatggctgccgcattgtgcgaagtgtagccgtatgcgatacgagtcgctatagttaccttagggtctgaataaggagcataccctatgaacagagcgtggttcgcatggcccgactgctgtgctgttcctgtctttccggcaacttctatcgggaatccgttaaatgaatcgagattctcaacgaccatcttcattccggagtggattgctgcccatccggacgaattcagagaagtaatctttctcttaagcttaggtttgtaagtttttatagtctttccatcaggtgactcgacatggtcgagaagcgtaagcttgtagacatttccagagcttgcaactgctgtcacatagcgggctaaggcaaccgtcgtatagttgtggtcggactgtccgatcgcagccatgaccgggaactctgtcgcaatgtgtgacttgttctcctgaatctctactccggtcttctctcccaggccgtagagcgaagcgtactttctgatacgcttgattcctctgctgtcgacgtagttgttgtcgcctccggcaagcctccagccgacctcatagaagaagtagttacatgaatctctgatggcttccgaaacgttgatcgttccgtgggtgccagggtatatccagcacttaggcttgttcgaaaccttctcgaatactcccttgtctgtgatcgtagaagcagtcgagatgactccctccgagagaccagctgttgatgaaaccagcttaaaagtagaaccgggtgctgtacgctgctgcgtggcaaagttgtacagtggattcgaagtattctgaagcaggtacgagtagtagctgttgtctacattattcgcgagcttgttattatcataacccggataggataccagcgcaaggatcctgcctgtctttgcatccatcataacagaagagccgctcgatggttcaagtccaagcattccaggagtaagctgcagtttattgatcttatcctttacgaaagaaaatgcagctagcctgccgcttaatagtgcatcccttgtagcctggtcttttttcaggacaccctgatcgtagaggatcgcacagaggctcgagccgctgatctcgtcatttaacagagcatagtgaaaaataatcttcttaaagccgtctgacttcatcacatcgtttacgatataatccgtcaggctcttgtaaagctccgaggaatctacaaatgtctggttcatagaaaatttcgtgtaatctatccagccctttgagaggcagtacttaaggtaagtatatactgaaatcttctcatcagaccactgcttataatatggatcgtccgctgccttcgacttcgaagagagaatcttatcctcgcgaagagtctttatgatgtaggtcgagtactcctggccctcttcactcagactcccataagccggagcattcgctgaaagaatgctgtcctttacaaaacttatcgcactctcctgatgtttgttaaaagcatcgcttacctggtgctctatgtcggtcgcacctttttcagccatcttgtcgatgtctatcaggtcattcttaacaaatgagtagtacacgtcatagaccggcacaaccacattcgcgccggaaccatccgcagggagatggtactccttggtgtttactatctttgagtttaaaatacctgctatctccttttcaaggagagtgtatgtcttcttctgaagtgatttatcgatcgacaggtagacattatctccggaaacaggctttttctcgtctgtgactgaaagcgccttgccctgggaatttgcatagatcttcctgtagcccttctttccggcgagataggactccatgactttctcgatgccggatttgccgacctggtcatttatagtcactgttgaatcttttttatgcttcttcgcatactcttcggatgaaatagttccagtgtagccgataatagacgcaaaagcctccgggtccgaatactttcgcacggtatcatccctgatatcggcacccggcagctggtccgagttctccttgacatagactacagtcttgtcggaaacgttatacgctataggtgtcgacatatactgctggtacctgttcagccagatcttgtagcggatcaccgcgatcttaaagcgcatctcgtccgaatatgaggatgaaacataaaacatatgcctgctgtagagatagtccatgatctgcttcggcgtagcctgggctttattgtagtggagcttgctgtcgtaatttaagtcactgactctcgcttcaccgaacacgtcggccctgaaacggtccactgcacttccactgtctctgaaagagagctttccatcgctcgaacggacgattccgaaatcagtgtcaatggtatccccattcttctcaatattttttataagattgtagataacggcatttagcttcttgtagtggtccttctgcttcgtataggttacggcatcagaaagtgtcactgtataagccagatcgttgtaggcaagaagtctgccttttctgtcgtaaatattgccgcgggcagcatttacaggctctgtacgttcgatctttaaattgtagttcgacctgtagctcgagccgcggatgatctgcagatagaagagtctgcagatgagtattatcataaataatgaaaacaaggcatagagcgtagtctttctcgattcaaaaatccgcccgaaaaaagcctttatttcgtcaaacaattctgcgttccctcctgttgtgaatcctgtccaaaagattgttcagatggtaaaatgggaaatacagtatcagtgcgcagatgaccgtatatatcatctccggcagcatcacatttaaaatatagtacaagacatctgcttttccattcagaaggaaaaagacaccgtagactataaatccgtagaccatatccgttgctgcacagaggatcaccggaagcctgatgctgtcgccgaaatatatttttctgaaaaatccattcagatagcctaagagcatgtaaataagcgcatacgtgccgaacagctggcctgaaaacaggtcgatcataagtcctgcaccaagccctgtaaacgcgccggtctttctgcctctcataaatcccatcatagacacaaggataagcatcagattcggcgtagcggcaagctgcagatgcggcattatggcagtctgtaatatgaataaaagaatgagggcaataaaaattatgccccctctaaaaaaataatatacagctttcattactttccagtcttttttagttcagtgatcacaagcacttcagacagatgcgaaaaatcaacgacaggagttatcgttcctgaactcgtcagtgcattcgtatcgttgtccttctttgcgatatagccgataagaattcccggaaggtatttgcttgaaatgttactcgtaacgaccgcatcgccttcctttactttattcttcgtatccctgagccctgagaaagatataagtccgttcttcctgatctgctctaatccgccggtgattatcatgtcgtcctctgtcgtagagaccgaggcagacacattcgaatcgtcgtcgataatagagcggacattcgcgtagtgctttccgaccgatatgacacagccgacgagtccgttgtcagctatgacgttcatgtcctttttgatgccgtcagcactgcccttatctatagtaaatgtagaaaaccagttgctcgtgcccttcgcaatgatcctggctccggtagtcttgtacttatcgtagtctttagagagctttaaaagcttctcgagcctcgtcagctcattttccttaagtctcgtgttcgtaagctttgactcaagctcatttactttgttgttcagtctcttgttctcggcgagaagctgctttttctctctgcgggagtcaatgccatgcgagatagcgcctcctgcattcgaaaggccctcctgcataggcgtgaaaacatagtccgccaacgcagaaaccggtccgccggagaatccggtcgcaaagctgaaaaacagcaggacgatacagagaagccctaagaacaaaagcactacgtatcccggtatatttatcctgtttttcttgtccattttttaactgaaaatcctcgacttcatcgtgtatccgaatctgtcaaacctgtcttctgaaagcacttttccaaggcctaaagctacagtctgtgttccgtcctctgcaacgatcatctcgatattcgtcatggatttgaagagatccccaagtcctctgatcttcgatgaaccaccggtgatatagatgcccgagtggacgatatccttggcaagctctggtggaaccttctcgaggatcatccttatagacgctccgatattcgacaggtcatccttgatactctgatagatgatctcatctgaaatatccatctcgataggcaggccgcttacgacatcgcgtcctacgatagtgactgtctctgcttcagcaccctcttctgcctctacggcacggccgatcttctcctttaaggacttcgctgtctttctgccgatcacgaggttgtatctgcgcttcatgtaggtgacgatcgcatcgtcgagcttgtttccgccgtaaggaaggagctctgagagtaccagtcccccgagtgagatgacagagatctcagtcgtatcggcaccgagatcaacgaccataacacctgtaggctctgtgatatcgatatcaagtccaagtgcatcggccagcggcttctcgcagagcctgatgcttctggctttgatgtgagtcttcgcgaacatatcatagaaggccttcttctcaacctctgtgatatccgtcggaacagcgataacaatgtccgaaccctttagcttcgcatcgacattcttcgataaaacttcgaggagcatcgtctgcatgttgtcaaaatcagctatgacgccgcccacaataggaaaagaaacatctatagtgtccggagccttctcatacatagagtaggcctcgtctccataggcatacatctgatttccaccgacgatggcaatggtattcttctgctgagttactgtatcagatgcacggctgtatatcttaagatttcccgtgcccatatcgattccgtaaccgttagtcattttttcctcctgaaacatagctcaggtgagcagaccgtgctccctgaaactgtaatacttaaaatcacctatgataatatggtctgaaagtgggatgtcaagaagccgtcccgcttcttctgtcttcttagtgaccttgatgtcggcctcgctcggtgtagggtctccgctcggatggttgtgaaacagtatcacctgagctgccctgtgccggagcgctgagcaaaagagctctctggtcgagtacatcgactggtccagagtccctttaaaaagcacttccttcgagatcacatgcagcctcgtatcgaggagcagcatcacaacatactcctgcttctcgtaccgaagctcctgcatcacatagtcggcagccgctctcgggctttcgatagccggcgattcagctttccgctgtgtaaatgcacgcttcgcgatctgttgcaccgcaagcaggatataggccttagcttgtcctataccctcgatctccaggaggtcttctctcctggcttccatcagcgaatagaaaccttcactccccgaaagtatttccttcgcaagctccagcgcgttcttctcgcgggtgccatttctaaggaccagagctaaaagctcagaatccgtcagtgacctgatgccgtacttctcagccttagtctgtggatcgacatcacttatccattggtttttcttcatctgcgtctccgtttctttctcaacggacacacacgcatacactaagagaataccacatttaagactctatttcaatgaaatttcacccgcatttacaaggtgctgcaaagccataagaataccgaatttggcgtgcggataagtgagaccgccctgaaaataggcggcataaggctctcttaaaggtccgtctgcagaaagctcgatcgacgcgccactgacaaaagtgcctgctgccattatgactttatccgaatatcccggcatatcccatggctcaggctttacgtagctgtcgaccggagatgccgcctgaattccctcgcagaatgcgcagagtccctcaggagtcttgagttctacagcctgaattatatcggctctcttctcatcagcctttggaatgcagttgtatcccaggccctcgaaaatttttgtagcaaaaagagcccccttctctgccgccgcagtaactgtcggcgccaggaaaaatccctgatagaaatctctcatcgcgttaagcgaagctccgacttctcttccgagtcctggagatgtcagacggtttgcggcattctcgatacactctttttttccgacgatatagccaccgatcggcgcaagaccaccgcccggattttttatcaggcttccagccatgaaatcggcaccggcctcgagcggctccttatcctctacgaactcaccgtagcagttgtcgacgaagaccagaacatccggctttatgctctttacaaagcgggtcgcctcacctatctcttctaccgagaacgattttctcgtggcgtatcccttcgaacgctggatttctacaatctttgtcgtatcgtctataacgctccttatcgcatcccagtcaaaagagctgtccggctttaagtccgcctgtctgtattttactccgtactctgcaagcgaacccgggcacggatttaagccgataacgtcgtcaagtgtatcgtaaggcttcccggcaatagatacaaaggtgtcccccggccttaaattcgaaaaaagcgcgagtgagattgcatgcgtcccgcaggtgatctgtggtcttaccagggcatcctccccgcgaaaaacgtcggcatagaccttctctaaagtatcgcggcctacatctccatagccgtagcctgtcgttccattaagacagtcgtacgagacgcgctcttttctcatggcctcgattaccttgatctggttaagctccgccatcttgtcgatcgcatcgaacctgtctttaagctctgattccgccctttcgccgagctcaaagacctctttgtcaattcctgcctctttataaaaatcacttaagttcatctgctttttcctttagtttcacaagttcattcatggcatcaacaggtgtcatgttgtttacatcaatcttctgcagtctgcctataagctcatccttcgcttcagcgtccctgtccactgtcccagcttccggctcagaaaaaatatccgaaaacgagatctgtccctcgataccgtcatccacttttcttgcgcttctggacttgttttcaaggtcttcgcgttcgagcttctgcgatatttttctcgcgcggcgaagcaccggggccggaactccggcgagttttgcgacctcgattccgtaacttctgtccgcctctcccggaactatttttcttaagaacgttacatccttgccctcttcctttaccgcgacacagaggttgtggatgcccgggagcctcccctcgagcgaagtcagctcatggtaatgcgtagcaaagagagtcttcgcgccgatttttttcttgtcgtttacatactcgacgacagcctgcgcgatagagaggccatcgaaagtgctcgttccgcggcctatctcatccaggatcacaaggctcttttccgtcgcgttctttaaaatattcgcgacctcgttcatctcgaccataaatgtcgactgtccgctcgctaagtcatcgcttgcgccgacacgggtaaaaatcctgtcgacaattccgatgtccgcactgtctgccggcacgaaaaatccgcactgcgccattaagacgataagcgctgtctgcctcatatatgtggactttccagccatattaggtccggtgattatcgcggtcgtaaaatcatcgtcgtctaagtaggtgtcgtttgcgataaaagagccgtccgggatcatcttctcaactaccgggtggcggcctccctttatatctatgactccgcgttggttaatagaaggccttacatagtggttcttctgtgaaacatcagaaactccggccagaacatcgagaacgcttaccgcctcagctgtccgctgtatacggacagccgcgtcgttaagtttttccaggatctggtcaaagatctccttttccagagtcacaagcttatcctgtgcgccgaggatagtgttttcaagctctttaagctccggtgtgtagaacctttcgccatttacaagagtctgttttctgatatagtcgtccgggaccttgtccttaaaggagttgcttacctcgataaaatatccgaagaccttattgtacttgatcttaagctttgaaattccagtcctctgcctctccttcgcctcgaggttcgaaagccactgcttgccgtctgtcttggcctttctaagccgatctgcctcttcgttgaagccctcttttaaaattccggcatcgtggacagtcgcaggcgcatcctcatcgatcgacgcctcaagaagctctcttaagtcatccatcgggtcgatctcgtcactcagctcctttaaaagctttgaattaaaacctgcgaggagattttttacagggccgagcggagttatggaatccttaaaagccagaaggtctctcgggttcgcactcctgtaggaaaattttgtgagaagccgcagaaggtcatagacaccggataagtactctcttatctcttccctgtcgaccatcgactggttaagctcttcaatcgcatcgagccttttttcgatctcgtccttatccagaagaggatgctcgatcatatttttaagcttcctctgccccatcgctgtcctggtgtggtctaagacccagaaaagcgagccccgcttctccttctcccgcatcgtctcggtaagctcaaggtttctgtatgtcgcgttgtcgatgacaagatattttcctatggaatacggatggatctcattcatatgcgagaggtcattcatctgcgtatcgagaaggtacgaagtcagcgcgccgctcgctatcatctcttccggatggccggacagcccgagcgcctctgtggaatagactttgaaatggcgcttcaggacattttctgcattatcaggtagaaaatatgacctgtcagcctcagaacagagctttttcttctcagtctgctcatcgaggaaatcctgatagaggcttgaaaaggcgctgttgtatatgaactcggacgggtcgtactttaagacctcgtccgaaactttcgtgatatcgtccgcttccgtcgtgtaaaaatcaccggtcgagacatccgcaaatgcaatgcctatagtccgcttgtctttacagtaaaggcttgcaatatagttgttgtcgccgtcattttccccgccgctaaggtctgtccccggtgtaactattcttattactccgcgttttacaaggcccttggcgagcttcgggtcctctagctgctcgcagatcgcgaccttgtgaccattttttacaagacgggagaggtaggtgtccacagcatgaaatgggacgccgcacatcggcgccctctcttttaagccgcagttctttcctgtcagtgtcaggtcgagttcctttgaaacgagcttcgcatcgtcgaaaaacatttcgtaaaaatcgcccagtctgtaaaaaagtatgcagtccttgtattgttcttttgttttcaggtactcctgcatcataggagatatttctgacattagttcactatcctcttaaatctgcggtcaagctcagcctttgtgatgcgcacgaccgtcgggcggccatgcgggcagtgatatggctcatccgcctgcatcatttccatgaaaagattgtccatctctgtcggagagatcggctgtccgccttttacagcggctttgcaggacatcgtggcaattttttcacggactatttcagggactttctcgtttccccagtcgtctatacccttaagcacatttgtaaaaagctcctccgggtcaatttctaaaagatttccgggaacggcttcaagcgcgacctcagtctctccgaagtccgaaattcgaaatccaaggtcacaaaacgcatctaaatggtcgaagaccgtctgcttttcctgccgcgtcagcgtaattatgattgatggcgagaccatctctgaggtcatctcacgctctttcagctgccgcataagcctctcgtaatttaccttctcatgcgcggcgtgctggtccaccagaaaaagtgcgtcgttgtactcaaaaatccagtaggtgtcaaacgcaagccctataagtctgtggtttatcgcagactccttcgaaataaatgaggtctgctcgtatttcggcatgcttgtcttctgtgtctgctcgtatttcggcatgcttgtcttctggtccgcaataaacctgtcgacttcggatctctcgtattttttctcatatggtgagtcgtctgcgatctgctggactatcgcgtcttttattgcgttaagtctctttttttcaaaaggctcaggagcctttgccgcgtaatttgctgtgtcagattgtttcaaagcttcagcagaaaggtcttctgtatccctgtccgtatcgcctccggtgtaggctctgtgcacagtctctgacacaagtttatagacaagaggctcatctagaaatctcacttcctgcttcgtcggatgcacatttacatcgacaagcggccgatcaaagtcaagaaaaattatcgcaaacgggtactggtgcttcattacgaagccttcgccaccggcctcgagcgccttcgaaaggaggctgctctttacgagacgcctgtttacaaaaaatatctccatcgtgcggttgccgcggttcagctcgctttttccaagaaatcccgagatgtggactccctcaatcgcactgtcaatttcgatcagatggttggctatcgacctgccgtagacacagtagaccgcgtcgagaagttttccgtcaccaacagtcacaaacttttcctgcttgttcatgcggaacttgaacgcgatatccggatgcgaaatcgctagtttttctaagaggtctctgatatagttgccctcagtcgcaggactctttaaaaattttctcctggccggagtgttgtagaaaagcgccctgacaataaatgtcgtgccgtcaggcgtcgccttcgactccctgtcgatctcttttccgccctcgataatatagtggcagccgacgaactcgtcttctgtcttcgtaaagacttcgacctttgaaactgccgcaatcgacgacaatgcctcgcctctgaacccgagcgagccgatattttcaagttcgtccgcagtccttagcttactcgtcgcatggcgcagaaaagccgtctcgatctggtcttccggaattcccgaaccattgtcggtaactctgatcaggtcgatcccgccgccctcgatctcgaccgaaatcgccgtcgctccggcgtcaattgcgttctctgtcagctcttttataacggacgccggccgctcaacgacctcgcccgccgcaattttatcaatgacactctggtctaattcttttatctctctcatacctgctaattataacctatttgtccaggttgctgtcctttttattcctggctgaaagaaccggtcacggcttctgccaccttgatcccgtcaattgcagcagatgtgattccacctgcatagcctgctccctcaccacacgggaagagtccgcgcaggctggactggaagctctcgtctctcggtatcctgacaggactcgaagtccggctctcaactccgctaaggatcgcgtcgtatctggcgaaaccgtggatcctcctgtcaaaaaagtccattccgttaataaatgcctgctcgatctcaggcgaatagatgcctcttaagttagcaaaggcgtgtgcccccttcgtcagcgactcgaaatcgccatacgaagtacttaccttattttctttaaaattcccgtaaagctgctgcggaatttttccccggcagaggtcgtatgcctttttttcaatggagcgctggtaagcgatggccccaagcggatcgttcatgtcgtactctcccgcgccgacagccacaacaatcgctgagttcgcattggctgaatcccgcctgtagttgctcattccattaaccgcgagcctgccttcctccgaggaggcatttacgacgaagccacccggacacatgcagaatgaatagacacctctatcgccctttgagaatgcaagtttgtatggagccgcaggcagaagttccgctgccttgcttccatactgcgattcatctataaatttttgcgggtgttcgattcgaaatcccatcgcaaactgctttgcagtcatcggaatgtgctcttcgtagagactcttgaaagtgtcacgggcagaatgaccgatggcgaggatcactgaatctgtcggaatgatatcttcatgcagattctgcccggaagaattctcagaaacagtttttacaccggagacccgtccgtcctgcactataagccctgtcattttggtttcaaatctgacttctccgcccttttctatgatggctttcctgatattcgagacaacatcgataagcttatctgtcccgatatgcggctttgcctcgtagagaatctcaggcggcgcaccgtactttacgaaagtctcgaggataaaatggttccggccatttttatcgtggactccggtattaagcttcccatccgaaaaagtgcctgcaccgccctcaccgaactgcacattgctctcgggatcaaggactccggtctcaaaaaacttttcgacgtcggctcttctctcggaagcttgttttcctctctccaatataactgggcagagtccagcctccgaaaggatcagtcccgcaaaaagtcccgccgggccaagtcccacgatcacaggtctcctgcgtccaccgagcgaaagacctctctttacattgtatgttttcttctggtactctgcgatattttttatgcggtgatttttaagaatcttcgactcgtcaccttttatccggacagcaatctggtacagcaaaaagacatccggcttcttcctcgcatcgatggattttttcaggatgcaaaggtccgtgatgtccttctttgaaatatgaagcctcttcgcagcctcgcgaagaagcgcctcccggctgtcctgctccggactaattttaatctggtcaatttgaatgctcatgagtgaaattatagcacggcttgtaaaattagtctagaaagatcatttttgcagccatttcaatatagaaaaaaacagtattaaaaaagctgaataagcctcagtctttgccgtgcagaattggcgacagtctcttgtagattaagaacgtgatcagcacatcgatcatgcctttaacgaaggtaaacggcatattgaagcatacgatcgactgctcgacagatttcatcgaagggatgatggcctgataagcctttaagatggcggccttatccatgaatttgtagtagacagggtagacaatgaaaatattcgaaggaatgcttactgcagccatgccgatcgagccggcgaaagaggcgatgacggccctttttttcgtctttttaaggttgtaaatgatgccggcgatcgcaacaaaaacggcaccgagaatgaaatttgaaagctctccgattccgccggaggatgacactgcaaggtgcagcaggtttttgataagttcgatcaaaatgccatagacaggtccgattgagaaggaaccgagcagagccggcagatctgagaaatcgaattttatgaagcctggcatgataaaaggcaccggaagctctataagctgcagtacgaaagcgaggccggaaaggacaccggtgacggcgatgttacggacatggcgctttgtgctgttatgggtggttgtatttgacataaaatctccaaaaaaagtgaatattatgatctggtggtcaaaagattgaccaccaaatcatgatatagttttctgcgaaaaattcagcgcagattttaagcattcagcgcattatcgagatctgcgatgatatcatttacattttcaattccgaccgaaagtcttatcatatccggaagcactccgcaggccgtaagctcgtcatccgtcagctgtctgtgtgtgctggtggccgggtgaaggacgcaggtgtgtgcatctgcgacatgcgttgcgatgatggcgagtttcaggctgctcataaatcttgaggctgcctctcttccacccttcacgccgaagctgatgacaccacaggtgccatttggcatatatttcttagctctcccgtaatacttgctgctctttaagcccggataatttacccatgaaacatgctcgttattttcaaggaattcagcgactttccgggcattttcacagtgacgctgaacacggactgcgagcgactcgaggccaaggtttaaaagataggaattcatcggagacggagtcgagccgaaatcacgcatcagctgtgcagtagcttttgtaatgtatgcgccctctttgccaaatttttcagcgtaggtgattccatgataggagtcgtccggagtcgtaaggcccgggaacttgtccttgtgcgccatccagtcaaattttccagaatctacaatagcgccaccgactgtggcgtcgtggccgtccatatattttgtcgtggagtgtgtgacaatgtcgcagccccactcaaacggccggcagtttatcggagtcgcaaaagtgttgtcaacgataagcggaaccccgtgtgcatgcgctgccttcgcgaaacgctcgatatcgaaaaccgtcagtgacgggttcgcgatcgtctcaccaaaaactgccttcgtattcggcttaaatgctgcctcaagctcctcgtcgctgcagtccggatccacaaaagtaaaatcgacgcccatttttctcatcgtaacattgaaaaggttgaacgtgccgccgtaaatggatgttgatgcgatcacatggtcgcccgccgtagcaatattaaaaactgcaaaaaagttcgctgcctgccctgaagatacgagcatagctgctgtcccgccctcaagcgctgcaatcttttttgccaccatgtcattagtcggattctgcagcctcgtgtaaaaatatccgtcggcctcgagatcaaacagttttcccatgtcctcactcgtgtcgtacttgaacgtagtactctgaatgatagggatcatcctcggctcaccatttttcggcgtgtaaccagcatcaatacatttcgtttcctgttccatttgttctccttttcctttgtttcctgctctaagaaaaatattctacaagtaacaatgctatataaagatttggtggtcaacaggctgaccaccaaatcattatattatttctctgctgtaaaataaagactaaaaattatgacatagttttcaatatggagctcccgcggagcagaaaatcggatgttcatcttaatgcttaaaaaatttcttcctaaaagccccgatcacatcagttttttcgcatgttcccttcggaatctggctgagtgctggaaaatggcgccagtacattataagagaaagagcaattgcgataagcccggcttccttcccgtagaaaataacggtcggaatgatgaaaaatgcaggaatcacaatggctccgacgcagaggtactgtgtcgcaaatacgacaagcattccgactgcatcagagatcagaccccagaacggatttatgataaaaacagccatgcaggtgactgctactccttttccgccgtggcgcggctggtaaaacgggatgttgtggccaagtacgagcccgagcatcgtgtagtagagcgccagatgactctgatcaaatgcgaaatgaacgagaagcatcgcagcgatggtcttacccaggtctccggcgagtacgatgattccgggcacaaaaccaaggtgcgccataacatttgccatcccgggatttccagaagttcctagttcacggcagggtcttccggtgagacgccttgtaacgatttcagccgtaaggaaactaccgaaaaaatatccgatgatcagacagataattttattagtcatcacgatcactcctcataaaaaatatccctgagactttccactgactccgccaacgcattctctttttgttcggcaagtccccgatcaaaggcactacgatcagatacaacccgctttacttttgcaatcatctgatctacgtctgtaaaaatttcccgcggagccagatatcttctcctgtgaagcgtcttgtcgaagcccataataagctggttattcaaaaatgctctcctgacagatgcaaggatctcatttccatagttgatatcaaaatacagatcgcatttttcgaacagttcatctgtgacatttttcctgactgtcgggtagagccttacattttcaaaatggccgaaagccatcagctttcctgacatctcagtcacagcagcaatattgaaagtaatctcaggaagagccctgacaagaggctcgagcgactctatctgatctgaatttgtaaaaataagggcatttttcgtgtggttgttttcgcggacaaaattgtagacaaagccgaacgggcgcaatattttaccagatgctcccagtgagataagacggctgtaactttccctgttctgcacaaggatagagcctgtctttgtaggaccgttaaaaatctcctgcatatttccagggatatcgtctctcggaccttcctgccagaaaagcacattttttcgtgaattactgcctagtttctcacttacgaagagcggggtcgacagggaattgtagaaaatacgctctccttcgacaccgatttcgcgaagcatctgaacagtcaggtcggtcagatttctatagagttctgtctttttgtcacgggttacaataatgtctccggtcactaaattttccacaattttttcccggtttttttcatcaaaccaggtgcggcagaacctctcgcccctgatgttaaaagtcgttctcgaaaagagcctgccgtgattgtcatagtggtcggtaaagcggacatttccattcgggccaaaccagtcgacatcgcttacaaaccggttttcagaggaaagatggtaatacatcctgccacgcagattatgaagatcatgaatttccccatttaccagagttgaagtgatctcccagtaatccggaacttcgatctggtcaaaaaaacgcggacgtcccggtttaaatccctgatgatagagagcgtactcctcttcactcatggtatgatatgcccctgtcttctctgaaggctcagacactttctctttatgctcaaaagtaaactcattttcgcggtcttttgaaaaccactctctgactgacatcacttcatccggcagaaatccatcgtcatgtatcacaacgaccggcccgcaaaagcctgctgcctgaaaagactgcgcaagcatctgcgcctgctcatcaaagctgtcgagaagcagaacgccgtctacactgccgtctgatttattttttatcggatcacgtctttccatttctgcatcaccttttttgtcaggaaattttcagctttatcgtatgaagccttttcaaaagcgctcctgtcggcctctgtgaagtacttgactatcgctcttcgaaggccttcgatatattcctgcggcgacatctcctcgtcaaccggaaccagatagccgttttttccatggtctataaaagtcggatttccgtatggcacatcgaagccgactattggaagtccggctccgacagcctccataaggctcagcccgaatccctcgctcgtcgaccccgatacatagagctcatagttctgatagacatcagtcatatcgtgctggcccaccagatgaatataagaatcagcttttctctcggtgatcagcttctcaagagcttcgccctcttttccttcgccgtaaatatcgagtgtcagctcctctgcctcttcatgcgccttgacgcaggcttctatcacccagtcgaggtgcttttcagtggcaagccttgaagctgttacacatgaaaatggcctgcggcctttttcaggaagcgggtaacgaagtctcgagaggcttccgaccggaattgtaaccacctccggagcctttccgacatatttcttaaactgctctgtcatcacatcccgctgggcatcggtagaggtgataaaaaagctgatatggcgagccatatcaaatgtgtactcgtaaaaattattccaaagaatgtaatcgtcatttgaacttcccgggctgtagtgctcagcgtgaacgacgattccgatgcgggcatatccgcagttttcaaggatcgactgccctatgcccgtggtcctgtcgattatcagtgtatctttatctgtcaggttaaggctctttacaaaatacccgacgaattcctctttcgagtaaaaaatatggtccgggaaccggaacatcatatttccatcatcaatcatctgttcatacgcagtcgaaccatctgtattgaaaaaacgtctcagatagaggtgcgccgagccgttgagcggcgcatagtactctgaatagattcgcccgtatgtgaaataatccttcctgatcaggtaaccgtgcgaaacatactcgacacggtgaagttttctttcctcctgatctgagaaataaagcgtcagaaatttatcttcatgattaaaaatgatccgcgcagtctttccattgcggaccaatttatagtctttgtcagagagagtctcttcaaaatcaccaagtgtgtatgtgactggagctgttttaaaatcagtaaaataggtatagagccagattacttcatcgtcattgaatccgatatttgccgtgaagtgctcaatattttcctgtggaaacatgtcggtaaatataaatttagccggaagtcccaggcctctgaatatcctggcgcggtagagctgtgcgtattctacaccgcttgaagcccagcctatacccagattaaaattgtagatcatcgctgttctcctgttacgggaatataatcttcatccgagaattatgggaaagtaatcttcatctcgccgtctttatcaatctgcggatcgcctaggaagaaatttctcgcgatatttttcttcatctcgaccttcatatcgttaaacgacttgtaggcctcacggctgtactcgaagatcgggtttctctgtgctgtgcctctggtcgtgatgacgaactgcatctgctgaaggtaatctacctcttcgacccatccgtcgtctattgctgtaaggaaacactgtctggtgtattcctggaagtcatcgtcatttttaaaagacatcgctttcaggtcatagaggcgggcagctatactctcgagcgtctctaaaagtttcttctggtcctttctgctgtgcccctcaatccttatcgcatcagggatcgactcataggtcaggttgtcaaggatatagcggttcagctcagcatctgtgatatccggattatttttcacaaaaagtttcagattgtcgtttacgatgctctgtatcgtactcttttcaatcgaggccttatcaagaagcctgtctctcgctgcatagagaatctcacgctgcctgcgcagtatttcgtcgtaccttacaaactgctctcgtgaagaaacgccctgttcctccattgtcttctgggcgccgtcgatcaaatgctttaatccgaaatgtgaaatattccgcctgccggagataatgctctcggccttttccctgttcatcgacttgacgacttcatcctcgagcgagacgaaaaactgtgaagaacccggatcaccctgtctgcccgctcttcctctggcctgtctctcgagcctgacattcttcatccggccgataccaatgactgcaagtccgccgagttctatgacttttttctcaggcttgatatcggttccgcggcccgccataccagtggagacggtaacggcattgtgctttccggcagctgctatgatctctgcttcccagtacgcgttgtcggcgtttaatacgctgtgcgggacgccttcttttacaagcatccttgaaaaaatctcggtatcctggatcgtagcggtaacgaccagaactgcctggcctgtcttgtgtatcttcaaagtctcctttaaagctgccttgtactgatcctcggcacttatgaaataacggtcctttttatcgactctccttacttttctgtgaggagggatcacaagcactttcttgtgatagacagttcgaagctcggttctggcatctgagatggtgccgctcatgccgcacattttaggaaacatcagaaacagattctgatatgtgatcgacgcgacggacctctgctcctgagtcagtttcaaatgttccttctgctcgagcgcctgatgctcaccgcctctcaacttcatgcccggaaggcttctgccggtactgttatcgataaggacgatttcgtcgttgtcagatactacgtaatcatcttcgttttttaagatcacgtgagctctgagagcaagagtcacatgcctgttcagttcgaaattttcgtgtgcgaaaaaattgtccacgccaaaaaatttctcagcgtatctgactccgcgctcagtaagccagaccgatttgtcctcagtctcatagtccctgtcttttttcaaggtcgaaacgaagaaatcagccatcgcatagaggttggactgcacccttggggaacctgaaattacgagaggcatctgtgcgccgtcgaggagcaccgaatcagcctcatctattatgataaaataaaaatcacgtaaaaagcggtcttccgcccgctttacgaggttatttaacaggtagtcgaacgccagaatgctgtgcgtcgtatagaggatatcggcgttgtagttctcgcgtttctcgtcatttgacaaaaactcgcccggcttctgcgtaactcccgcgcgctcagtaagtcccatgaattcaaacgccggacgcatttccgcagcatcacggtatgcgaggtagtcgttcgcggtcacaaggatagtgctcttgcctgtaagcgcattaaggtaaagcggcatagtagcggtaagagtctttccctcacctgtattcatctcagcgagatagccggcatccatagctaaagcgccatagatctgcacatcatacgggtattttccaaggactctcctgtccgcttcacagatagctgcgtatgcctccggaaggatcgccgaaagaggttttccccttttcagctgttttttaagctttggagtctccgcctgcagttccttgtcactcaggtgtttcatccttattgcctgaagctttacttttctcagcagattttttaactgtttgtctgccatatcaatccgttctttctgaaatcgtaaacgagtgaaaatggatctcgtgcgcacctgcacagatgagctgtgcctcgtagctgtacgtcttcagcggacacttgaaatccatctcggagtcttctacaacgagagcccctgcttcatctccattttttccaaaatataccagtcttataaatgctccgccgggcacatcacagtctatgtcgactgaaatgtgatagctgccctcaccgtcgattatcggcagcgtcggctcgattctcccggcctgaaaattcaccatcgaatgccaggtctttatagccgtaccaggaggcacgagcagatttttaaagaagacatcgtctttcgataagaatctgagctcagtaccatacaggtaggtatcactggcatattcattccaaagtatcttccacttattattaaattcctgactctgatctgtttgatctgcagtcttatctgccatatcagtcctgcttcctgtcatatctgtcatttaaaatcctgatgtactgccgtatgaaccagtttacaatgcccgaagtatcgtcgttgtgacgtccatgcaggccttttcctatcactttcgcacctctcgctctgacatgggagagcagctcctgatatgcgttcgcatcgtaatcatcctcgatcatgtatgctatacagaatgtccggtcagtcagatcggaattatcaaacttatcccagaacctctgattcaaaagggcaacatcattgtccgtcaaccctttataatttttccagagaagatcgagcgaagtcgggaaaccacccggccggatgattctctcggcttttgccatatttccaagggagaggagcggttttccggctatgatataggccggtctgatatctattccatagtaaaatgctccgaatgttcccattgaaagtccagacagaatgacctgatcagagctgaacccaagcgtattcatcgcatcctcgatcaattttacgagttttctctcgtattcgtgacttccgatatagaacgctccaccctcaagtctggattcgctgataagaaggaacgggactcccattctgcgcatcatatggtatccctcgaagccctccatcgtcttgtatcctgagaaatatacacagagaggcggtttcatatcacccggatcaaaatatgaaaatacttcttcccggttgaatgtaacttctcttctgctccccggcagaaaatctccttctccgtgcctcgaatatctgtcgtgcagggctatgatctcaagctttccatgtccctttgcattgatcgatgcaaaaaccggtccgtcctttttcatatcttcgactgtgacctcatgattcagttccttctcgctgaatttccagatattctgtatcgatgaaacgcttccagctgcaaactgaactatctgaagttctacctcaatacccgggtcctttttatactccagccagaaatcaattccctggcctgcatctaccgggatattgccacgccagaaagcggcctgactcatcttttcgccgaaatcgccctcaagaattatctctgaaaaaccattccacgagactgatcctttaaatcccggcgccggcgtaaatgtatgaggctcgtacttttcaccatatggccttccaaaatagtccttaagcctgttttcaaaaaaaggtacaagttccttgcgctttattgtccttccacacctgcttttcatcaggtatttcattttatttgtcataaagacatcgtctactataaacaggctgtgggccctgactatcttagaaagtatctcggcctcttcatcctttaaattcctgtctataaatgcaatgtcgtattctttatcttctaaactgagctcgggctcaaagttccactccacgtacggttgaaaagaaaacttctctgagaaatcctggtcaccgagctcaagtgctctaacgttcaacgctctctatgacctccttccaggactgtacgagtttgccggtagaatagcttccgcctagtttatatgacgcgatctgtgcgttatttacatttgttatactgctaaggtaataatgcatagaatcggcaagttccgagagatcatctatgactataccattctttccattcttgacgtaatcagtttcccgaacagtaatctgagggattcccatactcatcgccgaaatctgcaggaactgatccgggacctcctgaaggtcgactatgatacgctgctcccgcagtgtcctgctgaccgagagctcatcgacacactgcgccaccgtaaaaatctttccctcttcatcagggctaggataattttccgatttgtcgtcagtatcgatgacgatatccggatccattcccgctgcagaaagtgcgtccttcgtcttgcggagaaggcgcctgctcatgtcgtacctcgaagatcttgtaaacagtactatcctggcctttttatttatattgatgatgtagtctgcaaaaataactacgagtttgtcgaagacttcatccgggatatcatcaaccgccaccagcacgttctggacacgcagatggaggctgtcaccaaattccttccgtgaatcataaggcgtgataattcttaaaggtttatctgccgcctccgggaactttttaattttttcctcagtgcttctctcatcgaccactacataagaagcttcttcaaggagttttttatcagcgtcatttacatttgccttttcgttttcgattcttctggcaaaaaatgacagcacgacttttctatcggacagtgtctctgcaagaactcccgcatgcagcgggtgcgctgccactatgaaaatatcagaattcgtggtctcacgcagattttcctgaagaacctctgcgatcacctgatcgatactggcataatttttcttcttgtaggcagcttttaccaggttatgtccaattcctgaataataccagttgctctcaggatttatcacgacatgcccgtcatttaaaaagcgcgcaaatttccatacgccttcggaattgaaatactgctctctgtaaggcagcccgttttgatagacgacctgaagtgacataaagcccctgtcatcgtagtaattgctgctaacctgctcgtcatctttatacatgtcgacgcggaacatgttgccatcctccgcgaactcaatctgggcaaatttcttctcgtcacgccttacgataacagcgaacggagaatatataaactcaacatcgtccggccaggtcagatcatgaaacgaaaacatgcttatctggtgcatagaaataccctgcatcgcgtcaaagcatgaccagtatggcacgtgataaacaccctgtctgtgaagatagtgtctgaaatttggtgaaaatccaagcaggagtatcttgaacggggcaacatgtttcctgaaaaaaagctggatctgctttaccgtatcgtcgaattctgtgaccgttctcgaacggtaccagacctgttcgttttccttccagtcattgttttgataccaggctggaataaaatactgcataaaatctcctcttcaaagtttctgaaaaaagcgtttacataaagaaactgtaagcgtcgtacctgtaataagtgccggtctcctgtacaaaagtgcagatgatacttacaagtatcatagctgaagacgggagcatagcgagcgccaccggaatgactttttctaatgacatgataagaaaaagcgccatacatcctgtctgaagaattccactgataatgctccacttcacaacgatctttacaagcagtcttcttgtatcttttcccgcatagacaccaacaatactgtcaccatttttttgaagctggtgggcgctctccattgggtttaacatgataaaggagaagatgatcgtaagcagaaaaacaattatcagatatattttcactccaagaggtctcgtcagcaccataccatccaggatatttgacaatgtcttattctttggaaaaataaatacaagcagccttacaaagtactgtggcacgagaaaggctgccgtagcaaacatgaccggtaaaacacctacagggttacgcttgtaggccatgtaattctggtccgcatgtatgttgtggattgaaactctctggagcggaattttgatgatcgaattttccagaaaaattgtccctgctgtaacaaatgcgattatcacaaacataaaaggataatgccagaaatggttcaactgcagagtctctgccagcgtagtgataacgttaaacataattataggcatcgatgctccgatgccatgtttctcatttgctgaacaaagataaaaagtaagcatcgccccgccaaacagctcgagtgccgcaataatcattaccagaatcttcgggccggcatcactgcggtatgtaaagctggtcgcctgagccacagccatcaaccctgagatgatgactgcggctataagcatccagcggtcctgtttttgtttggatatttttgcacggctgtttgcacttttcaatgcagagataacctgtaccagaagagaagcgttgatataaggcataacgccaagcgccatcactgtcttctggtagcggtcgccactgaaaaatgatgtaatgtatgactggactcctgtttgctgagcctcgtctcctgccactccatacaggacgatactcttccctgctacatatatagccagcataaaaaatgtaaaaaatattcgcttatacaattcgtgtttattttctaatttcatgctgctaaaatctctctactcattcaataacaaattcctgtcaacgttctattacctgaagtggaacaaccccgttcagtgattcaatctcggatgccacatcagttgccgttccagctactggtgctgtcttcgatgcacttgcggtattatcagtctctgtagtgctctgtgctgaagtattgcttgaaaggttgctcagcgactgctcagctgacatcctcaggctgtttgaagcactgttgctgttctcagtctcagattcagatgctgctgtcgatgcagatgctgatttactctcactggctgctgcacttgcactatcacttgagcttgctctctggctggctctgacacttctcgactgggactcagaaatgctctcgcttgaagatgcacttgtaattgaaggtcccgaggtatccccgccagttgtattgccatttccaccatttccatttcctggatttgctggcgttcctggaacagcaggtgttcctggtactgctggcgttcctggaacagcaggtgttcctggtactgctggcgttcctggaacagcaggtgttcctggtactggtggaaccggtgttggcgtaggcgttgttgagttacttgtcgattcacttgccgaaacactagtgctctctgatgtgcttatgctgcctgaagcacttgcactatccgatgcgcttgcactagtcgatgcacttgcactgatcgattctgattcagtagtcgatgtgcttccagatcctgattcacttgtacttggcgaacccgatcctgactcagaggtcgattcacttcctgaacctgaaccacttgtacttgttgaacctgaacctgactctgaactcgattcgcttcctgattctgatctacttgtactcgttgatcctgatccagatgcagatgtacttgctgatcccgattcactcgttgatcctgactcagaggtcgattcacttcctgagcctgagccacttgtactcgttgatcctgatccagatgcagatgtacttgctgatcccgattcactcgttgatcctgactcagactcacttgtactcgttgattctgattcacttatacttgtcgactctgattctgactcacttgccgatgtactttcagactccgatgcactcgttgattctgattcagaggctgatgtactttctgattctgattcactcgttgactctgactcacttgtactcgttgattctgattcacttatacttgtcgactctgattctgactcacttgccgatgtactttcagactccgatgcactcgttgatcctgactcagatgctgatgtacttgccgactctgattcactcgttgattctgattcagagactgatgtactttctgattctgaagcactcgttgactctgattcacttgtactcgttgactctgactcacttgtactcgttgattctgattcacttgtactcgttgactctgactcacttgtactcgttgattctgattcacttgtcgatgtcgacgtacttaccgattctgattcacttgcactcgttgattctgattcagaggctgacgtacttgctgactcggattcactcgcactcgttgagcctgattcacttgccgatctacttgcacttgtagactctgactcacttacactcgttgattctgattcagaggctgaagtactttccgattctgattcactcgttgattctgattcagaggctgatatactttccgactcggattcacttgttgagctcgactcacttgccgatgtacttgcactggtcgactcagattcacttgcactagttgattctgattcagatgctgacgtacttgccgactcggattcacttatactcgttgattctgagccagataccgatgtacttgcggactcggattcactcgttgattctgatcctgatgccgatgtactttccgactcggattcacttattgagcccgattcacttgccgatgtacttgcactggtagactcggattcacttgcactcgttgattctgattcagatatcgatgtacttgctgactcggattcactcgttgattctgattcagaggctgacgtacttgccgactcggattcacttatactcgttgactctgattcagattccgatatcgacgtacttgccgattctgattcacttgcactcgttgattctgatcctgataccgatgtacttgctgactcggattcactcgttgattctgattctgaggctgatgtacttgctgactcggattcacttatactcgttgattctgattcagattccgatctacttgtggacgttgagcctgattcacttgccgatgtacttgccgactcggattcacttgtacttgccgattctgattcacttgtcgatgtcgacgtacttaccgattctgattcacttgcactcgttgattctgattcagaggctgacgtactttccgattccgattcacttgcactcgttgattctgatacagataccgatgtacttgccgactcggattcacttgtacttgccgattctgattcacttgccgatgtcgacgtactttccgactcggattcacttatactcgttgattctgattcagatgctgaagtactttccgactcggattcacttgcactcgttgagcttgatccagatagcgatgtacttgctgactcggattcacttatactcgttgattctgattcagatgctgacgtactttccgactcggattcactcgtacttacggattctgattcacttgcactcgttgattccgatcctgataccgatgtacttgcggactctgattcactcgttgattctgaggctgatgtacttgctgactcggattcacttatactcgttgattctgattcagattccgatgtacttgccgactctgattcactcgttgattctgattcagatgctgatgtactttctgattctgatgcactcgttgactctgattcacttgtacttgtcgactctgattcacttgtactcgttgactctgactcacttgtactcgttgattctgattcacttgtgcttgtcgactctgattctgacgtacttgcagattccgactcacttatactcgtgtcctgactcaattccgatgtacttgccgactctgattcactcgttgattctgattcagatgctgatgtactttctgattctgatgccctcgttgactctgattcacttgtactcgttgatccagattcagattccgtgtacttgtcgactctgattctgaagcactcgttgattctgattcaatgctgatgtactttctgattctgatgcactcgttgactctgattcacttgtacttgtcgactctgattctgatgcactcgttgactctgattcacttgtactcgttgactctgactcacttgtactcgttgattctgattcacttgggcttgtcgactctgatctgacgtcttgcagattcagactcacttatactcgttgatcctgactcagattccgatgtactgccgactctgattcactcgttgattcgattcagatgctgatgtactttctgattctgatgcactcgttgattctgattcagatgctgatgtactttctgattcggatgcactcgttgactctgattcacttgtactcgttgactctgactcactgttactcgttgattctgattcagagactgatgtactttctgattctgaagcactcgttgactctgattcacttgtactcgttgacttgactcacgttactcgttgattctgattcacttgtgcttgtcgactctgattctgacgtacttgcagattcagactcacttatactcgttgatcctgactcagattccgatgtacttgccgactctgattcactcgttgattctgattcagatgctgatgtactttctgattctgatgcactcgttgactctgactcacttgtactcgttgattctgattcacttgtgcttgtcgctctgattctgacgtacttgcagattccgactcacttatactcgttgatcctgactcagattccgatgtacttgccgctctgattcactcgttgattctgattcagatgctatgtactttctgattctgatgcactcgttgactcagattcacttgtactcgttgactctgactcacttgtactcgttgattctgattcacttgtgcttgtcgactctgattctgacgtacttgcagattccgactcacttatactcgttgatcctgactcagattccgatgtacttgccgactctgattcactcgttgattctgattcagatgctgatgtactttctgattctgatgcactcgttgactcagattcacttgtactcgttgactctgattcacttatacttgtcgactctgattctgacgtacttgcagattcagactcacttatactcgttgatcctgactcagattccgatgtacttgccgactctgattctgaagcactcgttgactctgattcacttgtactcgttgactctgactcacttgtactcgttgattctgattcacttgtgcttgtcgactctgattctgacgtacttgcagattccgactcacttatactcgttgatcctgactcagattccgatgtacttgccgactctgattcactcgttgattctgattcagatgctgatgtactttctgattctgatgcactcgttgactctgattcacttgtacttgtcgactctgattctgaagcactcgttgattctgattcagagactgatgtactttctgattctgatgcactcgttgactctgattcacttgtactcgttgactctgactcacttgtactcgttgattctgattcacttgtcgatgtcgacgtacttaccgattctgattcacttgcactcgttgattctgattcagaggctgacgtactttccgattccgattcacttgcactcgttgattctgatacagataccgatgtacttgccgactcggattcacttgtacttgccgattctgattcacttgccgatgtcgacgtactttccgactctgattcacttatactcgttgattctgattcagaggctgaagtactttccgactcggattcacttgtacttgccgattctgattcacttgtactcgttgattctgatccagataccgatgtacttgctgactcggattcacttatactcgttgattctgattcagaggctgacatactttccgactcggattcacttgtacttgccgactcagattcacttatactcgttgattctgattcagaggctgatatactttccgactcggattcactcatactcgccgattctgattcacttgcactcgttgattctgattcagagactgatgtacttcccgactcagattcactcgtacttgccgattctgattcacttgcactcgttgagcttgatccagatagcgatgtacttgctgactcggattcacttatactcgttgattctgattcagatgctgacgtactttccgactcggattcactcgtacttacggattctgattcacttgcactcgttgattctgatccagataccgatgtacttgccgactcggattcactcgcactcgttgagcctgattcacttgccgatctacttgcacttgtagactctgactcacttacactcgttgagcctgattcagatgctgacgtacttgccgactcagattcacttgttgagctcgactcacttgtcgatgtacttgcactggaagactctgactcacttgcactcgttgattctgatcctgataccgatgtacttgcagactcggattcacttgcactcgttgagcttgattcacttgccgatgtactgacactggtagactcggattcacttgcactcgttgattctgattcagataccgatgtactttccgactcggattcactcgttgattctgaggctgatgtacttgccgactcggattcacttgtacttgccgattctgattcacttgcactcgttgagcttgattcacttgccgatgtacttgcagactcggattcactcgtactcgttgattctgattcacttgccgatgtacttgcactggtggattttgaggctgatgtacttgccgactccgacttacttatgctttcagaaatagacgcactgatagattcagatatacttgtcgaagcgctgagtgattcagacttgctggctgactgagactggcttatcgacgatgattcaaatgtaaaacgtttcgtagaacccttattttctttgacatcagaagttgtcgttttctcatttgatacattagatgtagttgtgccctttacagccagatgaatgtctccatactgagaaacatcagtagctactacacgtcctgatctaacttcatgaagttcaaggttggcttttggtgcaataacattaccactgaagttacttccaacaatagtgccactataattaccaaaattccaggttacataggcagctttggagctgtatgcttttgtggcatttacaagagcattggaaatattcgtcagatctaatacacttccatcttctacatttacgttaataagaatatttacccggttattattagcattgctgttaaagaacgacgcaaatatctgatcgttctgccagctgttaggatcgatagcccagcttgtaaatactcttgaagaaacagtaacggagagaacatctccattgttgtattttccactttttactattttggcaatagatttgattttattgtaatcatctctgatattcgtccttggtgacttcgtcgcatcaatgatagcctggcctttatttccaatatcatccagattttcagagatattgatcatctggttaatatttctgaaacggatactatcagagttctgagcttcttctaatgtcgaagcacgataagcagccggagtatttttggcgaaatgataagcactactgtttttagcctggtcgccaaaaacaatcatggcctttagatcaccatcgcttccttctatcaggccatttctaccaacatttccaatatagctgtagccatttttattataattttctgaaatctcgcggattgacaaaccagtattggaatcttcaccgtactgactcttgtttaaaatatttataggtgtatttaaattttcaactgcaatgtttccatcaatatgtccattgccccaattgaaatttttggcatagatatcttcatcggaggtaatattctgtgagttgaggtattctttagtggcattggaaaccgtttcggacgcagttgaaacagtgccatccgcattgattactcttacagtctttttattgtagtcatcggcattggacatcacatttgccgtcgtaataacacgagtttccgtccaggtcgtgacagtcttatcctgtacatatttgtgatcaggataaaagccgtctttattttttgtgtttttttcttcttctgtcagttctacttcatattcgtcactaatgacagtttttacatgttttatgactatcgttcttgttgtagaaccatcatgattgtcaacctttttatcagagatggtctctgtcgtctcggtcgtgcttcccttagccagctctttctttgctgtagcagtcagcgaactcgaggtagagtttgacaatgatacattctcagatgtggatgttaatacactctgagacgcggatgtactttcggaagcagatgcactctctaaaatagatgtactttttgaagttgaagcctctgcgctctgtgattctgatactgatgaaaaactgtcgatatcatcaaaaaatccaaatcttccagctttcgcggcagctgtctcactctgctcttcgctggtacttgccgcagtagttccgctctgatcttcgctttcgcttgcacttgctgcagtagtctcactctgctcttcactggcacttgctgcagtagtctcactctgctcttcgctggtacttgctacagtaatcccgctctgctcttcactggtacttgccgcggcattttcactctgctttaagctctcgcttgcagaagcagacttcttctgtgacaggctctcactctcagaagcggacgtactctgtgacgcctttacactggctgcctctgatttgctctgtgacgcctttacactggctgcctctgatttgctctgtgatgcctttacactggctgcctctgatttgctctgtgatgccctggcgctcgcttcggctgatgcagctgagcggctgtgagccgcgctggcgcttgcttcaactgactggctgtgctcaaggctggccttttcagaagcggctgcagattccttttcgctggcagcttcagaattcgaggatgtagaagacaatgactcctgtctggattcagacgctgctgtctgtcccaggaggctgtcaagctgcgagccatcatcatttgactggctctgtgcttctgcagcgtaaaccgcattcccctggccgaacatcaaagctccgccaacgaaagcccccgttgcggccgcgctcttcagcagagcaccttttctttttgattgttttttatcattctttcttctacccatttcgcacctccgcgggatagtgttcatatatcatgaataaaagaggaaactattcaatccttcttttatatattatcgacaaaaatgtccatttttttaatataaataagaaaattctgtaaactcttactctctcggctttccggacctggcgagcatatccatcttcatctcatagtacttaggactcatatcgacgtaatggcggtgaggattctcgaaacgctgctcctcaggccagatctccgtatcgagctgggctctgacgaatttctgaatatcgcgcactgcagggagatcactcacgcactttccgttctttataatagctttctggagcagcctggcagtgcagtctgtaaacgatctgactttccatggctcgatcgggtctacaaatctgtaaggcgtgctgaggtcaaccgtctcatcgcggccagtgataaggtctgctatagcatgtcctcccttgtcgtaaatacggtaaacactctttagtccaggattcgtgatcttctcaacagagtccgaaatcttgatcctcggtgagaactttccgtcctcctctactgcacagagcttgaagacagctccaaaaaccggctccgaacggctcgtaataagcctctcgccgacaccgaatgaatcgactttacctccctgatcgaggattgactttatcgtatattcatcaaggctgttgctgatgacgatcttcgcatctgtaaatccagcggcatcaagcatttccctcgagttctgtgtcaggtatccgaggtctccggaatcgatcctgatgccgtagttggtgctcttcacacccttgtcacgcatctcctgaaatactttaatcgcattcgggacaccctgttttaaaacgtcgtatgtatcgaccaaaaggatacagttatttggataaatactggcaaattttctaaaggcggtaagctcgtcctgatagaacataataaagctgtgtgccatcgttccaccaaccgggatatcgaaatactgccccgcagaaacagtggctgtccccttgactccgcctataaaagcagccctcgcgccgtagatagcggcgtcgttgttatgtgctcttctggctccaaagtctgaaaccgctcttccatccgctgaacggacaattcgctgtgccttcgtcgcaataaggctctggtgatttacctgggcgaggatctcagtctcgaccagctgcgcctgaacgagcggggctacgactgtaacgatcggctcgcccggatacatgatcgtcccttcagggtacgcatacacatctcctgtaaatctgaagtctctaaggtactccagaaacttgtcatcgaactgatgaagacctctcagatactctatatcttcatcgctgaaatgcatcccctcgagatattctactatctgctgaagccctgcaaatatcgagaagcctcctccatcgggattcttccggtagaagacatcgaatgccactctggtatcagcattctcacagagaaaatagccgttcgccatcgtaagctcgtagagatccatcatcatcgaaatatttctgttatcgtaaatattcatcggtcttcctcgcttcttagaaaaagtcaattttattatatcacattttattggcaagtgatataatacatttctaaatatacaaaaagggaggccagccatgagtgaccaaacgatgaaaatgacagtatctccgatctgcaccgacaagaccggcaggaaaaaatttgcctatgtgacatttactgacggcagcaaatacgccgaaggccggatcccggaatgtaagatcacaaagaatgatggctttacagatgaagaagtcgccgggcttcacttttacatgaaggcgaatctcaaagaattaaaaaaaatagctgcgaagaacaatgtcttcgaagctctgaagaaataataaggaccgtccaaaaggacggccctgtttttttatgtctgattttttgaattagtaagctgctggtgcctgtggtgctggagccggggttggcctttggtcacgcgtctgggatagttacttcttttagggattcacagttgttaaaagcataatcacctattttggtcacgctgtccggaatggttatctcttttagggattcacagttgttaaaagcaagtttacctatctcagtcacgccttcgggtattactacaactgttatctgtcttatagaaacatcgcccgcatttataacgccggcttcttttaaatgaacttctctgccgtttataaaaacactttctgctaaatgccacgctgtttctccatattttacttttaaatatttatttatttctgactaaaacttcccacactcaaaaggtgtgttgaaccttgaaaactcaataatgtaggcaattaaaaaggcatagacgctgtgcctgtgtataatgagttgactagaaacaaccatacaaggagactattatgccaatatcattctacacaggataaagacggacaggaacttttaatgctatttcgacatttttctcaactttcagacggtaacctcctccataaatgcaatgctcagaaggagaagggcgttccggtaatcgatattttcaaatataagctctgcaatgttttcgccgaccgcagcatgtatatgcagcagaagacaggctccttcaaagagtcgttttcaaagaatacgttttatcggttcctgaacagcccgaagacaaactggtcgctttactacccttctgtctaagaaggttgctgatgctgttgagccgcctactcggaagaccgtgtaaacgcgtttgttgttgacgacagcctttttgaacgaacgagctgcaagcaaacggagcttggctcccgtgtgtttgaccatacctccatgaaataatgcaaaggattccgtctgatgacactggatggactgacgggatacacattcttcctgtaaacagctgcctattagcctcttccaaagagaaaaatcttatcggtccggtcgatcagtgcgatggccgttcccttgcagcaaagcgtagaaagcttgcacaacaaagggcacagaagtcatgatcgagctgcttaagactgcacagaacgcccgtcatcatgcggattacgtcctgtttgacacatggttctccagtcccgacagctgatcgctgtgaaaaaacttggtctagattccattgctatgtctcagaagagctcacatctactacgagtatgaaggaaagcgctttccatcaaaaagattttcggcatctgcaagaagcgccggggccgcagcaagtaccttctttccgtgaatgtcatggttggtaaagacgagaagattcctgccaaaatcgtctgcgttcggaataagaaaaacaagaaagactggattgctttcatcgtacaaatcccgaactgtccgaagaagagatcatccggatctacggaaagcgggggcagattgaggtattctttaagacatgcaagtcctatctgcaactgatatcggaatgccacagcctttatacgagccctgaccgcgcatgtggcgatcgtttttactcgatatctgatgatctccatggaacagcggcggagcaaggacgacagaacgcttggagagatcttctactttttcacggacgagctggcggatatcacctttggcgaatcttccagatcatataactgccatgatagaaagtatttctgctatttttcagccaaccgaagaacaacttgcaatgttcatagagatgtttgtcggtcagcttccggagtatatccgtaattcgctggcaaaggcgggtttagcggcataaagatcctatctgattgcctgtattattgagttttcaaggtgcgaagcccatttttgctatgggaagttttagtttctgatacttatacttatagttatatagctaaggtattccactaagaaaaaatatgaagtagttgtttttgtataggtaaaatgctataatgctttttagaagataagcagcagatacattagtgccgcagagactgccggacaagaaaggagtacatatgtcagagaatctaaaaaaatataaaagtgtaaattacaagacgtgtcgtattttcagttctaaacttgatggagataattgtggaatacagtatagtactaaaaaaaggaagaagcatatcaaacagactgtattacctcttaatggaaaaactgcttctgacaaatccgcggagaaaaaagctgagacaaaaaaggagcactctctatggcaatgagtaaggcactgtacgaagcacagaaaagatataaaaagaaatatgtcaaacacgttatgctttcccttaataaaaggactgatactgacataatcaagaaattggattctttggaaaataaacagggttacattaaaaaattgatacgcaaagacatcgaagaaacggaagaccattcaatgaatgatcaggatacagactgctccgagagtatgaatttttttctgtaaaaacagatctttcaaaagttgcagtgatatagattaaaatattttaaatatattcttctgtatcacttgagtataatattgcatagatcagctgtcctgtcaagaagttcagaaataattctgtcaatctgtattattgacattacagcagattatagctttactggtagctacttgtactttcaaaacagtgcagaataaggcttagagctcttaagtatgataaagcccgagaggttcattctgtcaaggattatatggaggagaacccaggtctcgaagtccgtcttgatgcaaaagatagcatggacgagtgtgaccagatgataaatccattctggaaaggacaagcaaaagacattcccgaagagtggcatgataaatttgtcctttcggcaggatggatgatggaagcacaggtaaacgcattaagcgtctatgctcctgatatgatgaacgtacggctacagctcgaagagacacaggcagtagctccacaaatccgcaggcatagaggaaggtgagaacatggcaggaaaaaggtatcttagaatgaggcagatgatatgtgtaaagtagaagctgtgcgatgggtattattaactgaaaaagataataatgacagaagtggtttatatggttatactcagcgtactttggcatataactcaaatagaattgagggaagcacgctgactgaagatcagacagcttcgctttttgaagaaggatttttaccaccaaccgattcggtttatatgtctaaagacatagaggaaatgaatggtcattttcttatgttcaataaaatgctggctacgcttgatgatgaattatctcaaaatcttatcaaggagtttcattatgaattaaaggccggagtgtttgaggacagagctaatggctatgctatcggtgaatacaagactcgaccaaatactgtaggtggaatgaccgtgactgcgcctgatgctgttccagaggaaatgaaaaagatgattgactggtataattcatgcagttgtgtgaacttagaagtattagctgaacttcataccagatttgaatctattcatccattccaggatggcaatggacgtaccggaagaatgatattgttcagagaatgcttaagaaatgatatcgtcccttttattatcaaaaatgaaaatcgagctgaatatattgtcactcttcatgatgctcagataaaacatgattatgcagctctttccaaatactttgagaaggaacagaaggaatataagtcccagtgcagatattttgatgtagataatagatatgctgcttcattgaaattcaagagcttatcaagagctaaaaggtgattccttatgaaggtgtataattttgataaaagtattctcgttgcaactaatgccagtaaatagagtagaacgaggtaatttaaatgaagttaaatgatgaagatattagacatatgcttgaacaggattctataattctatatcacggttctcgtggtggtatagaaggtaatatatcgcctataagccgtgaaagatgcgattttggtaaaggcttttatatggggacatctgagctacaggctaaaggtcttgtggttgatgatagtgagccttatttttataccttaaaacttaatatcaaagatattccacgcaataggatcctttttctttcagggaaagagtggatatataacgttcttgtcaatcgtaaaaaatcaaagaagtttaatactctttctgttgcttctgatattttggaagaacaaaaaaagtatgaccttattgttggcccaatagcagatgatcagatggccgaagcttttagacagtttaacagagggtttattagcgatactgcattagaagattgccttaattacgttgattatggttaccagttcgttgctaaaactgattatgcttgtaattgtattgatattattacagaatcagagattttatcaaacgaaatagaaggccttagaaaatatattaatgaacgtcatataaaagaagaagactttgtaagtgaaattgcatcacaccatcgaaacgatggactctttttagatgatataattgaacttgaaagtaaaaatgaaaatcatgttgctttcagaaagcatggtaggtgactatatgtatgtgcaagaatttgtgtgtgatactcaaggccttttatataagcttgctgctgaagagggttacgatatgagtgttttttcatacttatatttaaattctgatttttgttctagaagccaagataaaccttcccgattgcgctatgatgatgaggaagtaagtcttttctatttacttaaagagataggtggtcaacttaaaaaatatccagataatgtaaaattcaatcttgatgttgcttattggattggatgggtgtacaggcaattgtgctttttatgtgaaaagccaagtaaattcctttgtgaaaaaatcccttttgaattgatgtgtgattattatcccggaatgcacactattgatgaagataatgctgctgagatcattcttaataatgctggtttacatatgatttaggatgagtaacaaacacctgcgaaagcttgcaggtctatatgaggtaataaagatttcgtaaagaagcacatataggtgagtattatggattcggttatcaattataaaaaagatttgtcatatactgcggttccgggaagtaatggaacgatgtaccatataatgtgtgaggatactcttgctgatgatgtttttgtctcagacgatcataagacaattatttatatcgtttatgaacccccaggcatgacgcagcctttttcaggtggtacattggatctctatcgtttttatcgatttctaaaaagcagatgctttgaagattgcagagctgatcttccggagattcttgaagctatggggctttcatggtaacaatccatgggaatttgtaaagaagactcatggagttacttatgaggatcatttttggataaagttcaatgacgaaagattacatggaaagaggtgaatccacgtggaagaattaattttgataaaagcattcttgttgctactattggtagtgaaaacggtgctcagccaaagtataattcaaatggtagatggtttaaacaagataattgcggattgaaggttactctgaatatctagtatcaaaaatcctgagttttcaaatgtagacaattttgtaaaatattccaggtgcattataaacggtaaaatggttgtgtctctgatgattttaatcatgataaagttttcttgagttttcaaaagatgtttgatatgtattatggtggagaatttgaaggaaaactttctactatggattctccagaagaacgtatagattttacaaagaactttgtttttgagcagacgggcttgatatttcagattatctttcatcaattttaagtcttgatatgcttactctaatccggacaggcatatgaataatcttggtgttatagccaatattaagagtctactttcaattgctccgatctttgataatggtgcttccctttgcagtgatcttaataggtttccaccttatatgctattgatgaattaagagaaaatgttatgggcaggcctttttcgtctaatctagaattacaggcacttgctgcgggcatttctcttaaatagattatgataaagcatttgaatttttagacctaaaatactgacatcagagcaaagaagattttgattaatcagcttgacaatatgccagtttacttaaaatgaattatgaagaactctaaaatcttgtaatgaggattatgttaaccatagaagaaaagaagataaaaagcgtgttttgcgtccacaccattaaaaaacaagactatatcttccggagttatctatcatttggcaaggtctaacacagtgttccccgcgtatgcgggggtgatcctgaatgatctccgttatctgtgtagtgctcattccttggcatacatagagatgatcttatggtctatctctgatatatctttctggcgtttctttacaacctgtggttcgaacgtggaattcctgtccgtcgggacatcgatatccatgctgctgcgtagctggatttgacacgctttgtcttgtaaccgttccggtagttgcggtcttcttcggaatcgccgttacgctctgatttttcatagccaagatgattatccatctcagccgccccatctttttctttgatggtgccaccaagaaatccttgagggcttcctggatgtcgtttgcatcccggatatcatactcctgcagaagcccctggtgatggctcttttgccatctgtcatctgaacgtggtgtactggttgcttttctcttcttgccataataataggccctccatgaattaaaataattgtatcataaagaccctatatgaaacttttacagacttttttcaaactctcactgctcactcactcgtctcagtgccagcagtgatcaggatcttccagatcttcttacaactctatagagtggtcgaatatccgctaaacggcgcggatcccccaagcttgcaaactctgatgcaatgctcactcttaatccctgctggaattcatgcagcatatccagtttaaagccatagccgtttgaaatctgctccgcgtgcgtttcatttactcccatctgatataaaaatctttgacttcttttcggatggtgccagactaaggtctatgatatccggcttgtgaacaagctctagctgatcttcctgaacctctcgatcccatgagtctcgatctttatgacaccaagcctgttgtcggcatatggatcacggcgagcatcgatgtccctgaatcaaagagcggagccatggattcaaattctaaagtatccggattcctgagcacccgaagttttcccagtgtctgtcagtattgtttatagaaaatccgtcagatcatggcacaatgaagtcattcacataagtcctgtcaagaccgttttcggtacaaatgtcaacaaacttctccagttcttctttcccatcatactcttctcctaattctcccgagtccaccggtaacattataagcagagatcagttcatgctctttatcagtaaaaaacctcgcgtcgcagctgtcgcagatgccattcttaaaatgcaggagatatggtgtatattcaataatccaagccgctcatatagatcggaagcaaacttttcattgatattcatcagaccttcacctgatccactgccatcatctttatcagatgccagccatcagaccgtcttttggcttcttttgagagagaaccattcaacgaactgtctggtctggaatagtacacctctgccttctccatcatgaaaaataacaggagagctgaaattatcatatggattgacctgttcccaggtcagatcttttatagattccggacatatccagtatgaatcagaaaggcttagtgcgagattttaaaacaagcagctcctgcggagttttacatcctgcccgttttagaatgttttccagatcatcccggccactgggtacgtctgttctcaaaccacatcttaaactgatacccttttttatctccaatgaccgatttccttagcatttatcatttcaaagctgtaaaattctccactgtaaatatctattgataatttagccacgtttttatttttatgctttactatgaagctttcgacatatcctttcatatgtcctctttgataaaaattaagaccgccataaatccattaaaagagaatgacggtcttttcttacaatataaattaatacttacgcttcaagatcttaatcaagctcttaaaatggtcggggaaaagtttggggtatagatatgtccatactgtgtagtaatgcttcttatcggcatagtaatacttcttttcacccgacccactaactttgccgtcttttccggtcttgtattttctgcttccgactttaacggtcttattcgtatgcatatccatgtcggtagcaagataaatactctttcccacctttacggccttaaccttatttacagtatatcccttcttatcggcatagtaatacttctttccgatcctgaccaccttattcctgatcaggctctgtctcttctttccagcatacttatagattcgatacttttttcccttctttacaatcttataagatgctttgactttttttggacaattaaatttaaaagttttaagcttgtcacaattgataaattcatcacctccgaacttcgcacagcctctgcctacagttacatcgacaaggtctttgttatcggaaaatgtctctcctcccaatccctgacgctgtccgatggatatcttcttgaagccgcagccagaaaaagcatacgcaccaagtatttaaggtttctgctccacctgatgctgctaacttttcatcgtatgaaagcatctctgcctatcttggttacgctgtccgggatggttatctcttttaaggatttgcaatcaaaaaaggcattgtcgcctatctcggttataccatcgtgaaaaacgatggatgatattttagtattatgatcataacaatcgtaataatcattataataaaaaaatgattgacggactttttcgttatcaaaaccggctaagaataattatcatcttttttggcggatacgatctttcccttaccgtagatattcatctgaccgttttctttgttataggtaaaagtaagcccttaccgaattttcctttactataccatccttatcataagtgatatcctagaacatatccataaaagaactgctggaagcgggtttagccgctgttcccgaagcagaatcggtcttcactgctgctcctgctgctgtctgcggtactgctgatccgacggctataagcgatgccatggctaatgccagtaatctgatcttgtttttcatgtgttcacctctgaagaaatatctatatattgttcctatgattatattatagtactttccctatatttgtcaagatatatttttcagtcataagatgagccggagatgatacgccttaacagcaaagccctgcacattggagtaaggatcagttttttggtgtggtttccagcccggtcccatgcatcgatataatagcagacaagggtataatctctgctcactctgtcctgctttccatcgtgatctaccgtgtacgttgtgtccgaagaaggtgaagaagactcaaataatgttgttgagtgatagcagagagtgttcgggtcgtgggtttttactgcatttttaggctgggtaacagtagtcaggactactttgctgaggccggatgatttaagtccgggcggattcggggtatatcctctgaaactgctgctcctttttggaagatcgtctatttcctgaatgatgttacagtcagagaaatattctccttcttttgtaggaagataaggatatgtcgaagtcgaattccttttaacagcatttccgtgtgaagcgatataaggatctgtggatccggccacagcatcagatgacaatataaaagaggtcaggcagcatatcaaagagctggagaaacaggaagaaaagatcatcgatctgtatcagatcgggaccattgacatcgacctggtaaagaaaaagtcagaggcaatccaaaaagaaaagaagaagttagaaaaagtcctgtcagaaacgaagaagaagacccctcagagcgtttcgagagatgaggctatagagttgctagggtcattcgatgaaatcattcagagcggttctctacaagagcagagggaactcctcagatcgctgatagaagacattgtggtctttcctgaccacatagagattcactggaccttttcagtgaaataaaaaataccacccgatatatcatcgagtggtatctttttgcatattgtaaagtttctcagtagtctgctttttacatcattggctgctgcggctgtgtcccaacgtttgcaggttccttgatatcagcaactgcgctctctgtagtaagaagtgtgcttgctactgagcatgcctgctcaagggctgtacgtgtaaccttgacaggatcgatgattccgttgtcaaccatgttgccataggtctcattgtaagcatcgaagccctcgccctctttagagttcttgacattgttgatgatgactgaaccctcaagtcctgcgttgtctgcgatgaagtaaagaggtgcatcgagagctttcaggataacattggcacctgtcttctcgtcgccctcaagtgtgtcgcgaagcttctcaacagccttctcagcgtggatgtaagcactgccgccgcctgcgatgataccttcttcaactgcagcctttgtggcgtttacagcgtcttccattctatacttggcttccttcatctctgtctcagaagcagcacctacacggataactgctacgccgccagcaagttttgcaagacgctcctgaagcttctctttgtcaaactctgatgtagtatcagcgatctgtttcttaatctgtgaaacacggtctgcgatagcctgcttgtcgccctcgccatcaacgatcgttgtgttgtcttttgtaaccttaacgctctttgcacggccgagctgatccattgtagcatctttaagctcaagaccaacctctgaagagataacctggccgcctgtcaggattgcgatatcctggagcatttcttttcttctgtcgccatatccaggtgcctttacagctacgacattgaatgttccacgaagcttgttcaggataagggttgtgagagcctcaccgtcaacatcctcagcgatgatcagaagcttggcgccattctgaacgatctgctcaaggagtggaaggatctcctgaatatttgaaatctttttatctgtaataaggacgtatgggtcatcgaggtctgcttccatcttgtcggtatctgtaaccatgtatgatgaaatatatcctctgtcgaactgcataccttctacaaggtcaagctctgtctgcatggtctttgattcctcgatagtgataacaccatcatttgaaaccttctccatagcatctgcaaccatcttgccgacttcttcgttacctgctgaaatagctgcaaccttggcgatctgatctttgcctgaaacctttgaagacatctttcttaaagagtcaactgcacaatcgcaggcctttctcatacctttacgaaggacgatcgggtttgcacctgctgccaggttcttcatgccttcagaaatcatagcctgagcaagaacagtagctgttgtagtaccatcacctgctacatcgtttgtctttgtagcaacttccttgacaagctgtgcgcccatgttctcgaactcatcttcaagctcgatgtccttggcgatcgtaacaccatcattagtaatagtaggtgcaccatagctcttatcgaggactacgtttcttcctttaggtccaagtgtaacacgaactgtatctgcgagtttatcaacgccgttctgaagtgcctgtctggcctcagcaccgaatttaatatcctttgccatgacttaaatacttcctttcaaaaattattcaacaatagcaagaatgtcgtcctgctttacaataatgtactcttcatcatcgagctttacgttagttccggcatatttgctgtaaacaaccttctgtccagccttaacctgcatcgtaacgtcctttgttccaggacctactgcgataacctcagcctcctgcggtttctctttagcgctgtcagcgaggatgatacctgactttgtcttctcctcagcttctacctgctttaaaactacccggtctgataacggattcagtttcatgatgaatacctccttgatttttatttcgatttgttagcactcaatacttaggagtgctatcaactatgtatataatagttttttgtactactaatcgcaacacccgaaatcatggatttttctctgtttttcacttatttcctttaaaaaatgctgaaatgctctttttttcgtattgtgtttaattttatgttataattttggaaaaatgaaaggagattttttcatatgttaaaagaaggaatatccggcgaagcaacgacctgcgtttcgaccgaaaatacagcagttaccatgggaagcggaacgctccctgttttcgcaactccggcaatggttgcacttgttgaaaaagctgcctggtcatctgtcgcaggcgagctcgaggacggacagtcgacagtcgggatctcaatgacactctcccacgaatccgccactcctgtaggtttaaaagtcactgtaaagaccactcttaccgccatcgaccgcagaaagctcactttctcctgggaggcttcggacgaggccgggatcattgggcgcggcactcacgagcgttttatagtaactgacgagaaattcgtcgcaaaggcagaaaggaagaagtcatgaaattagctatcgcgcagatgcagatggatattgacaagaagaaaaatgagcagagagcgctcggtcttgcccacagcgcttccactgccaaagctgatcttctgctgtatcctgagcttacgctcacaccatttttcccaaagtacccttccaaaatgcttgaaggcatgggcatcccgagggacgctttttcaatagaagcgaacgatcagattctgaccagatttgccgaacaggccagaaaagacagcatctatctctgcccgaatttttacgttaaggaagaggacggaagacttttcgacaggtcctacttctttgagaagtccggacgtctcgtcggaaagagcgatatgcaccatatttttacagccgagaatttcttcgagggcgactactacactcctgccgaggagcctttcaaggtctttccgactccttacggaaatattggcgtagtcatctgcttcgacaggcacatccctgagacgataagggcctgcgcacttgccggcgctgagatagtgcttataccttctgcgaaccttaaaagcgagccgctcgacgtatttaaggctgagatcgtcgctgaagcttaccagaacaacgtgttcattgccatggcaaacagagtcggaaacgaggacggtctcgttttcgcaggtaactcacttgtagttggaccggacggcagggttcttgccgagggaggcgctgaagagggtcttattttctgttacatagataccggtgcagctgtccgcgagagaaagacaaggccttatatcggctactgcattcctgacagtggcgtctacaacttcgaatccgaagaactctctatagaaaaggaaccatctgtagaggatgtatatatggctatggccgattacgacgagggcgacgcgaagcgcatccagcattttacaaaggtgtattactatgcccacctgatctcagtcggcgagcatctgccgcttaagacaaggcagatcacagagatcgcagctatggtccacgacatcgggattcacaaggccgagcagcatttccatacgactgccggaaaataccaggagaagctcggcgcaccagaggctgcaaagcttctgactcatatgggattccctgagcaggtggtaaaccgcgtctcgttccttgtaggccaccaccacacctacacgaatatcgacggcattgattaccagatcttagtcgaagccgattttcttgtaaatatctacgaagaccagatggacttaaaggcccgcgaaaacgcatttgaaaagatctttaagaccgaaaccggaaagcgcctcttcagacagatgtaccctgaagaataatgcaaaaatcgagtctttcctcccgatttaatttatacatctgcccctgtcatgtaatgttaaaaatatgtaaaatttaaattaagtattgcatacaggggtaaaatcatttagacttaaactgtaatttttgtgtgaaatttatgtaaagaaatcgaaggaaagaaaaatgaatatcattattctgctgaaacttatcagtggcctcgttcttttcctatacggaatcgagtacctgggcgaggccttaaagaaagtctcaggcggcaagcttgagaaaattctcgaaggcctcacgaacaacaagtggaaggccgctcttctcggcactttagtcacctgtatcatacagtcatcaggtgcgacgatcgtcatgtgcgtcggtttcgtaaactcaggcatcatgagccttgagcagtccgtaggtgtaatcctcggagctaatatcggaaccactatcacagcatggcttctttctctctccggaatcaagagcgacatgcttcttctgcagctcttcaagcctgagaacttctcgcctgtgatcggtcttataggacttataatgcttctctcttctaagaaagagaagcgcagaaatgtcggagccattctcctctcatttgctatcctgcttattggtatgagcggtatgtcaagcgctgtatctcctctcgcgaaggacaagacttttacgagcgtccttacgatgttttccaacccattccttggtcttctcgttggtctcggcatgacagccatcctgcagtcgtcatcagcatccatcggtatcctgcaggcgctttcgacttcaggtaccgtgacatttgccacagctattcctatcatcatgggtgagaatatcggatctgctatcactggtatcatctcatctgtcaatgcttcgagaaatgccaagcgcgcctcctggatgcagatgatctactgcattataaagacatcagtcttcatggttggcttctatgttataaacgctttcgtacatttttcgttcatgagcaaactggcatcgcctgtttcgatcgccgttttccacagtttgttcaatatcaccgcagttcttatcatgctgccgttctcagacatcctgataaagattgtcagaaagctattccctatcactgaagacgagaagaaggaagccgagacgaatcacacatttactatcctcgacgaccgtttcctctcttcacctgctttcgccttagatcagtccaagaaggttcttctcgagatgatgaagcacagcagagatgcgatggacaacgctatcgatctgatctacgattacgatgagcgtaaagttcacgaagtctcccgtcttgaatcattagtcgacgaatacgaagaccatttgaacgactacctttcaaaggttgccgccacttctctctccgatgatgatggacacactctcgcttcgcttcttcattctacgaacgatttcgagcgtatcagtgaccacgccttaaatatcatgcagtctgttgaggcgatgcatgagaacgatgtcaccttctctggcggagctttggaggagatgcatgtatttaccgatgctataagtgagatccttactatcacagacaagtcactaagagaaaacgatatcgagcttgcaaagcgtatcgatcctcttgaggatacgatcgacaagatcaacctcgagataaatgatcaccacgtcgcgcgtctccagagtggagaatgtacggtcgagcagggactctacctctcagatatcatggttgacctcgagcgtgtcgccgaccactgttcgaatatcgcggcttacgaactctctgccgaggacaacaacttcgaagtacacgagctctcacagcgtgagcgtgaagccagaaacgacagcttccgcctcctggaagacggctacagagccaagtaccagctccctgaatacaaatattccaaaaagaaatccgacaagagttcggatgacgattcggataagaaagataaaaaggacaagaagaaaaagaagaaaaaataacataattttctccataaaaaaatcctctccgtacaaacggggaggattttttattgccatataagcttatttatttgttctgctttgctgcgttcgtaaggttttctgtggtgaggacgatatcgttgtagccctctctgatatggcttatattgtcatcgagatttccgatgcttgaagagatctcctcgatagcagctgatgtcgataccatgttgtcggtgatctctgagacgttcgataagtttctctccatgaattccttcatatccgatgtattggcctcgatcgagccggacttgtcaagaacgctgtccgtgttcgtatttatcttgttaaacgaatcggccatagtatctgcgtacttcctgcactcgtctacatcactctggctctgtgctatcttttcagtcacagactgcatctgcgcattgatctgctctacgatctcacctatctgatcggagaaagctgctgaattgtccgacaaggttcttatctgctctgctactaccgcaaagctctttccggcttcacctgcccttgcagcctcgatcgacgcattaagtgaaagaagattcgtctgacttgaaatatcgcgcacctttgtcagaatatcggcaatctgggacgtctgtgtcgagagctttgtgactgactgcgatacatctgacatagtctgctccagcttttgcatattgcctgagagatcggctacaagcgagtttccctcgtgcacgcttccggcattttcttcggaaagcgccttcatctcagcggccatatcggccatatcggtgatcttcttcgtgctctcctggatctcatccttgatgaccttagttccatctgctacggactgtgtcctctgcgccacgtcctctccagctatctttatctgtgaggagatgtccttcgtaacaactatgctctctttgatctttcctgcggtctcctgcagtgtatcaagagaggcactgatctcagtgagcaggtcctgtgccctcttcgactgtttctttgcattttttccagagttctgaacagaatcgaactgctcacggttgagcttcgcgacagacgccagcgctatgcagccacttatgatatagacgacacagatggccatcgcatcgatgctccatgagccggcgatcttatcgcggaacatcaggtaaaacacgatcatgcagacagcacttatcgcgccctgtatcgctataggcctcatgtcgccatatatagctgcgaaaaacagaagcagaaagaacatcagatagttcgcggataccggatacgtaagcatcagcactatagtaaatatcgacagtacgataataagagcatacatcataatgaccggcggcagcttttttaccatgaagaagagaacaccacagataatggctcctccgatcaggaatgggataacctgcccccaattgttggcaacaattccgtttactatagacctcaaaaacaggcagataaaaagtgtcgtgacaagtattccactcttccgcctcagtgtctcgtcgtacgtcataaaacctcctgtagaacaaaaaagcattgaatcgctccaatgcttaaccacaatccaaatgtattttaaaactgatctgccataaaatcaactatttccgaggttttcgggtacgttccgcggtctatccagatgacctcaggataccttcgaaaccatgtcagctgtcgtttcgcaaagtgccgggtgtcctgttttattttggaaactgccgtctccagcgtacattcacctttaaaatatgaaaacagctcgcgatatcctatcgcctttgcagccgtgcagtccctgtcacctaaaagatcgtatattcgtctggcttctgagagaaaaccagcctccatcattttatcaactctcgcatcgatcctgtcgtatagcttctgcctctcatccgtaagcacgaaaaagcgcagatcatacggcgactttttctgatgttcctctaaattgtgcgatgaaattttctctccgtgatttttatagtactcgagagctcttatgacacgcttgacattgccggaaggaatagcttttgcgctctccgggtccacctcactcagcttttcatggagagcttcattaccattggtttcggcaaaatccgagagtttttttctgtagtcgtagtcgaccttctcctcgccaaagtctatgtcgtaggccagtgcctgaatgtagaagcccgttcccccgcagaggattgggactttgccctctgaatatatcttatccaaagcagcgtgggccatctttacaaactctgtcacgtcgtaattttcttcgggatcaagtatgtcaattccaaagtgctctactccctgcatctcttccggtgtgatctttgcagttcctatgtccattcctctgtagacctgcatcgaatcggctgagatcacggcaccgccgatcttttctgcaagcgcgacagcgcactcagactttccaacagccgttgggccggctatgattataagttttttcttaatgtcagaatccggacttttttcagagctcatatcttttgtttccgtcataggcttcctgccgcccgtccagccgtatagcccgaggaaaatgcccactgcaggttgtagcctccacagacgccgtccacatcgacttcctcgccgcagacatataagtgcgggatctgctttaaagagagattttcatccaattcgtcgaaatatacgccgccggaagtcgtctgcgcattttcaaatcccctgctcccgcttacttcgagtacaagatccgtcatgtacttttctgcaaaatttgccatcgacacaggatcgacatcttctatactgaatttctgtgatgatgtcatacctgaaatgacttccgcaagcttttccgggagaagtcccatcagaagaagtctgcccggatcagatgggagaaggttctcggaagcatttgaaactgactgctcgagaagagatcttacagcattaggcggatagtcaggaaagaagttaagccttacctttactgattttttctgatctaaagctcttagcgcctcggatgagatctgaaaaacggggattccggagatgccatagtccgtaatctgcagattacctgactcgcgtgatatctcctgatcatctacgataagagttacctctgcgtctatacgaacgccggaggcctttttcagcggattatttttaatgacaagcggaactaatgcgggaagtggttttttgatcctgattcctgagtgatttaagatccagagcccctctccggtgcttccgctcttcggatcagcaaaaccgccgcaggctaagacaacgctctttgatacgtaagtatatccatcgacttcgactctgaaagtgcctccggatttttttacgtctagtactttttttccacccttaaggccaatgccaagccttctggcacaggagacgattgcctgctgcacggagacagcagacatacttctcggatagcaccagccgtccctgtactctatgccgatccccaaagagcccataaactcaaggagtgctgcctgatcgaagtttttaatgatttccatcgtcctgtcgatatcatccgaatggtagcagctgccatcgagagtcaggttcgtaaaattgcacttcccgtttcctgtggcgagcagtttctttccaaacgttgtatttttttcaaggactataacatcagaagcccctgcttttctggcggctatcgcggccatcagaccgcttgccccgccgcctacaactatcacatcattaatcattaagcacccccgtttagtctgttattttaacagatgagtcttctctgcaagctttatcagcttatcaccctttggaatcctcgaaagctctgccctcgtgatccctccaaggagaagcataactacatagtaaacaacaattgcgaccagaaccgcaatgatagtggcgataggattcgagcgggtcagcatgtggaccagtgtatatgcgaggaatgccacaatacccatgatcactgagccgataaatggtatcaggtaagtcgactttatatcctgtctggtccctgaatacttctttactgcgtgtccgttgaggacgcacatcattaatgcgtagaatgcgtttgcgaggattactgcgtaaatattcagcttgaaaaatttcattgcggcgagcagaaatccagcctgagctacaagagaaacagctgcattttttacagggatattcagcttgtcaattccctgaagcaggccgttgctgagagtcgacagagaatagaaaagtaccgagacagcgccgaccataagcatatatcccgaggtagggtctgtatcgtggaacagaagcatctgtattggctgcgccaggacaaatattcccacagtgcacgggaacgctatgaccataataaatctcgtggctgagtgtatcctgctccttacaaggtccatatcaccgcccttgtatgccgtgataagtgccggaacagaggatgacgccatggccgaagctatagagatagggacatttatgatgaccctgtactggccggagtagacaccccaccagatgtcaacggcgtgccgcttatacccctggaaaagcgcgaaatttttaaagatcgactgatcgattattgagcttatattgtaaagtgtcgtcgaaagaagcaccgggataatagtcgtaagaagaagccacattatagagccgtagctgtctgagctcgtcgtgtggtcgtggcgcatcttcttgtggaaacggcgcctgtagaccatcaggacaaatataaggaatgccagagaaacaactgcgccaatagcagttcctaacgttccgccggcggctccccaggctgctgcatattctttcgaatctccgagtactgctcctactttctggccgtaggcaaaaagcatccaggctgcgacaactgagatgatggcgtttgctatttgctccatgatctgcgagatagccgtagggaccatgctgtttaagccctggaagaatcccctgagaactccggctatagctacaagaaaaatgaccggagccagtacccgaagtgctatcgatgcgagcggcgtcgccaggagctttgatgtaaagaaatcagctccaaaccatactataagagcaaaacttccaccgcttatagatgcaaagataagagctcccttcaatactttccaggcgtttttcgcctgtccctgcgccattcgcgtagcaacaagctttgagaccgcaagcggaatgctgtatgaagagatcagaaggatggtgttgtagatctcataggctgttccatagtagttgttaccctcttttccaatgatcgcagtaagagggagcctgtaaataagtcctatgaccctgctgattatagatgcaacggcaagcactgtgccctgcattataaaattggcgtcgcttttttttgcccggctcatagtttagtcccttccgattccaagatgttcaagaatctggtcctgaagtttttccatctcttttctctcctgatcatcgacgtgatcgtagcccatcagatgaagcatgctgtgagctatcagaaatgcatactctctctttacagaatgcccgtattcagcggcctgcgcaatgactttcgaagtgcagagtactatatctcccaaaacgacttctccggtatcaggatctatcgaatcctcgtcatcttttatcagggaaaaatctcctggagccggatattcgagcatcggaaacgaaagtacatctgtaggacggtccactcctctgaactgctggttctcgacgtggatttcctcttcagataccagtgaaagcgaaacctgcaccggaagcgggaaatgaagcatgtcaagcgactcatttaccacatcctcggcaacctttttgtaatcgaaatccagtccttccttaaccaggtcatcaatcaataaagtcattctaactccttaactaatatatcacggatctttaaaaactgattcatcgtgatggttgaatcatcgtaatatccacttgatgacagctcatttaaagaagagtatataagcatctgcttgttccagtcgctcttcatcctgtcagattcctttgaaatagcgtcgagcctctccataacagcgtctgccatatgaactatagccgactcctttgacgtaggctttcttataagtcctctgtactcgtagagaatcctcgtaagctggtccggaaaatcattctcggcagctatctgcatggcatagtctatctctttatctcccctgataaggccaactctgtagtacaatcctccggctgccgcgagtgcggcatctgctccgatctctcttgcagccctcagggacgcgattgaaagccttctggccctgtcgtactcttcctctgaaaaaagcctgatctcttttatcagtgaatagtcatcgtctaaaatagtctcatatctgtcccgcctctcgcggtgcagcactttgtacagtgccggtaataaaatcactgcacaagcggccgtaattatagacattccacccgcaaaaaacaagtccttttttgagagcacgattttttcaaagtatcttatcgaagcgggcagagccgcatagactgccgtgaccgccaaaaataaaaggaccttctcaggagttttcgactttactatcagcctggctagtgaaaccgctataataacttcacagaaaaacagagcgtaaatattgccaccatatctatgcgaaaatgccagtgatacaagcggcaggagcgacgccgagactgaaagcgccccgtctccagtcgaagcgagaatgaaagcgataagccctgccgggataaaaactcccggaagaaaaagggaaagtgcgctgactatcgcccctgaaacaagatagatcagggcaaaagtcatatagtccgtatccctgtaccacagaccatccgcccttctctcgtgtataaggtaaagcagtaccgcaagagaagcgggtattatcacaatggcttcgcagataagtcctccggtggcaagtgagctcatacaggcatcgaatgccacaaataaaacagtcgataccacaaaaatgagaagagccgccaccctcttcgggtagaccctctcctcaatagtataaaccttttcaaggcctgcgtcttctgtcttttttgatttttcctgctgactgtttcttttcatattcttcgtaggcatttacgatcttctggacaagcgggtgtcttacgacgtcttttcccgacagcctgaccacgcctatctcttctacatttcgaaggacttttagtgctacatcgagaccgctcttcgctcccggagcgagatccttctgtgtcagatcaccagtgataacagctttgctcccgaatccgattcgcgtcagaaacatcttcatctgggccggtgtcgtattctgcgcctcatccagtataataaaggcgttgtctaaggtgcggcctctcatataggcaagaggtgcgacctctatcgcacccttctccatatttctctggaacgtctcagcacccatgatctgataaagcgcatcatagagagggcgaagatacgggtctatcttctgctggaggtctcccggcaggaatccgagcttctcaccggcctctatagccggtcgggtcagaattatcctctcgacatcctcatgcataaaagccgtgatggctatcgccatggccagatacgtctttccggttcccgcaggtccgaccccgaatgttatcattcgattgcggatcgtatcgacatactccttctgcccgatagtcttcggttttaccggttttccagtgatcgtatggcagatcacatcgctgtcgagctcgacaagcggatggtctgtcgtgggattttttattgaaagggcatagtttacgtcgccatcggtgatctggtggcctctctttgagagttcatacagctcatcgaaaaccctttttgccctgtcaatcttctggtcgtctccggagagcttaagagtgtctcccctcagcacaaagtctacaccgagattatcctcgagtatcttcacatgtgaatcaaactccccgaatatattgatcaaatccttctccgggatttcaataccaatctctgccaaaaataaaatcctttcttattccgattcagggtaatacataaatcccatatggtaggttttgctcttcagttcatgtttgtcgtaagccacgactgaaagcacatggtagccctttgggacagtgatctttttggtatatttcttcgacttcttgtctggattcttattagtccaggaataatagatcgtgcagtcctctcctgccgtgatctttaccttggtcttctttttaaaagtgccgccgttcggagttaccttcggctcttcaggcttaatatatttaatattaaacgtctcagcagaaacttctccgaatttaccgtttttgttgcggcagactgcccttacctttgtctttccctgtgtcaggaagataacgcttccatcgtagaggtgaccgtgaactccgttcggcgccttgccatccgtcgtatagaatatctggtaatcttcatctgcgtctttcggaagcgagagcgtaagagatacgtcatcgctgaattttccaccctttaccgaaaattcaggtggttttatcaggtaatccttgaatatcttttttaccgaatcggacttcgcatacttgtatatattctccatccgattgtagtcgccttcactctcatagagctttaagaggagttcgaaagacttctcatactttccgtcaagctttacagcccgaagcagatagatttccgccgaagccgggtgttttgtctttagataatcttctccgagagcacagagagtctttatgtcttcgggatctgacccgagggccctcctgtagtgaactatggctttatcatagtccttgttggcatccgcctgtctcgccgccgtgtactggtatgaaaatgagtgcgtgtatctgaaatatactattcccattaacgcgacaaggaccgcaagcactatgataagcttaaaatgccttggttttctcataggcgacaagctgcttcgaggcagttcctcatcaacatagctatggtcatcgggccgacgcctccaggtacaggagtgatatagccggccttttctttcacatcgtcaaaatcgacatcgccgcaaagcttcccgttctcgtccctgtccattccgacatcgattatcacagcaccttcctttatatcatctgctttaaaaaatttcggctttccaatcgccgcgaccagaatatctgccttagacgtgatgctccttaagtcttttgtatgcgaatggcagacagtaaccgtaccattctcacggagcagaagcatcgccattggctttcctacgatattgcttctgcctgcaatgacacagttctttccatcaatggaaatgccgcttctctttataagctcaatgatgccagccggagtgcaggacttaaacccctcaagtccgatagagagccttccgaccgatatcggtgaaaatccgtcgacatccttatcgggatctatggcattaataatcttattttcatctatctgcggaggaagcggaagctgtaccagaatcccgtgaactgaagtatcagcgttcagttcctgtatcttctctaagagctcactttcctcagtatccgccgggaggtcaatagaaacagatctgatcccggtatatttgcaggcgcgcatcttatttctgacatagatgtggcttgccgggtcatctcctaccagaacaactgccagacatggctctgttcccctggctttaagggcagctgcttcctctttcacctcatccttaatatcctgtgaaattttcttcccgtcgattatcctagctgacatatttctccaatctatttcttagaacaggcccgtaatgcgtccgtcgtccgtgacatcgatattctctgctgccggatgcgtcggaaggccaggcatcgtcataatatttccgagaacgatgactacaaatccagctcccgccgaagggtaaacctcgcggacatggactgtaaatcctgaagggcgtcccagcttcttcgcgtcatctgagagtgaatactgtgtctttgccatgcagacaggcagattatccatacccaggtctttaagcttctgaaggctcttcaatgctgacttctcccaggtaactccgtctgctccgtaaatctcctttgcgactgtctcgaccttctgctcgagtggcatgtcatcaggatagaggagcctgaagtctcccttcttattatcgagtgtctcgataaccttgtcagcaagggcaagtccgccctctccgcctttagcaaagacttctgagatggcaaattcacatcctctgtcttcacagaatttctttacgtaacttatctctgcctctgtatctgtgtcgaatgagttcagggtaactacgattggcactccaaacttctgcaggttttcgatgtgcttttcgaggtttacgatgcccttcttcaaggcgtcgagattttcttctttaaggttatttttatctactccgccattatactttaatgcgcggactgtggcaacaagaactaccgcatctggcttaaggcctgacattctgcacttgatatcaaagaacttctctgctccgaggtcagctccaaaacctgcctctgtaacagcgatatctccaagtttaagtgctgcctgtgtggcgcggactgagttgcagccatgcgcgatatttgcaaacggtcctccatgaactacagcgagattgtgctcaagtgtctgtatgatgttaggctttaatgcgtctacgagcagagctgccatggcgcctgtagccttgaggtcatctgccgtaacaggctctccgtcgaaattataggcgacgattatcttcttaaggcgttcctttaagtcatgcagattctctgccaggcagaacactgccatgacttcactcgcaaccgagatcacgaagtgatcctctcttggcattccgtctgacttcttgccgaggccaacgactatatttctaagaactctgtcgttcatatccatgcagcgcttccagacaacgcttctaggatctattcccagcttattgcccttctgaatgtggttgtcaagcattgccgcaagaaggttattcgcagatgtaatagcatgaaaatcacctgtaaaatgcaggttcagctcttccatcggaactacctgggcatatccgcctccggcagctccaccctttatgccaaaacatgggccgagtgaaggttcacgaagtgctgcgactgccttcctgccgcgcttgtttaaagcgtccacaagtccgatagttgtagtcgtcttaccctcacctgcaggtgtaggattgattgccgtaacgaggaccagtctgccgtttttctttccggatagctccttcagatactcctcggagagcttggctttgtactttccgtagagctcaagggaatcaaccgggattccggcgttttctgctactttctggattgggagtttctcggcttcctgtgcgatctcaatgtctgacttcattctttttcctttcaacatcctgtttacaagtaatctctaattgccggcactcttaagccactcttcaaattccggaagtgtcatcctgactgtccgcggcttggtgcctatttctgaaccgacaacccctgcttcttcgagctgatccatgatccttgcggcacggttgaaacctattttaaaatttctctggagcattccaatggagcccttctgcttctcgataacgagccttccggcatctgcaaagtactggtctctgctgtcgtccggctctgttccgtctgaaatagcgactgcatccgaactcgtcgcctgctctataaaatcatttatctcggccgtgtcctctgcagcggcttcattttcactctttaaaaatgagacgactctcgatacatcctcatccggtacaaaggctccctgcacacggaccggctttacatagccctgcgggaaatagagcatatcgccctttccaagcagcttctcggctccgttcatatcgaggatagtcctcgaatcaacgccgcttgtcactgcaaatgcaattcggctgggcatatttgccttgataagtcctgttatgacatttacagatggcctctgtgtcgcgatgacaagatggattccgcaggctctggcaagctgggccagtctgcagattgaagcctcgacttccttcggagactgcatcataagatccgcgagctcgtctacgatgataacgatctgaggcatcttcttgacgttgacctcaactccgtcgctgttcgtcatgcagccgtggtgaatttttttattgaagcctttgatgtcacgaactccggctgcagcgaactgtttgtacctgtcatccatctcgtggactgcccagttcagggcgcctgctgcctttttcggatcagtgactaccgggatcatcaggtgaggaattccgttgtacactgaaagttcgacgaccttagggtcgatcattataaatttcacctcgtcgggttttgccctgtagaggatgctcatgattatagtattgatgcagaccgactttccggaacctgtggctccggcgataagaaggtgcggcatcttcgcaatatcagagattacgacctgtcctgcaatgtcccgccctgcggcaaaagctatctttgacttcgcctctttgaattcctttgactcgaccatctctctgaatggaacagtcaggatatttttattagggacttcgattcccactgcgctctttccaggaatcggggcctcgatccttatatctcttgcagcgaggtttaacttgatgtcatccgccagatttacgatctttgagacctttactccaagcttagggtgcagctcatatctggtcacggcagggccacaggtcacatcggtaaccgtgacatcgacaccgaaattcttaagtgttacttcaagcttctgcgcagtctcctgcagatactcttccgagtctcctcctccgttctgcttcatctcagtaagaagcgaagccggcgggaactgataaggcctttcgaccggcggctcaggtggagccgtctgcggttctgcaactgaaggctgcggccctgctgcagccaccggcttatcctgtcgctgcgctgctgctgtatgccacgcgggctctgtctcgtcctgacatacagtttcaggctcgtcctgctcgtcaggttcagccttaattatctgaacatcgtcggcaggctcgtatgcgtcttcctgatatgtctctggcttatagtcggtcgtatctggttcactctgggtctggttcgtatattctgtatcgaaatccacattctcagataccggtgcagcctcctgtgcctctgaatctgagtttacctcagtaactgtaacttcagatacctccggttcatcgaagtctcttagctctgaagtctttttctcttcagctgtcctgctgcgatcccttccgaaaattcccatatgtatgtgagtctttacgtcttttccgctgtagaggtcgacttcctgcttttcaacaggttccggtatctcctgtctcttttcggaggcgtttttctcttttgactcgatgtcgcctctcgttatctcccgaagcccctgcttcttgtcatcgggctttttaataaactgatcagcggagggaatgatattgctttcagtgacaacatgggaagctctttttaattctctactgcgggttctcctctctggagggtcctcttccaagtcctcctcgcgccgtctctcctgcctctcgtggaaatcgcgtgactttttatcgatgaatctgctaagaagtcccttctcggtcacgaggaccaggcagattatcataaaaataagaaaaagaaggatcgtggcaacggtcccgaatcccttttcgaagggaatcgcgataagggtgccgatcatgccgcctccgcttttttcttcgtaacacgaaagatacgccctggcaggcgacggctgattctgcccgaataaaatgacagaaacgatgccgtctaaaaatactataaagaaaaatgccgcaacgatctttactgtcgcaatggcattgcctttatttgatactgcaaaaaatatcccgaagaggaggactatcggaagcacataatttatgagtccgaaaagcccaaagaaaaagcggcctgccgctccccctaccggtccgccaactcctaagttactcaaaaagagcaggatgcagaccgccaaggaaagccacagatataggtctcttctcacctctgaatcaggtgctttgtcctgtctcttttttgcagcttttttcctttttttgtctgacattcctgctctttttaccttttaaccttcctgctctaaccagccgcagaggtaattgtagaggccctcatatttgaacttcgatgcgttccatgagtaatccttcttcatatcgcgctctgccatcttgttccagtcagccttcttcgtaaagaagatgtacttggagtagtttacgatatttaaaagctcatcgccgttgtaatttttgaatgaaaaaccgtcgccggtcttctcgtactcgttgtaaggctctacggtatccttgagtccgccagtctcccttacgataggcactgtgccgtatctgaaagagataagctgagtcagtccgcaaggctcaaaccgcgacggcataagaaatgcatcgcaggctgcgtagagctttctcgcgaggtcttcggagtagcagatatttgcagaaatcctgtccggatacttccacgcatagtgacggaacatattctcgtatctgttctcaccggtgccgcagacaacgaactgcgtattctcatccgcaataccgtccatgcagtaatttatcaggtcgaggcccttctggtcggtaagtctcgagacgagacctatcatgtacttcttgccatcgactgcaagtccgagctcctcctggagcttctctttatttaccttcttgttgcggcggaaatttgatacatcgtactgcttgaaaatagacatgtcagtcgacggatcataggtgatcgtgtcgataccattcacgataccctgcatatcgaaatgtctcgaggacagaagtccgtcaagtccctctccatactcaggtgtctgaatctcctcgcagtatgtaggtgaaactgtcgtgatatagtcggcgtatacgataccgccctttaacatatttccagctttattgaactcgagcttgtccggcgtgaaaagctctgccgggaagcccgataaccccatcatggtatcgatatcccatacaccctggaacttcaggttgtggatggtcattatagtctttatgccatggaaaaacgggttcgcctggaactcgttcttcagataaaccggaataaatcctgtctgccagtcgtgacagtggataagatccggcttgaaatcgatgaccggaagcatcgagagaactgccttgtcaaaaaaggtgaacttctcaatgtcatatctcgcatcaccgtaaggataaaagcattcgaaatactctaagttgtcgatgaagtaatagtggacgcccatgtactcgtattccatgactcctacatacttcatgcccatgtccgggcctccgttcatctggaagctcgtgacaaacttgaactggtcgcggaactgtggcggtatgcaggtataatccggaattactaccctgacatcccactggctcttatcgaactccttcggaagagctgccactacatctgcaagacccccggtcttcacaaatggaaagcactcactagccgcgtaaagtatcctcttcataacctttatcctccttcactgataggaatcagtcctcttcgttccagttgttatatacttcctggacatcctcgtcgtcatcgagccagtcgagaattctctgaagattggtcttgtcctcttccttttcaagagtcacgtaattctgagggatcatagtaaccgaagcgtcggccataggaatattctcttcctcgagcttctctctgactgtcgagaaatcctcaggagcagtcaggataacataggagtcgtcctcctcctggaaatcatctgctccagcatcgagagctgtcatcataagagtatcggcatcctgatcgcactcctctttgtcaacgatgatctgtccctttttatcaaacatataggatacgcacccctgtgtacctatatttccgtggccctttgagaaagcatttcttacatctgcggctgtacggttcttgttgtccgtaagagcctgaactatgatggctgtaccgccaggaccatagccctcgtaagtgactgtctcgtagttgacgctgttcgcatcatttgctgccttcttgattccacgctctatagtatccttcggcatattcgcagccttggccttcgcgataacatcgcggagcttactgttatttgcaggatcaggacctccctccttaactgcaacggcgagctcacgtccaatgactgtgaagacctttccctttgcagcatcatttttctctttcttgtgcttgatgttcgcgaactttgaatgtcctgacattttataaaaattcctttcttaaaaaattatcaatgtttattttatcatttttgctgatttctttcaaccttcacctttgtgatgactctgtcgtggacagagaggactgtaaatttgaagccaaacgcagtcaccacaaagctcttcccatcgacaggaacgctgccgtgaatgtacataagaagcccgtttaaagtctctatctcatcttcaaaattggacagatcgactccaagtctctcagatacgtcagacagcggagtctttccactcataatgaaaacccccgggcctttttctatgataagctgttcttcctcgtcgtgctcatcctgaatgttcccgactatctcctctaagatatcctccatcgtaacaagcccggacgtctggccgtactcgtcgagcacgatcataagatgcagcttctcgaactgcatctgcgtaaaaagagtgtttatcgagtgagtctcaggtataaactgtgcctttcttataagcccatcaatatccctgatcttcttgtcgtaatcctgatgctggagcgaaaagtgcataagctccttcatgtggatagtcccgatgatattgtcaaggtcctttatgtagaccggaaaccttgaaaagtggctgttgtcaaaggtatctatcgcatcttttaatgtgcagtcgccgtctaaggcttcaatatcggccctgtgcgtcatgatgtccttcgcgtccttttcgtcgaatgaaaaaatatttttgatcatcgcggcttcagacgcgaggatatttccctggcggcggctggtatccaccatcgagatgagttcttcctctgtaatatcgggatctaaattgtgaagacttctcttcctgtcttttttagaaaaaatacccatatttacttgtagaatttcttcttctccaccatttcgccgttcctgtagtagagtcttggaatcctgattccaaggtcgcaggcgagctcatagttaaatcttcctgaaagatctccgagctcctcaacggtgatctcctcgtctccgtcttttccgataagagtgacctcgtccatcggtgcgacgtccggcacatcagacacatcgaccatcatctggtccatgcatatcctgccgacgatcggacatctctttccatggataataacatccgccttgcctgaaagagacctcggatatccgtctgcgtatcctaccgggacagtggcgatctttgtaggagcctttgcgacataggtcccgccgtaacttacttcagtgccggcagaaattgtctttaagtggacgatatgcgaaacgagtgaaacagctctgtgtatcgggaagctgtggtccacatcgtctgaaggccacatgccgtacatcgtaactccgagacgcaccgcgtcgagcttgtcctttgtgtattccatcgatgcagccgagttgcagcagtggcggatcttaaaattaactccgcgcacctttaacatatcgatcatatgcataaacttcgcatactgctcgtcggtatgacttgtatctgcgccctcatctgctctcgcaaaatgtgtaaaaattccctccggcacaagttcagagtgctctttaaaaatagcagcgatctcgtcggcgctcccctcatttacctggtagccgatacggctcattccggtatcgactccgatatggcagaacaccttctttcccagctgcctggcatatgaagcataatcgtcagccatttttttagtgaaaatgacagggcgcactccctctcttataatcctctcgtaagagtgggtgaacgtaaacccaaggatcagtatcggctttttgatgccggcttcgagaagctcgtaagcttcctctgcggtggccgctgcatagccgtagatctcatcgtctttttccagatcctttgcgatcggaaccgctccgaatccatagccgtcggccttcatcacagcgtagatcttctgatccggacatcttaatttcactgcatgtatattttcttcaatggcgtttaagtcgaccttagcgcatatcctgtaaaaatccattatcttcctccactttcaaaaatgcttccggcagtgactccgctatatccatagctttcatgccccggactccatatctgtctgctgcaatgtctccggccaggccgtgcaaaaagactgcaattgatgccgcccgaaaaccgttaagtccctgggccagaagcgagccggcaagtccagcgagcacgtcacctgaacctgccgtagacattccattgttcccagtagtattttttatcaggtctccctccggggatgccgtgactgtcctggcgtcttttagcgctattacagtgttgtacgacctcgcataggagagcgctgtgtttgcaatatcgttttttataagagcaggtgggatacctgtaaacctgctcatctccatcaggtgcggagtaagtattacggtatcttcttctgccttttccctaagagcatccctcaggccttcatcctctgaaataaggttaatcccgtcagcgtctattacggcaggaatccctctggtcgaaagaacgtctgcaagaactgcagccgcctttttcccggtcccgatccccggtcctataacgattgcatccgcccaggaaaaatcacctgaaagcgcttcttttttagtatccgaggaaaaaagtgcctccggcacatgactcataagcgccgtaaaattggacttcgcgctaaggacttttaccattccaagtccggatcgaagtgccgcttcagaggctaagatggcacagcccgcgcactctttttttcctgcgatacacaggagctttccgtaagtgcccttgttacttcccggaatcctcttcggaagaagtctctttactttcgctggagtcagtgtcgtcagattttccatctgcatcatcgctttcttctgtgctgtctttctcctggccgctgccagatccgccttcctcttctttatctgatttcttcttgaaattgagcttctcatcggacttcttcgatctccactctccttttgttccgccttcatcgtccttcggctggacttcggccatatatgaatccttgctcgtaagtattaaatccgtatcagcctttatatcaaaaagcccgagcatatccttgccgaaaatatcgtgcatataggaatagatctctctgttgttgatctcgcggttctgctttttgatgatctttttcttaagctcgacacgaatctgttttatccagtcagatatctcttttatctcgcttgtattcgtcctcatcttgtcatatgaaaattcggcagtgaggatcatcagctcgtcgtttgcttccttaagctctttcgggatctctaaaagtctgtcttcatcggccgcgatcttctcatttgtctcgtctatcatatctccgacattcgccatatgagtctttttcgagacatgggtgtcttccatattttcgacgatatttttcatgagcttcttctttacgaccttgagctctctgacttcgttattcagttttccctgttctttaaggatctcattaactctgacttcggctttctttatatcgtccggcttgccctcgagggcgaagagcctgtgccatttctggtccagaacaagtatgggtatcttcgtgactttaagtatacttttcagttcatcgagatccatactatttttgtccatgcttttacctcccggtcatattgtatgagagctgcatcagtgactctgacagatgtacgttctctacgactatccccttcggcatcacaagatccacatgcgcaaaattccagaatgcccggactccaaggttggcaagcctctccgcgacaggcatggctgcatccttcggaagggtaagcaccgctatgtctacacggtttgtcttataaaactcctcgaactcgtcaagcatcataatcgggatctcgctcaccctgatgcccttcttcttcggatctacgtcaaaaagaccaatcatcttgaaaggcagcttctcaaaactcacatagtttgcgatagcatgtccaaggtttcctactccgaagagggccacattgtggatctcggtaagacctaagatccttccgatctcgtcgtatagaaacttcacattgtagccgtagccctgctgtccgaatcctccgaaattatttaaatcctgcctgatctgagacgccgtgacctgcatcatctcactgagttcattcgatgaaatcctctcgactccattctcaataagttcacccagatatctgtagtatctcggcattctgcgtatgacagcttttgaaatacctttgttcatctattcctcactcggcactgcctgacgaccgctcccacgcttcgctaggcaccgcctaacaaccgctcccacggttcgccgtttccgctctgtcttcgcgcttcgcgctcgccaatcgcggacggctatcgcaggggcggtttataaggcgctgccgtcgtttcactcggcaccgcctaacaaccgctcccacttatcataaagcttttttaaactatcatcaagagtttttaactgtgcggtaagttcgttgagcttggccgaattcttcgcgatctgtggatctgcaaattggctctcgatcccggatttttcagtctccaggtcctcgatttgctcttcaatgttctttatctcgcgctcttttttctgtctggcgcgggcctcttccttctgcttcttccagtcatcggctgaactctgcggcttttcctcctgccgatcttctgcagtgtcgtccggaaggccgaagtctgtctttatgtcgtcacgtttgctcaggtagtagtcataatttccaaggtactcgtgcattccgtcggacttaagctcaagtatcctgtccgcagtctgatttacaaaatatctgtcatgcgaaacatagaggactgtcccctcgtaattatttaaagcgtgctcaagtatctccttcgagtccatgtcgagatggttcgtaggctcgtcgaggatcagaaaattgtcaccggcaagcatcagttttgcaagggagacacgtcctctctcgccaccggagaggtctcttatctgtttaaagacttcgtcctctctgaatagaaacgctgcaagtacattccttatcctcgtgttgttaagcgtcgggtaggcgtcgtgcatctcatcgaagagcgtgttgtcctcattgaatccgtgctgttcctgatcgtagtatccgatcgtaacaccggtgccgatctttatctttcccgaatcggccggaaagatgttgtttatgatctttaggatagtggattttccgatgccgttgtcacctatcagtgcgaccttttcgccacgcttcacttcaaatgaaatatctgaaaaaatctgattgccgtcaaatgccttagagaggtgctctactgtaagcacgtcatttccgctcgtggagattggctgaagcgagagcttcatagagtggtccatctcctggggcttctctatgcggtcgattttttcgaggacttttttgcggctctctgcccgcctgatcgacttctcacggttgaagctctgcagcttctcaataactttctcctcgtgctcgatcttcttctgctgcttttcgtattctctctcccttgataaaagaaagagatccttctgcctcataaactcagtatagttgcctttgtagtcgtgggctttaaggtctgagaggtcgatacagcgtgtaactgtccggtcgaggaagtatctgtcgtgggctacgatcacaacagccccgttgtaattcatcaggaaattttcaagccattcgatagagcggagatccaggtggtttatcggctcatcgagaagcaggaggtccggatttgtgacaaggagtttcgagagagcgactctggtcttctgtcctcccgaaagctcggtcatggtcttctggaaatcgtcctccgtaaagcctaatccttttaacgttcccccgactctcgagacataggactctccgtctgcgagcataaattgatggctgagtttctggtatgaatccataagcttcgtcagatcatctccgcttacagtcttcatatcagactccatcctgtggaggttttggtccatttcgatgatgtcttctctcgcatggtagacgtaatcccagatcgtgcccggatagtccgcgtcctgatactgcgccagataaccataatttgagtctttagcaaaaacaacgcttcccgagtcagcgggctcttcgcccactatgactttaagaagcgtcgatttgccgcagccattgtttccgacaatggctgcgtgctcatgttctcttatctgaaaagacaggtcctcaaaaacgaccttttctccaaaacgttttgtcagattggaaacacttaatatcataaaaattaacctaattttttctcaagattctctctgatagcgaggataaaatctcttgtattgagcttcgtcgggttcggaagcgatgtgatgcgggtcaggtcaccggtcatctttccagactcgatggtctctatcgtagcactctcgagcgcatcagcaaactttgaaagctcaggaataccgtcgagttctcctctctttctcaagccgccagtccatgcaaagatagtggcaactgagttcgtagaagtctcctcacccttaagatacttatagtagtgtctctgaactgttccgtgagcagcctcgtactcgtagtatccgtgaggggaaacgaggactgaagtcatcatagcaagtgagccaaacgcggatgagagcatatcactcatgacatctccatcgtaattcttgcaggcccagataaatccgcctctgctcttcatgatacgggcaaccgcatcatcaatcagtgtataaaaatatgtgatgccgcaggcttcgaacttatccttgtactcgctgtcgtagatatcctggaatacatccttaaacgtatggtcgtacttcttgctgatcgtgtccttcgatgcgaaccagaggtcctgttttttctcaagagcgtagttgaagcagcttctggcaaaactctcgatagatgagatcatgttgtgctgtccctgtacaactcccggtccgtcaaactcatgaaccagggctctctcctctgtgccgtccggcttagtgtagacaagctctaccctgccagggccagggatcttcatctctgtcgcgctgtaaacatcaccgtaagcgtgacgggcgatcgtgatcggtttctcccaggtctttacgttcggctcaatgccctttacaatgatcggtgctctgaaaacagtgccgtcgaggatcgaacggatagtgccgttcggggacttgtacattctcttcaggttgtactccttgacacgggctgcattcggggtgatagtagcgcactttacggcaacaccatatttctttgtagcgttgctggcatctatagtcacctgatcgtctgtctcgtctctgtgctttagtccgagatcgtagtactcagtctttaaatcgataaaaggaagcagaagctcgtcctttataatcttccagattatacgcgtcatctcatcgccgtccatctcgacgagcggtgtcttcatagcaattttattcattattaagcggctccttatttcattacgaagttaatgattctgccaggtacgaatatctcttttacaacatttccggtcagcttgtcagcgatagcctcctttgcggccgcaagtgcgtcgtccttctttacgtccttcggaaggctaatgaccttcttagtctttccgttgatctggacaggcatctggacatcttcttcctctgtaagcttctcatcccatgtcggccactgctctttaaagactgattccttgtagcctaagatctcgtgcatctcctccgcgaggtgtggtgcgaacggtgccataaggactgtaagggcctcgagagtcttcttgtcgactcctcccttctttgcaatatttgcaaaagtattcgtatattccatgaatcccgagacaacggtattcagtgaaaatgactcaagtctcgtagtgatggtctttatcatctggtttctaaggcggacaagctctttggtctcaggaacgtcctttgcgctctcctctacaacgagcttgtaaactttgttgaggaatctgctgattccctcgatgcctctgtcatcccaggcactgtcgacctctggaggtccgataaagagctcgtacattctcaaagcgtcgcagccgaagtctcttatcatatcgtcaggtgatacgacatttccaagtgacttgctcatcttgatgcccttaggtcctaagatcatgccctgattgaagagtctcttgaacggctcgtcgaaatcaactacgccgatatcgtggaggaatttcgtccagaatctggcatagagcagatgaagtactgcatgctcaacaccgccgatatacatatctaccgggagatacttgtcggccttctctctagaaacaagctccttgtcgttatgaacatctacataacggaggaagtaccatgaagatccggcccactgaggcatagtgtttgtctctctcttggcaggtctgccgcagacagggcaggtcgtgttgacccagtccgtcatggatgcgagtggtgactcacctgtgtctgtaggctcgtatgacttgacgtcaggaagaactacaggaagctgatcctctggtacaggaaccgctccacagtgagggcagtgaatgataggaatcggctcgccccagtatctctggcgggagaatacccagtcacgaagcttgtagcttacggttctcttcccgatacccatcttctggatgatatcaggggcctcactctttaacttatctgaatccattccgttccagtcaccggaatttatcatctttcccttcgcctcaacataaggctccttcatatcagacatatcggagccatccgggcttataacagggatgatcttcaggccgaatttctttgcgaaatcccagtctctctgatcgtgggcaggaacgcacatgatggctcctgttccgtggtctgcgaggacatagtcagaaacccagataggaacttccgcgttattcagcggatctatagcataagaaccagtccagacacctgtcttctccttgttctggacacggtcgacgtttgacttgtttgcagcagcctggcagtatgcctcaacctcagccttctgctctggagtcgtaagctcctttaccatctcgtgctccggagcaagtaccataaatgtggcaccgtataaagtatcaggtcttgtcgtaaatactgtgatgtgcttgtctggatcgttcttcagagggaaattgacctcggcaccgtatgaacggccgatccagtccttctgcatcttctttactctctcaggccagtcgagatcgtcaagtccctcgagaagcctgtcggcgtaactcgtgatctttaacatccactgacggagattcttcttggtaacaggggttccacacctctcgcagacaccgccctctgcctcctcgttcgcaagtactgccttgcagtgagggcaccagttcagaggcatcttcttctcgtatgcgagaccgtgcttaaacatctgaataaatatccactgggtccacttgtagtacttcggatcagtggtattgatctccatatcccagtcgtataaagcgccgatctgctgcacctgacgcttgatattctttatatttgcagctgtagaaatagacgggtgctggccggtcttgatagcatagttctccgcaggaagcccgaacgcatcccatcccatagggtgaatgacatacttgccgtgcatcagctgataacggctccagacatcagagataacatagcccctccagtgccctacatgaagtcctgctcctgaaggatacgggaacatgtcgaggcagtagtacttcggcttgctttcgtcctttggattaaccggtttttcttcccaaaccttgcgccacttctcttcaacagcgcgatgattataaatagtattcattttttcctccaacaaaagctcagaattagtatagattttaagcgtatgtgccggttttgtcaagaagcgccgctcctgtgattgacattaaatttggcatgatataaactatttcttaagaattaagaaagagaacaagattacgatgaactttaatccaagaaaaatagtttttgtggggctcgggctcataggcggctccgttgccaaagctatccacgccacatacccggatatcaggctttacgccacagccggacacaaaaagaccgttgaggaagcacacgccgacggacttattttaaatgatgatctcctttcagatgaagagatcgcagacgccgacgtgatttttctctgttccccggtactaataaatatacaatatctgtcaaggataaagccataccttaacagctcgactcttatcaccgatgtcggctccgtaaagaacgatatctcccgcgagatcgaccggctcgggctttcggatcagttcatcggaggccaccctatgacaggctccgaaaacaccggatactcctactctgacccgtcatttctcgaaaacgcctactaccttctgacttatcagagtgcaaaggcaaaggagatcgtcccgtatttcgacaagtttataagttcactcggtgcagtgaccatggtccttgagcctaaggaacacgactttgcagtcgcctgcataagccacctgcctcatgtgatctcggcttcccttgtaaatcttgtaaaaaacaacgacaaagacgatctgcttaaaactatagcagccggcggttttaaggatattacgagaatttcatcctcgtcgcccgttatgtgggaaaatatatgcctgtcaaataaagacgcgatcttaaagcttattgacgaatacgaggacgtgctcgacagtttcaaatcagttatagagtccggcgatggcagcagaatccgtgagaaatttcaggccgcaaaggactaccgcgacagccttcctatcagaaagaagaccggcatccttccgtctgagtttgttatctactcggatctccgcgatgagccgggtgaaattgcctgcgtagctactctcctcgcatcatcttctatttcaatcaaaaatatcggacttatacacaaccgtgaatttgaagagggcgtgctctctatcgaactctactctgaaagcgactacgaggccgcttttaaactgttgaaaggacatggctatgtactgcataaaagaagctgaccgactctccggagttgtcatcgtcccgggagacaaatcaatttcacacaggggaataatgcttggctcgattgccgaaggggacacatatctccacggcttcctcgagggagccgactgcctttcgagcatctcctgctttaaaaaaatgggaatatctatcgatcggaacggatcagaagtcacgatccacggaaaagggctccacggtctttctgccccgtcagatgttctcgatgccgggaacagcggaacgactacccgtctaatgtcaggaattcttgccggacagcatttttcttcgacgatcactggtgacgagtcgcttaagacccgcccgatgaagcgcgtcatttcccctctcacgcagatgggcgcttctatcgattccaatggcggctgccttccaatgacgattcacggcggctctcttcacggaatcgactacaagtctcctgtcgcctcagcccaggtcaaatcctgtgtgctcttcgccggactctttgctgacggaaagacttcagtcacagagcctgcgatctccagaaatcacaccgagctgatgcttcgcggcttcggggcctctgtctttactgacgaatcgcggcattacacagaagttgagcctgaaccccgccttatcgggcaaaacatcactgtccctggcgacatctcttctgccgcatattttctggcggccggccttatttcaaaaaatgcagagataattgtcgaaaatgtaaatacgaatccgacccgtgccggaatcttaaaagttatcgaggccatgggcggagatatctcctacatcaacgagagaactgtttcaggcgaagccgttgccgacatcgtcgtaaaatcctcctctcttcacgggactactatcgaaggcagcataatccccgctcttatcgacgagctccctgtcatcgccgtgatggccgcctacgctgacggcaccaccacaataaaggacgcagccgagctcaaggtcaaggaatcaaaccgcattgacacagtaaccgagaatctttccgccatgggctgtgatatcaccccgacagacgacggcttcataatacacggcggccgccctctccacggcgcgcagatcagaacgcacaaagatcaccgcattgcaatgagcttcgcagttgccgcactaagcgcctccggcgaaaccactctcgacgatcccgactgcgtcaagatctcctaccccggcttcttcgacaccctccaaaaactgggacagtagggacggttctttttgtcccactttcttaattttcagacaacttaatccagctcagtcacattgatagtgattcatttgttcgaagctgcgtcgcataggagggcaatagggtacacacactattttgctaatttttcaatattggctgtcgcggagccggaaatatataacagcaatttgagaattacggactgtatacgaaaactgtagtatagtccgtaattactagtcaggaattacggactattggcaagagatctttcaaagtccgtaaatactggtcgggaattacagactgtgagctaaaaactagtcagagtccgtaaatgcaattcgagaattacggactgtgaactaaaaactagtcagagttcgtaaatgcaattcgagaattacggactgtgagctaaaaactagtcaaagtacgtaaatgcaagttgagaattacggactgtaagctaaaaactagtcagagtacgtaaatgcaagttgaggattacggactgtaggcaaaaattcttccagagtccgtaaccgcagagcctggtatttttagaagcaaatatagtttatgattttgacgcgccattagcctatattgagaccaacattttattctttaagatttctatcccagcatcctgcttttgcaaacctcagtcacacagcgctgctttcgcgagcttatcggccatctcattgtattcgacgcctgtgtgcgctgccactttgtgaaatgaaatgtgaatttcgctgccgagtttcttcatctcggcggcgtattttttagtcaaatcagtgttggtcttccactgtcctgtcgcccacatctcgatgccctgataatcgtaatagatgtctacggctttgaagccattctcaagcgcgaaacgggcagcgtgcaatgcgccctgcatctcgcctgcaacatttctctgggcgacgcctgccgcgtcgtcgtaagcaccattaagcttctgaattgacccatccgggaaaataaacacgcatccgaaggcgtatgccttttttcctttctggaagctgccgtcaacataagctgtaaggcatttgtcggcaggaatatttttaagtgatgcccgggacgtacagccttgtgcagaaccagagcccgaagctgcgctgactgcatgtcccattcccgagttcaaatactcaagcgcctcctgctccgtcacaaagcccttgtaaatggcccctttaaagccgatcacctgcgccctgcactcgtcccaggtcttgaaaattccggtcttcctgccgctctttacgacgtaaaaatgcttcttttccgccattactccgcacccgttaaagtaacattgtcaaggactacgaccgacggaaccctggcgttgttgtactgcgtcatatcacttgaaaaatgcatcgacttggcgcagtctctcatcgagccggatacagagccgccagatacgatttttacagaagatccgtcatgcaggtagccaagccttatctcaccaaaaatatccccggtgatcgaatcgacctggaagtccgagaactcaacgacctcgagatattttccggctcttagatcagcttcgcttgaagagcccggagcgacctcgtagtttgagaggataaaagtgtcgtcaagacccaggtaggacgagaatttctggtttccccagagcttctttacgacaccatcaaagataagagtctcgtcgcggatcagcgctccctcatcgtcaaaggtgctgtttttgctggaattcggcaggaatttttttgaagagagagtgaccttatctccggaaatgtccgaagcgtatgcctcgccctgcttccagtcacttgccttctggtagaccatcccggcatttattctgtcagcgaaatagttccagacctggagagcatctgcggtcgaaagcataagagatacttttccaagatccggagtcggctcggttaagagtctgtccctgccataagctaaagtcttctcaatatcttttttgagcagggacttgtcgcaggtgccgctgtcgtatgagcggtagagctcgatctcgcgctcgtcatctctcgcgttagttacaacctccaagaaacttaccggatatttctctatagtatctatgccctctgaggtgaggtggcgcttttcgatcgatgatgcaaaaatctcgtagcagttgatgtctagagtctctgtctcatttatattatttaaagtctcgatgaaatcccttgaaatcttcgaagggtcggcatcgtattcagatggctttacgtcaaccggttttctaagggaatagagtggattttttacaagggaagccctcgataaaagagtctcgaccttgtccttcgtctcttcgatagaagctgtagggtcgatctcctctgtagctgagcccaggtatttcccgtcgggtgattttttgtagacggtcacattgatgtgctcggtgtctacgcagcggtactgatcgaggctgtgctttataaagtaaaattcaaagcggtttatcagctcatcggttacgtcccaggcatcggcctttgagtcctttaaaatatttaaaatatcgttaagcattatccaagcctccctactgtcttaagatacgggccgccgtctgaaaccttgacccattccttgtgtcccttgccgcaggcgccgtttccgaagcactctctgtcgtcacttatcattgaaatatgtccgagaaggtcaggaacatagcctgtcatgatgacaggagatacgacctttcctgtgagctttccgtcctttatctcgcggccaagctttacgatgcactgaatgccccagtgcttcgggtcctccattccgctctccataccctcgagcaggaagccatagtcgaccgactttatcatatcatcaactttcgaagtgcctgaatcaaacatcgtatttgtcattctggtgtaaaccttgtgctcgaaattctctctcttgccgtttccggtaggtttgatcccgagacgaagcgcagcgagagcatcgcagataccggtctttaaaatgccgttctttatctctgtgacgtcgcctgctaaaactccctcgtcatcaaacgcatagcttgtgacgtcgcgcgcgataagcgctccctcgtgcattgtaacgaggtcagaacccactctctttccaatgtactgggcacccaatgctcttccctttacgaactggtccatctctacgccgtggccaaacgcctcgtgagcgatgagacctgtgacctcagggcttgtgattatcgtatactcacccggttttaccggttcagcgtgaaggctgtcgagagcctgtttcataccagcgtcaacacagccctcgagtcctttaaaaatctcaggaccgcagagatctgagactcccgagtagccgaaattggtctttccatcggctgccacaatagggatgaccgtcccctcagagtagacataagactgtcttaagtctctattctcagataggaacatctttgaaatatgggtggactgggctgttaccctgacatcgactgcctcatcagacaacgtcattcccctgtcagaaagcttcgtcataaagtcgatcagcttcgaaacatcgcaggtctccggaatctcctctgtctccatctctttaaaaagagtgcatggctcgtcactaagcttcccagtcttatacatcctgcttccggtggtttttaagagctcttcctctttttcaaatgcatctctgataagcttataggaagaggcaggatcagccgggtcgaaacggttcagcgcgtactcaccgtaatggtcctcgttatggacacggacgacgattcctctctctgtagtaagtgtcttaccttcaactgtcttgttgccctgcgagacgcggatcaaaagtcccttggaatccgttgcaagagcactgacataatcatagtcatttctcaacaagccgatcagctctttaagtcctggcgctatagacttcagatattctgaaaatggtgctttcataaagatcttcctttcaaaaaaaaataagaactgccagcccaaaagggccagcagtcctattttacaatatctcttcagaaaaatctacaatcagtatgcgataccctgagcgagcatagcattggcaaccttctcaaatccggcgatattggcaccgatctgaaggtctccatcgcagccataccttgcagcagcatcgatagagttgtgaacgatgttcttcatgatgccctgaagcttctcgtcaacctcttcgaatgtccatgaaagtctctcagagttctggctcatctcgagagctgatgtagcaacaccacctgcgtttgcagccttggcaggtccaaacatgatgcctgccttcttgtactcctcgatagcctctggtgtagaaggcatgttagagccttcgcatacagcaatagcaccgttagcaacgatcttctttgcgctctctccgtcgatctcattctgagtagcgcatggaagatagatatcagcctttgtgccccagacacctgagcatccctcatgatactctgatccgtcgttagcacgggccggatactccttgatacgtcctctctcaacttccttgatctgcttaactacgtcaagcttgattccgttcggagctacaacgtatccgttggaatcagacatagtgatgaccttgccgccgagctctgtagccttctggcatgcatagatagcaacgtttcctgaaccagagatgactactgtctttcccttgaaggaatcgttctttaatgtctttaaagcttcctcggtatagtagcagagaccaaatcctgtagcctcagttctggcaagagatccaccgtatgtcaggccctttcctgtaaggacaccagtgaactcatttctgattctcttgtactggccatacaggtagccgatctcacgtccgccaacaccaatatcaccggcaggaacatctgtgtcagctccgatatgctttgcaagctctgtcataaagctctggcagaacttcataacttctctgtcactctttcccttaggatcgaagtcagaaccacctttgccgccgccgataggaaggccggtaagtgaattcttgaaaatctgctcgaaacctaagaacttcaggattgagaggtttactgtaggatggaaacgaaggccgcccttgtaaggtccgatagctgagttaaactgaactctgtaaccacggttgacctgaaccttgccattgtcatcgatccatggaactctgaaaagaattactctctctggctcaacgagacgtccaatgacgttgtcctcttcgagcttagggttctttgcaaccactggctcgagtgacataagaacctctcctactgcctcgaggaattccttctgctccggatagtgcttctcaagtccatcatagacttcctgaagatagttactcttgaatttcattgtttgtgaaatctcctttctttccctttcaaaaatataaattgctgtctacgagtcaaggacacgagtccgcgccccacaaacaaaacaattatagcataacaggaatcaatgtaaagaaaaattttgtttattttaaaaaaatccttgccaagacctcgccatccttgccaattttggcaaggatgattagttttcttttaatgaataagtatgcgtcttgtcatacttgcttccattaatgctgataagccctatttcaacagattatctccaagcatctgctttgtcctgtccccgatacgaagccaggtttcgtcattatttgtccggatgatctgtcgatcactgctcattatgtgaagcagaagcagacgatcgggttttcccttgtcatttgtgatatccacgaactcatctctatatcgcggcattggcttgcagagatctttcggtgtattgataaaatcattgatcttatcttctccgacagaattgacaccttccagtgttttcttcttgtcactgattccaagcacgattgtgccgccatcagcatttgcaaaagcggaaataagcggcgccagctcagctacacggatctgtgcagacttccggtcaaagtatttgttttcatgttccgtctgcatatactcaagtgtcagcagtgggttaattttagatcccatggtcatacctgtttacctttaaaaattagaaccgttccatccccagttggtacatggactgtactttacatacatctcatcccgttcagctgacgtaatgaatcctgctctcatcaaatctgtcctgctgaggacgcgactcggcgggatatccgagtgaaaagaggcagaacggctctaatgtctcaggaagatcaagaacctttctgacattttccatacgctctttgtccggggctattgcaagccatacaccgccgagtcctaatgagtcggtctcaatccacatattttctgtagcaatagacaggtcaacaagtgaaagttcaggagccgcaagtccgcttgtcctggagcacggtacaataacaaccggcgctccggcagcacacgccgaataaggacttgctttcgcaagggccttgatcttctcgtgatccgttactacataaaactcccaaggctgctggttgcaggcgcttggagcctgcattccggcacgaaggatctgctcgatcttctccttctcaaccggctgtagttgatattttctgatacttactctgtgaaaaatgctgtccattccgcaaaatctcctaaatattgattccttatagatgatcacagtctggctgtatgatctgaattgcaattacctttcagcaaacgagagcgcatattcatatagctgaatacgcggatcatcatgtacctctttgatcagcttctctgacgggttattcagacagataataccatgtaccggaaccttttctttccagttcttgtcaaaccagtccagataactgcagatctgtttgtaaacatcgtcatagccgctgtctttcttgagttctatgacatagagttcaccaagattatcttctgcaagaaggtcgagccgtccgactccctgcagcggatactgtctgccgaactctccgtgcctcttatatatcttcagcattcttccgaatgttggctttccggcctgtatccggctgaatatctcatcttcaagaacatgttctgcagagaactgctgcttcgatacacccaaagtaacatcagcatcttctgtcgccagttctgtatccgaatcctcagtttcattgtcatcagacagcagctccgggtctttcgaaattcttttatttgtggaagatgctttattgacgcgatccagcaaggacttatagattttataacttgttccctttacaaacgccttcgcatctttaaagcgtttcatggcaagaagcgttctcacataattatttgcagcatacttgacatctgctttttcatcaaggcacttctgaaagatctccagagccctgttatacatttttgccttgtaataagcatagccaagattattaagcgtgtactgaatctccggagctatctcatatgatttctgataatacatgatttcatttttatagtcctttatgctgccatatgaccatgccatgaagaaatagatatcaaatacagtgaagaaaaatggtgcctctttttccagatccagccgttcaaaatacgcaatggcattctcgtattttttatcacagtaatattcatagcccagcagttcatccgtgcaggatctatgaccggtaatctcctgcacattaagcagagactgaatgatctcatagtaatcatcagactcatatatgaccggaacaatcttgcagaattctctgatacccggctcagtatttatcatctgaagttcctgagtaacagcatcccagaattcaggaaatgcattcttaaaagtgttaacataagcatagatgaaatcttccagaggcatcggtgtatccttgaaagatttcctgtctttattcaaactttccctgatgtaatccaggcacttgtcaaaatcaccctcataaaaagaatccaatgccagataataaggatgtccctcaggcagatactgaatcatgcggtgatataagtctacctgagaatcctgagacagagcctcccttgtataattggtatataattttccaattacatctgcctgcgtcatgcagaaatatgtgaccattttaggaaaatcagcatcgttcttgtgttcttccaggatccctatcacatcatcttttgttctggtgctcgttagaagcttataataacggtcttcatctgcttccatgcgtttgttgcctttcgcttatgatttatcagctgatctcccataccaccgtcaccgtatcggtaacgtcgatatcgtccggttcgatgtccatgttataagaaccataggaaggtgctgactctgcaagcatcatcttgtccatcggcgaaaccgagaaatctatttcgccccaggaataatcgattgtctgtatctcaccaggcgtgactccggcagctttcgtcaaaacttcagccttcgccctggaatcagctactgctctcgcaagaagctcattctttgagacctctattttagtgccaggtaccgttaaggatatattaaggaattatgaattcctctcaacagtgcctggcaccaacgtggtcaacctaagccagaaagcccgtaaattgcggctttcctggctttttttcatgcgcagatttctgcaaaattatcacaaaaaacacttgacattgtgccggccgctttcactactgaaaaatcttgaggtagtgaaagcggccaattgattaaaggcaaatgttccgtcacagggacgggacaattctttatcaattggaggtactttatgaattcactatccatctgcaggaagatcctgcaaaaaatttccgaattgatccgttcagaagattttctggaatcccatcgtctgaaaaacaggtttattcggaaaggactcctcacaatgactcatatcattgtctatctgctcatacttcaaagcagcctatgagcataaacctggaaacatcccgcttgatctgccacagccgaattcccgaaagtcacaaaacaggccgttccaaagccaggcagggcattctaccatctcttttcaaggaactgtttgatgtctccgtagacacctactacagctccattaaaaaggaaaaaaatggcatgatctttatcactctgcaatcgatggatcgcgcatcaccatgccaaattcaaagtcaaacttcgaaaactatggagagatgttttcgcataacaaccccaatcgaaaatggactcttgctctctgctcaaccaatatgatgtctgcaatgatgtcgtgttcatggcataatcaaacgtatctgggctctgaacgtgacgctgctttaaagcactgtgaagagctcgaaaagcttgatctattcaaagattccgtggtcatatttgaccggggctatttctctgatgccatgttcagatatttctcagacagaggtatctctgcgtgatgcgcatcagagacagttttaagattgcgaagcagtgcaccggcgactgtatcctcaccttgcctggaaacaagaagaagggtacagaagacattgacattcgtgtcatcaagatcccgcttgacggcggtgttacaggtacctggctacaactatctttaatgaggatctgacagctgatgacttcaagaaaactgtattttatgcgctggccgatagagtcaaaatacggcgaattgaagcatcagtgcctgcttgaggaattctcaggtgcaacaagcacttcaatcgagcaggaattttatatcaatctgctgctctcaaacctgtctgccatggtaaaaagcgctgctgacgataagatcgattcccagagaaaagaaggaaacagatatcgctatcaggccaacagggcatatgtattaggccggatgaagtggttcatagcccgatttattgcaaaagatgtgagctctcgttgttgatgacatatttgaaggcgcagtgttaatcactcccagatacagccaggaaggaggaatcctcgaaaaaagaaatcagatgccgcgaggggacacttctataaccgaaaacgagctttataaaagttccgcgagaataaaaaagctttcaatagtaagctgccataactatgacagcataagcatgcaaaaaaaaaacgggaacattgctataaatcctggaggagagcgaggtgtgggctggcaccggggtgttctcagttgcatagtagcagaagaatgcgtctgaatgtattgcggactgtccttttgcggctccagcttactactttagacgccacacagtcggagggagggggtgggaggaggtggggggggggggtgtggggggggggggggaggagtgggggcgggaaggggggggggggggaaggaggggggaacagggggggaggcggggcaaaaatacataacataaaggggggggggaggaggggaggggaggggaagggggagggtggggggggaaggggggagggggggagggagtggggggagggggggggggggggcgcgggcggggggggtggggaggtaggagggggagggcggggggggggaggggaggaggggggacgggggggggaggggggtggatggggggggggcggggggggggagggggggggggcggaggcgggtgagggggggggggggggggggggggggggggggggagtgggggggtggggggggggtggggggaggaggaggggggaggggggagggggtgtggggggggtgggggaggcagggggggggtgcgcgggaatacaagggggggggggggaggggcgggggggggaaagaaaaaagggggggggagggggggggggggggggaggcgcgggggtggggggaggggggggggggaggggagggggggtggggtaggggtggggggggggttgtagtgggggggggggttgggggcttgggtgttggaataaagggtttttccggagagtgtcgggtgttcggggggggggggatgaggggggtggtgggtgcgggggtgggggggtcgtggtttttttgttttcgaccaaaattcaaacacacacttgtttttttttttttgtttttttgtttttattgttttttacccccaccttcaaaacgtggcagatattcaaacattataaaaatgcctattcaaaaatcctggagacatgcaattaagttaagttgacgctaagtgtaccacattggtgcctggcaccaacgtggtctcctcgcttttctcagtctacccgcagcatacggtaaccgacgccgatatgcgtctgaatgtattgcggactgtccttttgcggctccagctttttgcgcagtgtcgccataaatactctcagggaagcaatatcgttttcccagctgctgccccaaatctgctgcgtgatataggtgtgcgtcagcacctttccgacattatgagagagcagacacaaaagcttgtattcaataggggtcaggtgcaattcctctccatttagataagcgcagccggcggcataatcaattttaagctcgccgttttggaaaacgggagaatcggtatcgccgcttgcctgaagaagcagcagccgtctttgcgtgacacgaagccgtgctaaaagctcctctacggaaaagggctttgtcagatagtcgtccgccccggcatccagcgccgtgattttgtctttatcctcgctgcgcgcactgatcacaataatgggcatattggaccatgagcggatgctttcgatcacctgtgtgccgtcgatatccggcagccccagatcaagcagaacgatatccgggttatgggaggtcgtttctataatagcgctgtgtccgttctccgcggtcagatagcggtaatcgttagcctttagcgttgttacgatcagattgcggacagggcggtcgtcctccacgacgagtacaaggggtttattcattcagagtcacctcgctgagcggtaaagtaaaggtaaatatgcagccgtgcggtacgttatccgtaagcgtcagcgttccgccgtgcagttctacgatcgatttacacagggtaagcccgatcccgaagcttctgcggctgtctgcgacggtattttttccggtgtaaaacatctcaaaaacatgcggtttcatatcgtctgcaattccgtttccgttatcggtgactcggatcacggcattcccgccctgtttttcggcacttacgcagatctcggagccttgttcggtatatttcaaagcattatcaataaggttgacaatgacctgcacgataagctgtgcgtccatacgggcaaggatcagatcgtcgcaccttaccgtcaccttgtgtccgacggattttttcttcaaatgcgaaacggcttcgttgaccacttcgtctacaagctggtcggtaagctccagcttcaggcgtccgtcattcagccgtgtaacatacagcagattttccaccacgccgatcagccattcggaatcgtcataaatatctttatagatctgctgcttggttgcttcgtccaggcggtttccgttatgcaaaagcgtgtccgcattacccgaaacggagcaaagcggcgtgcgcagatcgtgtgagatcgaccgcaaaaggtcggcgcgcagctgctcgctttttgcaagatctgccgcccgttccttttcggcggcgttgtgagcattatccattgccagcgcacattcgttcacaaccgacagtacgatactgttctcaaatgaatcgggcttttcgggtttcatcggtatcccgatcaccccgtagactctgccgcctgcacggatcgcaagataaaaacattcggcttttccaaactgtgctgtcgttgctcctgcacggcgaccgttttgaagcacccattctgcggtctgccgctctgcatcgcttagcagcttttcagcgtgtgtatcctttttttcggcataaagccgcccggacaacattccgttttcgcctttcgtataggcgacaatgcttcggtcaagcagccgtgagagctgcatacaggtcatgcttaaaacatcatcgttgctttttgctttttgcagcagacggtcagtgtcgaacagcacctgcatacggaacgcggagcgagccgagagccttgcatgatctttcagcttcgaggcaagcgtgccggtgagaacggaagacgccagcatgacggcgaaggtaacgggatagcctacggcataggtctgaaaggacaacctgggtttggtaaggaaaaatccgaacaatacaacactcagaagtgagcctgccatactgcaaaggtatcctttggtcaaaacggagatcatcagcacaccgaggatgtataccataacgatattggtatcgggaaagctgagatgatcgaacagaaacccgatcgccgtgcatacggcaagcatcaggacggttatggcaatatcccgcagcgacggtatctctgcaccaaggaacagacggcgtctgtgcggctttgtgtagttcagcgcatcgggaataatatgaatgtcaacatcaggggcggaggcgatcagcttttcggtgagagtcggtcttccgaacagccctctgcgtctggcactgctttgcccgatcacgatttttgtgacatcggaaagtttgacatattccgagatctgcagcggcacatcctcgccgtgcgtcataacgatctcggcgccgagcctttgtgcgagctgtatgttctgcgaaagtcgggactgatcctcatcatttatgaccgtatccgtctgcacatagatggcggtaaatcttgcatgaaggaccttagccatctttgcggcggtgtgtatgattcttgcattggacggcgaagaggacaggcagacaaggatatgctcatctgcgtctttttttgactgctcggtttgtgttgtcatccggttcaccgtccttttgttttattatacatcaaaatcgtgaaataatctaccgcaagctaatactcatcttctttcccgtcggaaaggataatatcgactgttccgtgcgtttcccggaaacggtggatctcgcttaatatctcactgtcggacagtccatgcggcagcgtgacttcagaaggctcgcaggattcgttttcctttaacagtgcctttctgttttcttcaagaaatcgatccagcctgcacatgacataaaatccgaaagcaaatatgccaatcaggctgacaatcagcaatagctcagccatcctcattcacctctgttaaatgcgaaagcacttttgcagttctttgtaagcaccgagaaccaaaagagtgattttgtccgtaagaacggtttccggtgaaactgccatattgatctttccgttctccttggtcgccatgatattgatgctgtattttctgcggatatccagttctccgacggtttttccgatccatcccttcggcacctctacttcaaaaatggcatgagcctcatcgacctcgatgtaatcccgtatgtgatcggcggtataccgaatagcagcccaatttgctacttgcttttcagggtaaattacttcgtccgctccgttacgcagaagaaatttctcctgaacatcacgctcggcgcgtgacacaactaattttgcgccgagttccttcagtaaagatgtagtctccagcgaattttgaaaattttctcctatggtgacgatgcacacatcaaagtttccgatgccgagcgactttaaaaattccgcatttgtgcagtcgccgatctgtgcattggtaacgattggcagaatcttattgactctttcttcgttactgtctaccgccatcacctcgtgtccgaatttattcagctgtaaagcgatatgcctaccgaatctgccgagacctattaacaatatgtttttcataatatagtaactcctttatccgactgttattttttcgagcggcagctttgctccgctctgatttttgttaggaaccgccgcgtaaatcagggtaagtccgccgactctgccgagatacatcaagacgatcaaaataagctgagaaagaacaccgagcttcggtgtaatcccaagggtaagcccgaccgttccgacagcggacgccgtttcgtataggcaggtgctaagcggcagaccttctgccatgctgataacattgccgccgataaaaaacatcaggaaatacattacggcaacggctgcggcgtttttcactgtcgaaccgtcaatgcgcctgccgcagacttcggtatcgtcctttttgcgacagacggagaatgcactcagaatcagaacggcaagcgtagttgttttcataccgcctgccgtggagctgggcgatccgccgataagcatcagcagaatcataattgccttagaggaaccggacatagcgggaagatcgacggtattgaaaccggcggttctcggtgtgacagactgaaaaagcgacgcaagaatcctttcggagagcggcagccccgtaaaatcacagaagaaaaagaatactgcgggagcgataatgaggattgccgttgttaccaatatgaccttactttgcatatggtattttttgaaatgccacttgtttgtgtaaatatcgtcccaggtcaaaaatccaataccgcccacaataattaaaagcataattgcaatgtttattgtcggatctccgatgtatcccgtaagagacgggtatttgtttttggcggtgccgagtatgtcaaagccggcgttgcaaaaggcggaaatcgaatgaaatgccgccatccaaattcccttgataccgaagtttctgcaaaatgtcggcagcatgacgatcattccgataagctcgatcaaaaaagttccccgtataataaagcgggtcaggcggacgatcccgccgacctttggggcagagatggcgtcctgcatggtgctgcgctgcatcagcgatatttttctgccggacagcatagcgaaaaataccgcaactgtcacaacaccgagcccgcctatctggatcagcagcagtattatcgcctgcccgaaagcggaccaataactgcccgtatcctgcacaaccagccccgtaacgcaaacggccgaggtcgatgtgaacagcgcctcgtgaaatggcgtaacaactccggcagtcgatgaaaacggcagcatcaatatcagcgctccaagcactatgacgccggcaaagcccagaacgatcagcttaaaggatgacagccgcttttttctatgtgtaagcatatatacttctcctgtttctgtttgtttacaaagagtatattatgaaatataaaaaaatggtgtaatgatccggcgctctgtattaagattgcattaaggcaccagatctattccttcatcgtgatgaatgactcctgttcccttcgcacaagcagcttcggtatcctgaaaaaggcatactgactggccccgtcagctccataaaaataatcgtagggcatcttgtcgtcctccgttcgggtaaaaaaagacgtctggctgattaaatcgaaatcagacaaacgtcttttaataacaggcttctttccaagttaaagaagtccatgaaaattagcgtaaatattatacactaatcaggagttgaaataactaactccttcaaaaagagactcatcgtactggcacttctccggatctcctgtcacatcatgaatctctatggtctaaattcattttccagtcaggaccactgcagtgatcacacccatgcttaccgcttcagtgataagcggtaccatcgcagcataaaaagccttcatcggtttcattctgtaatacaggacatacagcactatgcttatggtaaacgctattgcaactaccactgcaaggatccagaacctggtatccgaaagcctccctgctccattcagtgaactgataaccgtaagctccagcatcacccacccggtgataagtaccagttccgtagtaacctgtctctgaaataaaaacctcgtaataagaagcagtaatacatatgctattatgcctccggccactatcacaatccctgtaattttcagatgaccggtcttctgaaccgcattcactccgtatatcgatactgcaataccggcaagtccacagaatgccgtaatcagaagcattatcccgttaaggcctcctgcacgttttacttctactccaggcctgtacgatatactccaccatatcagataaaatatacagcagataacaagaagtatctgtccgataataatttttccaaaagctccattagtcattcttctttctcccatcccttgcacacattgcaccagcctgctgcaccagacgctttctcaagttcctccggagtgatctttaccgaagtaaactccttatcataaaaaatcaacaatctgtaccgtgtcacctgctgtggattaaactgatttctgacaagaacaaaacctgcttttatcctgttcagaaaccacctgctgtaaaaggccggaatatccgtaccacaagacaggaattgtcaaatggtacggaaatagcgaaaaaaatgctatggcattcatcttcattaagctccatcacaaggtacagagaaagacaagtaccagaaaaataggtcgccgaatgtgcatttcagtttcttattatctgaatctggcatgacgccattgtctcaagcgctgccctgtgcttctccggagtgactccggcgcagcaagacggatctacggaaatctttttttctcatctgttcacctcgacgctgatactttctgcttcagtcaatataatgtatcctgctctggtcgaatctgtcctgctgcggtctgctctcagccggatatcccagtgggaacagtgaaaaagcttcctgatcatccggaaggtcaagcacctgctttactttttccatgcggtctttatcaggcgctattccgagccagacaccaccaagtccaagagaatccgtcatcagccacatattctcctggcatatggacatatcctcaagaaccatacttgggaacatcacgcccgtctttttataaaccggtacgatcacaacaggcgcaccagcggcgcatcccgcataattgctgcattccgacagctgccttatcttttccttatcggtaacgacatagaattcccacggctgctggttcccggctgaaggagactgcattccggcctttaatattccggttaatttatctttctcaaccggcctgtcttcatactttctgacacttatcctgtgaaaaatactatccattctatcaccattccttcctttgatacgattcattatattgcatttcaacgaaaaaataaaattcatagttaaataaatagataaaacaggctgacaaccaccccgaagtatgctagaataggagacagtaagcagttggttacataccggtccaaaagttggtcccggggataaggagggcaattcatgaagtttattaaatgtgagaaatgcggtaaggtagctattattgcaaaggactccgcctgcgacaccatgtgctgtggacaggctatgacagttctcaagcctaacacaactgacgcagcagttgagaagcatgtaccagttatcgaagcaaacggatccaaggtaactgtaaaggtaggatccgtagagcatccaatgcttgcagagcattacatcgagtggatcctgatcgagacatcacaggggtatcagaaaaaggacttaaagcctggcgacaagcctgaagcagtctttgcactggctgaaggagaaactcttgtagcagcatatgattactgcagccttcatggtctctggtcagcaaaagcctgacagtggcgcttaaataaatatcatctgaaaaaggggccgcaaggcccttttttctataacagaactgctgcacagcccgattacttaaaagctccgtctgccgcctccatggagagccttctcctcttcataagcctcatgctctgtctttgacatgcagacaggtccaatgtctgtgttatagatctttctatccgcaatttctgcgggagcctcattttttaaaatctcaagcgttttctggtctctccgcccgccatagaacttatcgatcactctcgcaaacacctcttcatcaggagccgctttttcaaaaagagtcatgcacgacagcagcttcaggtaatccggactcccgaatacctcatacggatcatctgtttcaaggtcaagaagcgcactgcttatctcaataagcctctccccaagcaccggatccttcataaaatccacggcttccttaatgctctgtatcgaatagaacctggaaatgcccgtcatccccagcccatgaatctgtggaaaaatgtaccacatccagtgagaacgcttctttcctgcttttatctctgaaagcgcagtctcgaaatcatccttctgcgcatccttgaacctctgtaaaccttcagacatcttatttttctccttgcaggcgcaaggcccttatgtgactatcttatcatgcaaaaatactcatgtcacttcctgatcctgacatctataaaaagtctcttcctgccatcccaaaaataaagtataatagcagcatgaacacaaaaaatcttatgaacctctcagcagcagaatattttaaaaagagcctgatgccagccatactctcagactatgacaggctttcagccgaaaacggccttatagtcatagagggtgccggctcatttcaaggttcagcacaccttttaggtgtgggaggtttagttactgatagatttggtgaatcatagtgtttatttcatcatggatttcatcacatttatcatattcattatcaataatatatttttttattaattttacctttttgcttatttcggaaatcatttccggtgaaggttctatatatggaatttgtttaatgtaatttgcagaattatttgcagtaggattgataatatgtatcaattcatttatgacatctgaattcattaaagccaatatatacaacaattttgtttcatcttttggaaaaatgccaacaatcgattggtcgaatacgcgcttgtcaatcataaaagctttgatcgtgcttgactttaccattggaatagcaacacccgttttgaaataaaagcttgaattttgaaagcgagatttaccattactgttatagaattttattgtttctgagtcccaacgaacaaaccattcatcacttgttctaaaatagcgtgtttttgaagcactcttaacatacggaatatatccttcatctacatttggaattccattaagagaatcacattcaaatattaaagaacttttaattttttcatagctttttccgcccttgacagaatcattaagagcgcgaataaatcgtttgttgtcaccggtataaaatcctgttactacatcggcaacatctcccaatttaattgatgaattattgataattgatgcagttcctttatctgtcaaaatgaaccggtgctgggcattagagtatatatctttttgtttgatattaaatgtagttaagtttggtggtaatttctcactaaatagttctgctgattaaccgcattttcagcaatcagcaggttataccgcggaaaaaatttccgcatttatataacggccgcatatctgtggtcaaaaacagtaccttgaaaaaagcacaaaataagtcagacgccctgcccaggattctgaacaggttcgtccacaagatggaaagccctacagagccgtatgatgtttcttcaagctttgtttttatagtcccagacgtagcatctcttgctgagctaagctcctttccacttcgatcctgttgtattgtctttatattcaatgtgcttttcttcacactgagttccttgacggtcttccgagctttggccctgagagccttatgccgttttctttgcagaactttctgtttttctttgttctgtagatctgatctgcaagaacacgctccggataatgtcctgtccgtgttttatgattccacggctctcttaaggacttcggattcatgtatggatcaaaagttatcttttcgatccttcccatgtggtcctcatcgatactgaggtcgaacttgataccgaattccacgggagatttcgtcttgcctctcactataggtctgatatacggctgtgcgatgcttacgatcctgtcggctactttatgcgtcttgttgtcatacatgtatttctgctgctcatagagctttctgatcgtatctagaagcttttcttcttttggcagaagtgcatatccgtctgatatatatctgtcgtgtagcccagatcgcgtctcactagcccagctgcttgcgtactgtcgctctgatctttttctttgagcgtttcttgcattttgcaaggttgaggtaatcctttcttgcctccctgcagtaagtacgcgttctgtaaagtccgttatctccgcagatacggaagatgatatcttcaagtttttccctggcttctttcagcagtgaaaaatcctgtggataacgtatgtatgagggtgcacatgtcgcatcgattatgagcgttccgctgtttacatctttatcagcagcttcaggactttcagtcttgcagattttcttcctactgcagcagaccttcgagcttccgttgtcgttcttatcatgcgggtctttgttctctgaatcctgcttcgctttattttcttcaagcaggatgtcatcatgaactgactcatgtcgagatctatcgctttctgaaagctacaagtgtgctcgcatcaaacggcggcgtctcctgatatcccgggagccctatgaaatactggagatacgggttctctgtgatctcctctacaagctctctgtcagagaagcctaaacgttctggatcatcagtgctccgagagccatcctgctagctttgcgacatttcctgtacacttctgaaacgggaagctacttttcttcgtattcatcccatggaatgagcctcgccagcctgatccagcggtttttccgggttcatgtgcatcccgagcggctgattgaaatcaaaaaaaaatactctgacttatcttttgctttatacacgattttaatgctccgagggtaaaattttattcagaaactccacaaaaagatgaatgaaatatcaaaaatccatgcatctattatacctatattgagccagaaatcgcgtattttaggcaatttttaaagattttttgctaatcagcagaactaaataaacttgcaaactcagctgacgaatcaaatcctttaataattttaatttcattatagacctccaaaatctattaccatccaatttattattatgccataaaagagcggctatctcaatttagtaactattaatatcgtcttttaaataattgtatctctttgcagatttaagcgtcaaatatgcgaaaaaatggcataaagaaaggcggatagcccttgaaaacaaaggatttacgtcttattttattctccttctgaaaatacgcttctacattcagtccacggatccgccggagcatctcgaccgaatcgaccgtgttcctggcgaagcggctgatcgattttgtgaggatcaggttgatatttccggcttcgcagacttccatcattctaaggaactgtgcccggtgccggttttctttatttttcataccatttgatgtattctctaccaagatcagtgagcttgacccagtaatcgtacttaaactcaaatttcggctcatggtcatacagattcggatgtgcttcatatgccttcctgtcagacatatactgttctttcagttgcaggtaatcctctttatctgattcctgtttgtataattctatgcatttcttttctattgccgatagattaagcgtatattccggcttattatctgatctccacctgttgctgccatcctgtattatatcgcatatttcttccggcaggtcctcctcgtcaaggtaacttttatcggttgttccgacatgtatcggtttctcgaccgccttgcagagctggtatagccctgatatatcataatctttactaatatcggggattcttataagattatctgttataaattcaaccggcatctgcataaatgaaaatcctttatcaggattttctacaccatattgatatatgatgtcaacaaatgggtcattattctgatgataatatgattcgttcttctcctcataatttccgataatactctttatatgtcttattttctgttgaacggcaaaacttccgccatattcccggataaaagaataatccatcggccacatgcatggactgtcattctttttatttacctttgccagatatacggtgtatccgaatatctccatttcctcctcagtaagtacagtgtgttttactttgtcaatgattgctggccagtcctcaaaaaggaaataaggaaaattatccactgcagcttcatccgcttcttcccttctctcgccaaaaatctgtaaaaccgtcttatcgcgtgtcttctggtctactccgtacacatccagcaagtcatgaagtgactccttcgggatcctttctgtccgttcccatccctgcagtgttgacactgatacttccagcttctcagcaaccgcttcctgtgtcatccctgtttcatctcttaacttctttaatgtattcatgcgctgcctccttgtaatgcttgttattaaatgataactatacaatagcggatagccggtacacacacaactgacttttaacccaaaactcccttactgaaaatgattagttatataaaaataattacaaaaaatggttcatatctcagaaaaattgagatgaaccatcaaaatttttaagtgtgctttaaacatcttattattcctggctctcagagagtttcctggcggtctcgcttgcggcgaggccgccttttccggtttctcttaaagtcccgtccatcattcttccaactgacttcatggcgtcgatgacttcatctgcaggaatcctgctctctattccactgacagccatatcacttgaagttacagcgttcacggcgccgatcacatttctctttatgcacgggacctctaccaggccgcagactggatcgcatacaaggccgagaagacccttgagtgcaagagcggatgcgttaaaaacctggtgaggagtgccgccccttaaataggtaagggctcctgcagccattgctgaggcagaaccgatctccgcctgacagccgccctctgcgccggaaagagaagctctcctggcaatgacacctccgattccgccagccacataaagagcctcggtcattctgtcatcggtgcaggtatccggatctctctcctggaaactgataaggacagccggaactatcccgcaggagccggcggtcggagcagcgactattcttttcatacaggcatttgattcagcaactttcaatgccttccccatgactgatgtgataaagtcaccagctataagcctgccatgggccgccgcagcctcaagccttcctgcatcaccgccgctgagaccgctcgtagactgaagagccggatcgtacttcgcgatagagtccttcatagccatatacatcgatttcattttattaaaatccgtctgtggcctgatcccctgatcctgtgcatcatcgtccataattatctgccaaagcggcttgtcagaagaagccgcgtcattttcgagttgtgctaatgagccgtacataattcctccatccgagatcagagcggactataatatgtcaccttttttacgccctcgagtttcctgagccattcgatgccatcctgcggcacttccttgtcgagctctaagaccatgacagcgtttccgccgcgtctggagcggtagagctgcatggtggcgatattgacatatttgtgctggagcattgaagtgacctcagccacatgacctggctggtcgacattgtggacaataagggttggcagttcgccgctgaagttcgcagtaagaccgtctatttttgaaatacggatccgaccgccgcctacggactcagcgataactgagagttttttgcctccgactcccttcatatcgacctttgctgaattcggatgagcgtcttctcctaagtctatcggatagaattttattttaatcccgcgatccctggctatgtcaaaagactcgggaattctcgaatcatcgacatcaaaaccgagaagacctgccacaatcgcgcggtcagttccgtgtcctttgccggtgtttaaaaatgagccgtgcagtccgatccttgcctcagcaaggtcttccgcaagcagcttcctgcaggcgtttccgatcctgacagctccggctgtatgcgagcttgaaggtccgaccattaccggaccgattatatcaaatagattcatttttccctttccgcatgacctctgccgctgcaaaatgataaaaaacagataatgacagtatagcatacacaaggcacaaaatcgagcgtaaaagcccttgtccagcctggctttgagtatttaatataaagatggcagatatcttcaaccttccttatcagcaaaactatggaataaaaaaaagaggttatttgcaataacctcgtctgtcatttcgtatatttcagatccctgaatgccatttcgtaccctgcctggtactgtgggtctctttatatttttcctggagctttttttcaagtttcttttcagcaacgaactcctgcttttctttctcgacctgctcgtctcgttctgcctgatactttcttaatatctccatctcatcatcagaataagattcgaatgctattctcgcatcgatgaatctgccgtactcgttacccatatctggcagaggatcttttctctcactgtcaattgatttctggagattttcgataatacttttcttttctgcatcattcataagtaaatcccttatcgcatcctgcagacttaattacccgaaggatgcggcatatactcatagagtttcattgccgtggaagcgataggcatactctgtaagatcagatgtcccggtccgtaaaccactgtattgaaaaggccctctccgccaaaaagaacattgcctattccttttactgtctgaacttccattctgcagctctctgacatagcagccacatacccggtgtctacgatcttgcagtcacctgcaggcacatcatattcgtgggctgaaccatcgatttccaggaataccagtccgcttcctgtgaagcgtctcatcagaaagccctcaccgccgaacagtccgcggcttaaatgcttctgaatatagacttcattatttatatttccacaggacgccagaaatgaacctttctggacaatgagtccattgccgggagtaacctctactgctcgtatcgagcccggaaattttgatgaaaaagctatctcccctggtctgtttgctagataagtgttcatgaaggcattctccttcgtaagcatacgcccgaacatcttacccaggccgccggcgcttgtctgcatctcgatttcattgtccatccatgacatagcgcctgcttcacattgaatattttctccggaatcgagctgcactttcaataccggaaggtttccaccgctgatctcatatctcatattcgcttccttttataaaaatatttctgtgtcagattgtttatgacatatacttcgatacattcgatgaatcaacaggctcaaatggaacccagccgtagagccggttgtccgttacacccttgattcctttggctgactttccactgccgagcgttttcgctatctcgactgcctttgcagcctgtcccttggcattctggaaaacagtaaagctcatctttccctgggaaatggacttgcagccgtccgatgtagcatctactccggtcacagggatcttcttcgggtcgaggccgttgtcctcaagggcctgaatggcgccgagagccatagtgtcattattcgaaaggatcgcatctacagacttgccagacttgaagaaaaggtcgagcttgtgacgggcttctgtgtcaagccagtcgcagtaatcttcgaaaacgatatttacctttattccatcgcgcttaaaagtgttcttgtttgccagagttctctggatcgtagctgaatgtcccttctcgccttcgagaattactacattcatctctttctttccaagttttttgataacgtactctgcctgcagcttgccacactgagattcatcggaagctacatacatatacttgtcggctttaagtgcgctctcatcaggctggttgtttacgtagataaccggcaggccgcctgctgcaagctcaatctgcggagctgtcgaagcgtcagcgagacggcagatgatagcagaataacctcctgacgcagcatttctggctgcttcggcctgtttctcgacatcttcaccgacttccctgtcatcaatcgtaactccggccttctttgcctctgacaagatagcatccatcagagattttctgtacgcatctttcttgtcggtgccgatcagcatgatctttccgctgccaccgctggcagatttaccggaagagcttccgcatcctgaaaggagaccgacgctcatagctgccatgccaacaaatgctgtaatttttttaagtaaatgttttttcatcgatgtctgtctcctcaaatcttaaacttatttacataaccggtcagggtatctgaggtatcggcaagttctttggagttgtccttaacttcctggctcgatctggtgatgttctcagccttctcgaccatatcctcagaagtctttaagatttcatctgaagaagcggcctgctcctcggaaatagctgcaacgtttgctgcaacatcgtttaccttgtcgacatcggctgccatctcctggatcagattatccgactgctggatgttcttgtaaatatcgtcaaaagttgaaacagctgtgttgatgagctctgtgttctccttgatgctctcagcactgttattggcctgatcgacaaccttgctgataaggctcttgacctttccgataagctttgaaatattctcagcactgtcagcagagttcgaagcaaggcttccgatctgtgaagcgacaactgcaaatcccttgccgctctctcctgctctggcggcctcgatagaggcattcagtgagaggaggtttgtctcgtctgcgatctcagaaataacttctacaatctttgtgatctcctcagaagcacttccaacctcaccgatacttgaaacaagttcgttgttagtcttttcgatacggaccatagcctctgagaggctcttcatatcgtctctgcccttctgtgagagctcaaccgtagacttcatcgaatctccggccttcgaagatttgtccttcgtatcagatactaccatagcaagtgtagtagcgttctgtgcgatatcgtttacagcctttgagagctggtcaacagtatcgttcaggttcttcatggcctcggactgcgacttcgagtcattgagcatcgacttcgatacctcatccgaagaatccgactgtttcttgagtctgtctgactccgcgttgatctgcgaaagcataccgcgcatcctttcgacgaacttcgctacagagcccgacatggcaccgatctcgtcgtttgacttctgtgttacatgaatagtgaagtctccgtttgtcatagccgtgatattttctgtaatatctgagataggagctgttactctctttacaacaaagtagattgaaatcgagataataatagctgcaagaataccgacgaagatgaggatattcgtcatctgtcttacgccgctaaaaatggtggcagccggtacatatgatactaacagccagtcagttccctctatctgcttaaaggccacgagatttcctgcgatagtagaattgttgtaattcatcgtggcaatatttcctgctatgcctttaagaagcggagatgtagagttctttccaagcttctttccagagagagtgatatcagggctcgcaaggatcgtgttgtcgttcgtatcgataagcatagccttggcatctgtcatctttactccggagtttacgatagtggaaatcttgttcagagagagatctgctccgatgactttgagctcatcagaaccgtcatcaagcataccggtcgcactgattatcatattgccatagccatcgtcataggcacttccgaagtgcatcgaaacagaagtagttccctgcttaaaccaggtggaatcctcaggattagctgcggaatacgacgatttcgtaggctttataacctttccggtggctgttccgatgtgaagaccatcggcggcatttgaattgtagccgtatgtagcatcgataatatgctgaagcgccgacatacccggctgtgtctgctctatcaggtgcttgacagatgaaaaatctgccagattctcatccatccaggaattgatactttcagcctgatttgccacagacgcggtcagctcatcagtagccatctgcctgattctctttgtcgaagagagatctgcgattaaaatcagtacaaataccatgacaagcacgagtggagcaatgagcttcatcagctttcctctaaccgagctccttctcgccacagacgatgaagtgttgacttttttcttcatataacctcctgaaaaattctctcctttttttacaagtaacttatatcatacaccaattctgtaaaaaaatgaacaggaaattacttcgtaaatttaattaatctgctcacatttatctcaagctgatgtctggtgatgtttttttgctcaaggccttttaaaatctcctgatagtcatgcaggcttcccggcataaacagtgaagtgcctgaggctgccaccttcacaggcgatggataagcccactttgaacccttctcggccatcataggagctatccagtccgtcatcaaggctccatcaaatccgaattcacttcttagaatatctgtcatcagatctcttctctcagatgaatgaactccatttatcaggttgtagctgctcatgacaaagcccgggtgtgactcccttacagctatttcaaaacctctcaggtagatttctctgagagctctctcacttacgcaggaattcgaaaccattctgtttctctcctgattgttggctgcgaaatgctttatcgtcgtgtatcttcccggatgtttctggacacctttcgtaatagacgctgccatatgcccgcttattagcgggtcctcagaatagtattcaaaatttcttccgcatctgatgcttctgtggatattcatagccggcgcaagccagatatcaacgccaaatatctccatctcttccccgacgatatctccgcactgctccgcaaaatctctgtcccagctctgtgcaagggctgttccgatagggatagctgtcgcaaactggtactttttccgaccgccctttgccgtgcggcgttctgcaagttttctctggatagtgggccagagctttactaacttaggcgaatactcgaacagggaattaagcatcggatttccataggaatatctgccctttttgtcctctccgtactctctgtcgagtctaagcccagccgggccatcggccatcacaagggctcttatgccttttttcctatcttcgtatgactcgcccgcgcttcctggaaccctggtccccgccagaccgatcgtgctggcaatgcctccgttctgaaatgctccgacagaaagcatcgcaagctcttcatcggacatttcactgacgacagggtccactctgtccgtctcatcgtaatttacatcgaggcagtcgatatctgtctgagacagcccgatcactttcgcgttcacagcatcctgcgggatcactcttctatcatccggagtataatccttaaaatccgtctctccaagtgaattcctgacctgcttcacctttacatcctctgacgcgcgaagaatgcaggcagttctggtatctttggagctgtcacccacagagattacggtgtctcctgccggtatgatgtaggcggctcctgcctcgtcatagactgtgatatccctaagatccacgtccgcagagactgtcacttcttctcccggttcgattgttttagactttacaaagccagccagaactttgcgcggtgtatctatcctgtcatccggaagtgacgcatagacttccacgacttctcttccggcaaatgaaccggtattttttactttagcagacacagtcaggataccgtctagaagcgacgcatcctgtggagtcacttcaaagtctgtatagctcttcccgaatccgaatgggaaaagcggcttgacgccggctgcgtcatagtatctgtatcctacatatattccttcgcggtatctggtgtcgttcttctcttcaaaatctccgacgatctcgtgatcattccatgaaacccatgtagtagaaagctttcctgacggatctgccttcccaagcagaatatctgcgagcaccactccggtcacagctccaagctgtgacagaagcagaatgttgtcaacgacgttcactacaggcgacagatcgaccggcccgccgacatttaatacaaggataaatctcctgtaatctgccttaagctgcaggatatcgcttatctctgtcttcgtcagcaggatatcccctctgatgccctttctgtccgagccctcaccacagacacgcgagagcacatagactgccacctctccgctctcagtcaaaatatcatattcaggttcaggttcgatctttcccatcgaatactgaatcgggttcataccagacttagctgcttctgtctttacactctttacaaatgaagcgtgtttttcctttttcgctgcgtcgtacttgtcaagccagtctttcgtcgcgatcgtaaatccggccctctcaagcccccgctcagctgtatagtaaaatctcgaattcacttctcccgagccggtgccgccttttaaagtctgcctggccccgcttccatagagcccgatctcacacggcccgtccagtggaaagtcactatttctcttcaggaaaagtgcacatccggccgccccacttctaagctccctcaggtgtctcttttcgtactcagttatcttcataaaagtcctccgcttcatcgcagatataaaacaaactacttaacattataaattgtgcggcggttttttacaactgaataaatttaaaaattgctatgtaaaaagcgcatactggtataaactataagtatttttaaaacacagaaaacgggagcctgtacggctcccgtgttttacttcagactccgcggagcctgaaattaatatgccatcttaaagattgcaagaatgtcatctctgtcgagtggctttggtcctggaagaacacgatttccgttctcagaaaccatgtcagcgaacttctcgatatcactctctttgatctcatctgaaagctcgcggagagttacaggcattccgatcgaacggtaatagttctcctgcatatctatggccttgttgatgccctcatcaggatcagccggatcgcactttacgccccagacgttctcagcgtacttggcccagcgctttttgttgtacttcatattgtaacgggcccaggatggccagagagctgcaaggccagcgccatgagtaatgctcggataaacagcgctcataacatgctcgaactggtgcagctgcaggaacttgccacggccaagaccagtcaggtcgttgtgtgcaagtgagcttgcccacatcatagtggcgcgcgcctcgtagttattagggtcatcgcagcagatctttccggctttgttgttctcacggataacagcctctgcaatagcatccggcagatcggtgtgatctccgacattaaagtatctctcgatcgtatgcatcgaaatatctacagcgccgcaggctgtctggtacttcggaacagaaaatgtgaggcacggatcctcgattgcgaagcacatcctgttctgcggacagttgatacccttcttggcatgaacctcatcatttgaaataacgcacgaatcgctcatctccgagcctgctgcagcgagagttaagatgcagcccttcttcagagacttcgtaaacggaaccttcttggtctgaatgtcccactcgtcaactcccggatttgcggcgccgtgagagatggctttcgacgaatccataacagaaccgccgccgacagcgagaacgaaatcgacattctcgtcaatggcaagcttaacgccctttcttaccagctcgatcgacgggttcgcacgaactccaccgagctcaacgaacgggatgttctcatccttcatagccttgcggaccttatccagaagaccgctcttctcagcagagtgaccgccatagtgtaaaagcacctttgtggctccgaactcctttaagtatttccccacattaagctcttcatctttcccgaaatgtaagcgaattatctgatggcgggtataccttccagcaaaaccttctaagatgtgagatgtaagcattttactctattcacatgttaggagccaacaacaatgaattccagagctgagcgcgtccctgaggataagcgcattgagctgatcaatgagtgtcggcgttccggactgacagatgcggaatggtgtcgccgaacggaattagccgggcactttctatatgtgggtcagccgttgcagaaaaaatagtgcagctgaaaaactgatccggccgagatccgaagagatccggccagaacctgtcgtacaggaggttgttcctgtttcgattgttccggatgatccatccgatgaacatacatccctggtttctgtaccaaaggagccggtggaatcgtaccttgacaatccacatgagatcgaagttattgccaaggaataacaatccggatccgaaatgatgcaggttcagcagcgatcagaccgtgttccggtatctgaaggagatcaatgttaggcgatatttccgggtagaccattctatctggtgaccggctacacagacatgaggcgttccatcgatggtctgtcgctatcatcgaagatcagctgcgcatggatccctattcgaattccctttttctattctgtggcaaacgccgtgaccgcatcaaggctatactgcatgagcctgacgggatggtgcttctttacaagcgtcttaccgtttaaaggtcattatgagtggccgagaaacaaaacagaggtcagagacctcacctggcgtcagttcgactggctgatgtcaggtcttaaggtcgatcagccgaaagcacttcagacggatgatcgggcactaagaaataccgaaaaagcttctgagatcattgactaaaaagtgccgaaaaaacagtaaaatcaaggctttcacggttttctttatgccctttttctgatataataaatgtatcaattcgaaaggaggtccaccgtgggagccagcgcagctgaactgaaaaaccgcgaattacgcgacactataaaacagctgaacactaccatcgacacgctgaattctctgatcagtacacttcagaccaccatttccgaacagaacacccgcgagcagaattataaagagcagatcgattatcttacaaagaaactctttgggcgctcaagcgagaagaatgtcggagacatcccaggtcagatgagccttttcaatgaagctgagatgaccgtcgaccacgaggcagatgttgaatctgttccggtcaaagctcataccagaaagaaaagatctgatcatacgaactttaaaggcttcctgtcgaaaaagtcgtcatcctcttccgatgaccagaaggtctcccggaatgcgggacacagatggaaaggtcggtgtggagttccagaggcgggagcttaaatacattcctgcaaaggtaagtgtcatcggtattacagcgagaactatgtgtgcccgaactgcagaaagcgcttggtgtgtgctgataaaccagtctttgtcaaatcaaaggtccctgaggctctgataagaaaagctatgcttcctcatcagcgtcccatggacaatgtaccagaaatacgtcaacagtgtcccgctctaccgtcaggagaaagacgggaagcagtacggagctgcactttcaaggtcaactcttgcaggctggatcatccaatgttcacagacctgttttttttccggtcatagattacatgcaccaaaggctgatcctccgcgattatgccatgggcgatagaccagatgcaggtgctgaaggaagacggccggagggcacagacgcaatcgtttctctggtgttcgtagtggcgatgatggcttcctccatcatcctgttccattattcaccaacaagaagcggcgatttcgccaaagaatttctgaagggattcacggatatctggaaaccgacggctaccagggctataacaaagtgtcggggatcaagcggtttacctgttgggcacacctgcgacgctacttcatagacgccatcccgaaagggaaacagtttgattacagtcagcctgcagtgcagggagttgagtattgtaatcgattattccgcgggaacgtgtgatcaacagcacatgtgccggcgattatgacaaaaggaagaactccggctcgaaaaagagaaacctgttctggatgccttctggtcctggctggatcagcagaaacccgttcatggatcccgattcgaggcggtgaactatgcccagaatcgcagggagacttccctgaccttccttgaggacggccactgcagtctttcgaacacgataccgaaagatcgattcgtccgtgcacagtcggaagaaagaactggctgttctgcgacacagtcgtgggccgaagccagtgctgccgtttattcgattgttgaaacagctcatgccaatgatttaaactttacaaatatcttgttttccttcttgatccccgtcctcatgcagatatggcgactcagaactcgaacagctgatgccatggagcgaagctgccataaaagcctgccagccggattcttctgaaaatcttgtgtgaattataagttttctccatctaggatgcacttcctggacgtggaatttttatgcgggctgacgccccatgataactcgcttacgaaataaactttagtcgggatatcatagataaaattcttcataaaagcaaaaacctcctacccaccattatacttgatgggaggaggtttgttaagcaaaaatctgccaatgtcagcaatccttattttccgttgaaagcttcaaatctgttcttgccatgctccttactgttgtagagagcctggtctgcaagtcttactacttcctccgggtcacttgagtccttcggataagaagcgtagcccacactgatcgatacgacgtcgtaagtcgtgactccggtcttgtatctgatctcggtatccataagcttcttaagcaaatcctgaatctgatctggagtcgtgttcttaagcagtacgaaaaattcgtccccgccgtatctgcctatgatatcatcacctgtgaatgtctgagtcaaagcagcacttaacgatttgagggcattgtcacctgtcccgtgaccatagcagtcgtttattattttaaaattatcgatatcgagcatgatcgctgcgaatggcttgcctggattttttttgaaatactcaacagttttctcgtcaagtccctgacggttcaggatgccggtgagaaagtcaatatctgcagcctcaagaagcgctttctggcgctcgctgtttatcatcagcatatatgaaagccaggtaatgagaatgacgatcgcaaaaccgagcagagcgatgatcaggaaatccttcgaatgaaaccatccgcctttaggctcaattgaaagcttccacttactcgcaccgctgctgaaagtataggtgacaggatcactgagtctgccctgccctgccacagtcagatatttgtttttcttaatcgactctgtcttttcgagaagatagttgtagttgttcgcatctatcgactttgtaacagaagctataagttttgtggcatctactactgtgatcgtaaagccccagaacgaaccgtctgtaagaaagacaggatctcttatcgcaattccctttccgccctgcttcaggtcaaaaggtccctgcgtcgtaatcaccttgtgttctttaccgtaacggactacaggtccgcggtcaggatcgttcatcagatcgatcatgcccttttcgtttccctgtaatggaaaaatacgggtgactacgccgttcggtgcgagctggatactgtttacgaaattaagcttggcaaacagctgcttcgcagtcgtatcgaaaaagtcggtatttcctttcgagcctttaagagagaattccagaaccctggtgacctgttctgcactgtccatggtccttacgacattatcactgtagatttttgtatcgattcccgccatctgcttctgcacagcaatgttctgtctccggtaataaaccagaaacccatttaacagagtaatcccgatcgcgaacaagatacagagcgctatgatgtgtttctttttcgttgacatacttttctccatactgtaaaaaattgttgctgcttttcacaccaaaacgcatctgcaggttgtggaaaagttttcgttttcagatatttaattcatcgtaaaatgatgaaagcagctcagctgacttgtgaagagcctcctcttccttcgggtcgagttttatctctacgatctccttcgaaccagtcttgtcgataatggtcggaaccgaaagccatgcgttctcaatgccgtactccccggaaagtccgacagtaacaggatagatatggttctcgttgaagaggatagatttgcagatagctgcggaagatgctgcaatcccgtagcaggtattgccctttctgttaaaaatatcccaccctgcttttatcgtctgcttctgtaaatcttcaggtgtaacgttctgagttctgtctggattgtccctcatgacgctttctacaggcttaccaccgatgacagctgaatgccaggatacgatctcactgtcgccgtgttcaccgcagacataggccgaaacactctttgaatcgagatcgtacattttcgcaagctcacagcagagacgggctgagtccagattggtacctgaaccgatgacctgattcttcggaaggccggaaagcttatagaccagatatgtcataatatctaccggatttgatacgataagaaaaataccgtcgaatccgctttccataactgatcctacaatgcttttgatgattttgatactcggcgcaagcatatcgagccggcttgacgagttcttaggcatcggcgccgaagccgtgacgattacgatatcggcgtccctgcagtcactgtagtctcccggatgaatattgatatttcgattcatgaaatatatagaatgtgccatgtcgagagcctcggcataggccttgtccttatttacatcgataaggacgacctcctcagcaagttcctggtttactatcgtatatgcagtagtgcttcccacatttccgcatcctacaattacaactttcgaatccttaaatgccattttatcttcctcccaaaactaaaaaatttctctaatattatacaacaagtcaagagatttgtgggagattttagtgcaaaattatgatattcaaatttatgataccatatttttctgacaatttgtattaaatctttgatttttattctgcatttatatataatgattttgtgagtgtttcacactcacaaatcaggaatcttattgcaaatgaggtatgcttatgtttgattactcgaaaaaagtagtggcagttaccggcgcctcatccggacttggaaagcaggtcgcagaaggatatgccaaagccggcgccgatctggtcatcctcgcgagaagaattgagcggcttgatcagagtgcaaagtacatggaagaaaaaatatcttccggaaaacagagctacggacgaatcatcaatatcgcctcgatatacggcattgttggaaacacagctattccaactatcgcataccacgcatcaaaaggtgccgttgtaaactttaccagggccgccgccgaaaaatcatttcactttcttagacgaagttcccgaccattttccatagtacttctttccctttatcgtgatataagggcggacttttacagaatatgtcttcttcttttttagctttgaaatagtcttactagttgcagagacataataatatttccatttcttactgcccttaatcctgatggcaatctgatatttcactgatattccactgatttttatcttttttaattttatcgtcagcttcttcttgccagcagagagcttggagatctttcctttctgcttcttaatcgaattaatctgcttctttgaagaagtcgatttcttctttttagcttttgatgtattggacttcgaagttgtactctttttggtagtgctctttgaagtgattttctttgtggtagtaccctttgaagtgattttctttatggtaacgctcttcgaagtggaagtattcgagttagtgccgctcgatttcgtcgtacttgaggtacttttttttgaagtatttgtactcggagtctttgtacccgatgttgtcgtacttgaagtagttgtacctggagccttggtgctggttgtagctttcttggcaagggcattatattcagattctgccctagtcagcgctgcataatttgtcacaaatttcttctgatcagtcgaaagtttattataggcagatcttgcagcattgatcaaattcttcgatgcatcactatatgagacttttccaatagaatcaatcttactgattactgcatttgcagcatttttatcattttgattcttctgttctcttgcctgctgctcagcgacttgcttgttatgttcgtcttcgagatgttggtactctgtctctgctgaggtcagcgttgaataatttgtcacaaacttcttctgattatctgtaagcttatcataggccgatctagccgcgcttatcagattcttggaactgtcagaaaatgtcactgtgcctatgtctatgattttattcataaccggaacagctgcattataatcatcaacaagactagcatattcatttattgcattgttcaatgtctgaacataactgtctggaacaagtttcttctgatcatctgtaagtgccttatacgcattgtctgcatcatttatcttgtctatactgtttaaatccacagtaccaatggcatcgatcttttcaataactgcatttgcagcattcagattctcctggtaattttcatcagaatagcttctgtacttttcttctgcatcttcaagcttagtaagattattcacaagagccttctgggtatcactgagctcattataagcatatctcgcggaacttatcttatcaccggacgatacggaatttgaaacagtaccgatggcatcgatcaaatccataacatcattcgcagcgctctgatcttcatcatctaatgccgcttcagtagaattatcatatgctgtgtctgaaagagtcagctcgtcagacgtataaaaatcagtcgtgtctgtttcataattgtgattgcctgttgtatcatcatttacagttgtctgtcctccgagcaggtattcagacctgtatggagaatctgctgaatctgtatcataccatgtcacatcgacgatgtagttttttccgtttatatcaacgacgttccacatatggttggaactgctcacaagtttggattctatttttgccttctcgaaacgtgcagtattgtccatcagatactggaaagccttggcatatccttcgcagaccacatttgtattcgaatcattgtcgaaaacagagataaggctccacggcgaactactggtcttaacattctcatttgccgcctcatgattgtaagttacattatctgcaatataatctgcataggcctttatagtgtcatagacaccattcttcgaattttcagaaataactttctttgccactgcctcagctgaatttaatttatccagagttgacgtactcagagtatgtgttgggtcaacgcttgatttatcctgaaagcaatcatctacagaaatgtaagcattcagggaagtcactttataatcacctgtataagaatagctgaacctactccctccatttgcacttacaaggtcctgatagcaaagcagttccggatggttatttgaaacacatgtaataagcctgccccagaggttcttgacgttatctttgtcagaacaatctatctcctccagtttgaagtcaggatcattaaaagaaatttttgtcgatccaccattttttaagattctcttgagttcgcttaccagatggtcatacatcagctgctctgtcgacgagagccgggaaactccccacgacgacatcttcagcgatgcgaacgcactaaccggtgccggagcagcggtaaatattaatgctgccgcaagaaacgtgcacatgagtttttttaaagtcttattcttcaaggcgattcgtcctttctcttaatgttcgtgtaaaacaaaaagcttaagtaaattataccattttcagcggcttattattattaaatttttattttccaactgtctgaaaaaaatcctcaatactgcttctcttttccaaaaatatattgtataatggctttgtgcaatcggttacgcaaaaataagattatctcagtttttttgctgcggactgcgattgtttttttaaaaaacgggctataaaatgaaggagacacaatgacaaaagccaaagctgtgctgctatcagcaattattatgggttcaatgattttaggaacaggctgctcttcaccgcaagccagaaagaacaattcattttcaaatatccggggtatggatatctcttcatacataagcgttcaggacggtttcgacgcattgaataaagaggaaaagactaagaaatacgggtttaaggatttcgaagggaagacgatccgcgatcaggattttttcaattttcttgcgaaacagggaatgaactgggtccgcatcagggtttggaacgactcttatgataaggacggcaacggatacggcggcggaaactgcgatctgaaaaaagctgtaaagatcggcaaatgggccacaaaagccggcatgagagttcttatagacttccactattccgactgctgggctgaccctgcgagacagatcgcgccaaaagcctggaagaaattcaagggcgacccagacaaaactgccgccgcagtaaaaaaatatacgaccgattccgtgaacaaacttctctccgaaggcgtggatgtaggaatggtctctgtcggaaacgagacaaataacgcgattgcgggcgtttcagcttctggcgactggacttcaaatgtttcaaaaatttacgccgccggctgcgatgctgtacatgctgtcgccaaaagtcacaacaggaaaatcctcgcctgcgtccatttcacagatccgcagaagggcggtcatatgacttttgcggacaatctcgctaaagcaaaagtagactacgatgttttttccacatcgtggtatccgtactggcacggaactgcggaaagcatcaccagagaattgacccagattgcgcagaaatacgataaaaaggtcatgatcgcagagacaagctatgcaaatacgctcgaagattacgatggatatggcaacaccgtaagcaaaggaaacaacgattccggcgatggaactgtatatccttacaccctggatggtcaggcgaaatccttccacagcgctgtaaaagccgccactaaagtacatggcagagacggaaaaactgccggactcggcgctttttactgggagggcgcatggaacggactcatggatgtaagatccttgtcagaagctgatcagaccgctgcccttgtaaaagagcggagaatctgggacaaatgcggctgcggctgggcatcatcccactatatcagttacgaccctgcacagtcgaacggaactgccggcggctgcgtcatcgagaaccagtctttcttcggaccggatggcagggctctcgcatcgatcagggcattttcgaaggattacgacggttccaaaaccattaaataaaaattgcagatcaggtaaactaaaaaggccggcgttctggaaggtcaaagagcgccggtcttttttacaatgttatttcgccataacaggcactatttgtcttgtaaatcagacagattttatcataatcgtcttgtaaattagacaaaatcacattataattgtcttatgaacatcacaggaggcagttatgaatagagatattttgaagcaggttattatagaccagcgtgagatgtatcaggacatccctgtcgttcatcgacagtttgaatttgaagataaagtgaattactgctttgtcggaatcagaagagccggtaaatcctattatatgtatcagcggattcaggagcttttaagtcagggagtaaagctgtctgaaattatatacataaattttgaagatgagcgtcttctggaaatgacagtaaacgatttgaatcttattcttgaaattggatacgaattatcagggggaacaaagccatatgtatttcttgatgagattcaaaatgtggatggatggtcaaagtttgccaggagaatcgcagaccagaaatattccgtctgtataacaggaagtaattcaaaaatgcttagcagtgagatcgcttcaactcttggcggccgatacatgattgttccggtgtatccatattcatttactgagtatctggaagccagcgggatcaaggcagacgatgctttgcttaccggcacaaagggaagagctgagatttcaggacttttcgataaatacctgcgctatggcgcatttccggaacttgtaaatatcagaaacagcagggaatatttgaacagcatttaccagacgatatatctcggagatattatcacaaggaacaggataagcaacgcatttgctgtaagacttatcctgaaaaaagtagctgaatcagtcatgcaccctgtctcattcaccaggctatctaatattttatcaggaacaggtgcaaagatatcaaaacagaccataataaattacatgggttatatctgtgattcgtatctgctttttccaattaaaaattattcctcaaaacttgtagagaaagaatccatcccaaaatactattttcaggacaccgggcttctcggacttctgctcctgaattctgaatcggcacagcttgaaaacctcgttgcaatcgaactgatccgcaggtatggtttggagaacgtatactactttgagaaaaatgtcgagatcgatttttatgttcctgacttaagccttgcgattcaggtgtgctggaacatgctggatgtccctgagacaaaagaacgggaaatcaaagcctttgagaagcttcatcacttcatcccggatgcaaaatgtatcgtgatcacgaatagtgagaaagcatctcttgagactgatggaattcaaatagatgtcattccggcatgggagtggctgctgcagagcaagccacagcagtaaatcaggccctacagttatactccatttcccgtttccaatcgagtgtgcatctgtgacgggacgttttagcatttcctgattttctaaaaaatcttcgcagtattcatcgcgaatcagtgcatacgaaatcaaattgtccatgaaggaaatcacctcctcttatatcatccatctctttccacggatgatttggattcctgttgattgccatttgcctcactctggtaagcaattccatgtgcagatgatctttggttacatatggaaaaattttacgctcatgatatgtcgaagacttcatgttataaagattcgcaacaaggtccgatgattttgtaatatcctgatcagcatctccatttctgtcataaattgtttgcctctagctttaattttatcacaaaatctgaacaatcataaatttgctgccctactattctctttttggattaacatccatgcctgtacctcccgtgaaaatctttgatgacttgaaaaactaagaaaaagttttctgagttttacagttattctaacaaagaaatccggaacaaggaaggtgacgggttatctaccatttacgacttaacgcaaactaatcatcatacaactgttttataaaaaagatttcgtggctcataaccacgaaatccttgtcgttttaatccgtcaccaatattatttcttcttagactttctgcccttcttcgacttcctggctgctttaaccttaatagtcttcgttaccctgccgttcctggctgtcttgtatttcttattacctaccttaacagtcttgttggtataaatatatccattcttggtagtaacgtatgtggccttgcctaccttaactacctttaccttaattggaatgtggcatataactgtacaacgtcattgcagtcgatgcgataggcatactctgcaggataatatgccccgggccgtacacgacagtgttgaacaatccttcaccaccaaacagcacattcttgacaccgcttatcgtcttaatctccatcctgcaagagtctgacatagcagcgacgtagccggtatcaacaatcttacagtcgtttgacgggatatcatactcatgagcagaaccgtctatctcgagaaagactaagccctggcctgtgtagtgtctcataagaaaaccttcaccaccaaataacccactgccaaaacgcttctgaagatagacttcgctctgaatatttccaaaagaagcgaggaatgagcccttctgtacgatcaggccatttcccggtgtaacttctactgcccggatagaacccgggaatttagatgcaaatgcaatctctcccggacggtttgcaatataagtgttcaaaaacgcattctccttcgtaagcatacgtccgaacatcctgccaagaccgcctgcacttgtctgcatttcgatctcattatccatccacgacatcgcaccagcttcacactgaatgccttctcctgcatcaagcagtaccttaagtaccggaagattgtctccatcgatcttatacttcatttttctgtcctccttccaggtaatctgttgattctggtcgattaacattatatcaaaaggttgagccgatgtctctacctgatttttgaatttacaccattataaggccgtgatctgactcggtcacggccttataatggtgtaaattcaaaaattaagtagaaccactggctcaaccttttggtaccatgtaaattgacgaaaataaacaatgtacctaaaaggagaatccaatgtaataggagtatttcctaagtaaaagacacgattcggtttgctctcaggagcttatcggattgggtcctgttttgcataaagctttttatcaaatgtaatcagaggttattgacacatttttctaattattcgttaaaacaattttttccgcaacatcatccgacttcgtcgtaaatatctcgaatgtgatattttttacgtctgaacctgttgctgacttataggtgactgtggctctctctgcgatcggctggctgctctcgcctgcagtcttgtgcacggcagaaacgaccggttcaaggcccttcttccacagatcctgagttattttaaaaggatcttccctttcatcgtagcttaaagcgatgacatacttgccctgaactttttcggcatcgactatttttttgttgtgatacttatcgagcagtacagaaaatgaagtcacacgcccctggtcatcgtatttgatgttggacttatactgaggttcatttttattttcaggcgtgtagctgctttcgacactcgcaagactcttgtcgaggtctggaagtgtgaacgagacttttttatcattgtcagacttcgctgtaactgccgcactgcccgatgctgcctgctgggtgttacttgattttgcatttccgcatgaacaaaatccgagcgtagctgaaatggttgcaataaacagaagatatttcatttttctcatatgatgatactcctttaaaaaaaaacggccttcgattacaattccattatacttattatctaaaacttcccacacctaaatggtgtgctgtaccttgaaaattcaataattcgggcaaaaaataaggcatagatcgcatgcctctggtataattgagttgtcgaaaaacaataaacacaaaggagttttctatgccaacttcaattttaccacaaaatcaggacgaacaggaactttataatgcgatttcttcatttttccgcagatttaaaatcggagatcttctgcgtaaatgtaatgcgcagaaagagaaaggcattcctgtcattcagattttcaaatacaaactctgcattgtcttcgccggacgaagcatgtacatgcagcagaagaccgggcatttccatgaagcattcagcaagaacactttctatcgcttcctgaacagcacaaggacgaactggctccgctttacaacactgctttccaaggctgctgcttcaacctcttttttgcatcatttcatggattatctttaaaaaaaacggccttcaattacagttacattatacttcttatttttaatgtttaaagtcctatattaaaaaaagagcccgatcttttgatcaagccctattcttatcaaagagaattgtccccacttctgtctttgataaattcagcgcagacgtctagtatgctcttcagattcccgatatctgtcatcacgttctgtgtctcgagggagtggtttgcctcggtgacttcgtagtaggccacgccgcactcacaagcttcgcttgagataagttcgttgtccggtgcccactggtcggcgagcccgtgaaaaacgattatatctttgcttcgctcagatccctgctgttcgagcaggagttttaaaatatgcatcgtctcgttgagtggtgtgaaaagtatgtgctttgctccgatatttctcttcaaatccgcctggagtgagactgccgtcccgatgctttttgaaataaaaatatcgcctgaagatgcatcctctggcagctgctcgttcagcttgttgtacgcctgaatgaaagcccttttcattttttcagggtcgcccttgacgcccttttcaaaacgaccaaaagtgatcggtcttctgtggtaaccggcgttgtaggcgatccgaccggtaaaatagagaagcgaacgatcgactgtgtagccgatgccaggtactatatatgcgttattttctgccatttttacaccagtcctgtcgtctcatcgagccctaaggcaatgttcatgttctgcacagcggcgcctgaagcccccttaccgaggttatcgaaaaccgcggtaatcgctgtgttctcgtcactgccgcatacatagattttcaatctgttcgagcctgagagctcgttggcatagagcgttcccggcttttcgtccatgtcagcaactgaaacaaaagtctcgccgtcgtagtgctttttatatgcctgccagatatcctctgcagtggctccatgatttaacattctgttctgaagcataagcgttccggccattcccttgtaatagtcatctactactggtaaaaataccggtgtatgagaaagtccggtgtattttaccatctccggaatgtgcttgtgctttaaatttctcccgtagatgccaggcgctgaaagtgactccggtctgccatcggcctcatagctggcgatcatctttttgccgccgcccgaatagcctgtcagggagaaaaagctgaccggatagtccttgggaagaattccggcctgaaccagcggagctacagtgctgataaatcctgtcgcatggcagcctggatttgcaattctgtgagaagatgcgatttcttccctctgaccttttttaagctccgggaagccatatgcccatccatcggcagtcctgtgtgcagtcgaagcgtcgatgatttttacatggtcgttcccgacaagtgaaactgcgtgaacagcctcagcatcaggcaggcagagaaacacgatgtcggctgcatttataaatttctttctctcttcgacgtcgtgtctcttatcttcatcaattctaagaagctcgaggtcgtctctcttcccgatcctgtcgtagatctgaagtcctgtcgtaccactctgtccatctatgtaaatctttggtttcatcttttttcctttccaaaaagccacactgtcacgggttttacaaaaagcaataatcacctgtctttgccatctgcagagttcgaagtcccgtcttttacatcgtctccagacccggagctggaagatacttcaggctcagatctggaatcgtcatgagactctgatttgggagccacttcgatctcttcctcttcctcaatcggctcattccaaagcctgccgggatttggctccggcgggaggtcttttacggtaaacggctggtcttcgagatttcgctcacgtgaacgcttgacatcgaaataggtctcggtgaaaggctcatcctctttgttgcgttttgctgaaagattgagccagcgctcgtattttacgctgcggatgaaagtgatcataagagccaggattccgagaattcccgcgaacatcactccgaggtaaaaatatgtgaggttcgcaaatatagtcggagtgtctacaaggaaaaatgccgctccgaggcagataacagccgccgcaaagacgaaattcagaaaggctgaaaatggcccgcgcatgaatgcgcactggaggaaaaactgcaggatacagacgcctaagactatcaggatagcaccgagcacatagatcaggtgcccggcaacggccctggcctgaaggataagcagcaccccggctaagatcaaaagaattcctgtcgagaaatcgtaatttgaaaccgacatgtactcctctttcataaaaaaccggagcacgagccagcagccgccgattatcgcaaaaccgctcatcacatatatgaaacctacggccggaaatgcatgatctatggcaagtatggctccaactatgataaggagcaccgaaatgatcacgacagccatcattgcggcataatttctgtttacgcgtttttcctccatatttactccttttcatacagactcacaatttgacaaatcccgcctctttgacaaaatcaccctttttcaaactgattccgatatttccgatcgcggtcttgtgtttcagagggaaatcggcggcagagagttttttcttgtggcgcttctcggtctttatctcaatagtcgagtcgggatctaagatgccgactgcgacgagctcatcgtcgtctttgaatttggtcgccgctatcgtctttcgggacgataaaaattcgtcaccggctaccttctttatcatacccctttttgtgataaaatacatctctttcccgacaatttcagaaattgaacctaagaaaagtgctctctccttcgagccatcgaaattgctgacattgtcgaccggttcgcccttgtcacggaacttaccgagcggcagatcgagcacctttaaagtgtcagcgtttccagtatctgtgaaaataataagcttgtctgtatttttgcagaagattactctcctgctctcagaatcggcggcctctttatttctctcgtaagtggccgtgtcgacgcctctggcgtagccaaatctgtcgataaggactacctgatcagtctcctcgacaggcttctctacgatcacggcctcggcaacgttgtcgatcgtagtcttccttggagcggcgaattctttctttagttttctcaaatcagctatgatcgtcttcttcatcgactccctgttttcgaggatgtcggtgtagttggcgatgtttttcatggtctcgtcgtagtcggcgcgcagtgcgtcgatctcgaggccgatgaggcgatacagcctcatgtcgaggatcgcatccgcctgtttctgtgtgaagagaagagtctttgcagctttctctgaggtcttctttctgaatttgatgccctctgtatttccatttacaaggcagtcacaggccatttttctgtctttactgccgcggaggatctcgataataaggtcgatgcagtcgcaggctttgataaggccttcctggatctccttcttctcgcgctctttgttaaggagtgtcgtgtattttcttctgttgatctcgtactggaattcgacgttgtgcctgatgatcgggacaagtccgagagtctcaggacggccgtcgcagacgcagagcatatttactccgaaagtgtcctcgagctttgtcttcttgtagagaaggtttatgaagttgtcaacgtcggcaccttttttcagatctatgactatccttatgccctcctttgaggactggtttgaaatatcagagatgtcgttagtcaggtggttctcctgaagagccgccgtatcggatagaaactttccgatgccggacccgatcatagtgtaagggatttcagttacgactaccttcgtgtggcctgctcttcccggctctgtgataacccttccgcgaagctttatcttgccctgtccggtcgagtaaatttcctcgagctcgtctttattcgtgacgatgccgcccgtcggaaaatccggacccttgacatactgcatggcctgcttcgtcgacatgtcgggatttttcatataggcgatcatcaggtcgatgacctcgcccgggttatgagtcggaatcgaggttgccataccaacggcgattccctctgctccgtttatcagaatatttggaatgcggacaggcaggatcgacggctccttttcagtctcgtcaaagttcggtacgaaatcgaccacatccttatcaagatctgctaaaaatgcctcctgtgtgatcttcgcaagacgagcttctgtataacgcatggctgcggcaccatcgccttcgatcgagccaaagttgccgtgtccgtctactaaaggaagctcctttttgaaatcctgcgccattacgactaaagcatcataaatagacgagtcgccgtgcggatggtatttacccattgtatcgccgacgattctcgcactctttctgtaagggccattccagcggatgccgagctcgtacatatcgtagagcgtgcgtctctgcaccggcttaagtccgtcgcgcacgtccggtaatgctctctgcacgatgacgctcattgcatagtctatatatgatttctgcatgatctcggagtattccgagtgaatcaattcctgtggcattttttacctctcaaaaaaataatcggagatttttaaaaaaggatcaaagatcgagctctgcttcctttgcatggctgtggataaaattccttcgtggcgagacgtcgcttcccatcagcatctccgtgacgtcgcttgccattcttccgtcttcgatctcgacctggcggagctttctcctgtcagggtcaagtgtcgtctcccaaagctgctccgggtccatctcaccgagtcctttgtaacgctgcagtgtgaacggccccttgtgcctcttcctgtactgggctagggcttcgtcgtcgtataagtactcttctctgcccttctttggcatggccttgtagagcggaggcatggcaatgtagacatgtccctcgtagataagctccggcatgaaccgatagaaaagtgtcagaaggagcgtcgcaatatgggctccgtcgacatcggcatcggccatgattatgatcttattgtatctgagtttggtgatatcaaagtcgtttccgtagccctctgaaaaaccgcagccgaatgcgtttatcatggtctttatctcggcattcgcgaggactttgtcaatagaagccttctcgacatttaaaatcttaccgcggatcgggaggatggcctgatacattctgtttctggctgtctttgccgagccgccggctgaatctccctcgactataaatatctcgcacttcgaagcatctctgctctcacagtttgcgagcttgccgttcgaatcgaaagagtacttctgctttgtcaggaggtttgtcttcgctttctcctcggtctttctgatctttgcagccttctgcgcgcagtctatgatggcctttaaggtatcgacatttctatcgaaatagaggaccacctgctcgtttaccaccgtagaaactgccttcgcggcgtcctgattgtcgagcttcgtctttgtctgtccttcaaaacgagggtctggatgctttatcgaaatgacggcagtcattccgtttctgacgtcggctcccgtgaaattcgggtccttatctttgaggattcccaaagttctcgcatatgaattgatgactgtagtaaaaatagtcttgaatcctgtgatatgtgtaccgccctcggcattgtagatgttgttgcagaaacccatgatgttctcatggaactcgtttacgaactggaaggccacgtcgacctggattccgtcgctctcaccgctcaatgtcacgatgtcagtgacaggttcgttgttcgcgttcaggtccctgataaatccggacagaccatcttcctcgtggaaagtaaggtgctcgtccatcccctcacggttgtcatcgaaaatgatcgtaagctttggatttaagtatgcggtctcatggagacggctcttgatctcgtcctctttgaatctggttttttcaaagatagaaggatccgggagaaatgtgatcgtggttcctgtctccttcgtatctccgatgaccggtagcaggccattctcaagctttaagaccggcttgcccttcttgtatctgtcgtggtagatgtgtccgtcacgctttactttgacgtccataaaagcggacaatgcatttactaccgacgaacctactccgtgcagtcctcctgaggtcttgtagacagagtggtcgaatttgcctccggcatgaagtgtcgtaaataccactctctctgcagaaactcccttggcatgcattccgacaggtatacctctgccgttgtccgcaaccgtgcaggacccgtcatcatttaaagtgacgtgaactgtatcacagtatcctgcgagatgctcgtcgactgagttgtcgacgatctcgtagatcatgtggtttaaacccttcctcgaagtggaacctatatacatgccggggcggaccctgacagcctcgagaccttcgaggactgtgatcgagtccgcaccgtaatcttcttctgacgatttctttgacgaattctttgccatcaaaaactcctgtgtaaatttatcgtgttttttacagaacagtccgaacgatccttggctggtaaccgcccttcttcagagcgtccatgatctggttcttgtgatctgtaccgaaagcctcgagcgtgatgcgcagctctacctgagcgctgcggtttacagcgacgaactggttgtgctcgagtttgataacgttgccctgctcattagcgatcgtctcagcaactgaagcgagctcacccggcttgtcaggaagcaggactgaaactgtaaagatcctgtttctcatgataaggccgttctggacgatggacgacatcgtgataaggtccatgttgccaccggagaggatgcaggcgacattcttgttcttacatttcagcttccctgcagctgccaccgacaacagtccggaattctccacgatcatcttgtgattctcgaccatgtcgagaaaagctacaacgagctcgtcgtccttgactgtgatgatatcatcgatattcttctggatgtaagggaagatatgtgacccgggtgtctttactgcggtgccgtctgctatggtgtcaacatgctctaatgtcgtgaccctgccgttctttaaggactccttcatgcaggcagcgccctcaggctctacacctatgaccttgatcttagggtttatcagtttggcgagagtggaaactcctgtggcgagtccgccgcctccgatcgggactaggatgtagtctacaagaggaagctcctgaatgatctccatcgcgatcgtgccctgtcctgtagctactaccggatcgtcaaacgggtggataaaagtatagccgttctccttcgcgagctgcatcgcatagtcggcagcatcgtcaaatacgtctccgtgaaggacgacctcagcaccgtatcccttggtgcggttcaccttgataagaggtgtcgtggtcggcatcacgatgacggccttgcagccatacttctgcgcagcaaaagcaacgccctgtgcgtggtttccggcggaagctgtgataagtcctttcttcctctcctcctctgaaagagtggaaatcttgtaataagcgcccctgactttgtaagcgccggtgcgctgaaggttctcaggcttcagataaatcctgttcccggtctgagcactgaaatagtcactgtagatgagcttggtctccagcgtgacttcgtggactttcttacacgcttcatcaaaatcttctcttgtcagcataatctttttccctttcgtcttttcttttttcgtatgtgtgttctatattttaatacatgtcaatgttttttgtcaaatcagccgttttcctctgagtcatcctgcgacgagtcatcctggttgtcgagttcgaaaagtgcctttgcaaactgttctggatcgaacctctcgaggtcatctacctgctctcctactccgatgtacttgactggaattccaagctcagttgcgatagcgatcgcaatgccgcccttcgctgtcccgtccatttttgtaaggacgacacctgtggcatgagctacctcagaaaagtcctctgcctggtgcagcgcattctgcccggtcgtcgcatccactacaacgagagtctcctttaatgcctccgggaaatgggaatcgatgatcttattcatcttcgcaagctcgtccattaagtttttcttgttgttaagtcgaccggcggtatctatcagaaggcagtcggcatgtctcgccttcgctgcggcgatcgcatcgaaaactaccgacgaagggtctgctccctcacctgctccgatgatctctgctccggcacgctctgaccagatttcgagctgctcctttgcggcggcgcgaaatgtatctgctgcggcaataacgacttttttgccattatcgtgcagctttgctgcaagctttccgatagtcgtggtctttccgactccgtttactccgataacaaatacgaccgatgtagtctcggcaaatttgtacgcatcctccggaactgccattttttcagtgatgtagtgtacgaaatattcacggagcggtcccggatttttgatgtgctcttttttggaagcgcttttaagctcctctatgatgtcctctgtcgtctttactccgatatcgccgaggataagcgtctcctcaagatcgtcgtaaaaatcgtcgtcgagcttttcgtgccccatgaaaacagcatccatatcagctacgaagctgcttctcgttttaaaaagtccctgttttaacctctgaaaaaatcccattcaaatctcctggtaaaataatgtttagagttacttcagctgatcctctatcaggtttacggatacgagcgtcgatactcccttctcctgcatcgtgattccatagagcctgtcggccgcgttcattgtacctcgtctgtgcgttatcacaataaactgcgtgtgatccgtaagcttgccgagataatttgcaaaccggtcaacgttcgaatcgtcaagcgctgcctcgatctcatcgagcaggcagaacggcgacgggtgcaggttctgtatcgcaaaaagaagtgcgatagctgtaagcgatttctcgcctccggacatctgcatcatattcgtaagttttttgcccggaggggaggcgatgatattaatatccgattcaaggatatcctcgtcgtcattcagcgtgatctttccgtggccgcctccgaagagctccttgaatgccctgtcgaactcgcgctggatatcggcgaagccattcataaactgctttcgcattccagtatcgaggtcgtttattatcgtaaggagcttctccttcgcattcagaaggtcctcgtgctgcgagctcataaacgtgtatcgcttcgagagttcctcgtactcctcgactgcgttcacattgactgagcccatctgccttatatccgactggattgacttcgactccttctttattgcagaaaggtcagtaagcgactcgtccttcatcgtgatggcctcgtgctttgtgatctcgtactgatcccacatataattcgagagctcgtcaaaacgctctttgtttttctctgctctctgctcgagccttaggctctccttttcaagaacagagatatctcctgccacgctttcgctctgatcaaaaatactctggctctttttatcgagctcgtccttagatctgccaagctccgctatctgctgggcaagggttttgttttcttccctgccctgctctatctgcctcttcagctcttcgatctcctgcttctttacttcagtttctttcgagcctgattcctttttatttttaagctcttcaatgagcttcgcggcattttgctcactctctttaaagcggtcaaagcgctcctgggcagcatttaatttttcagaaagcgaagcctttttgaccctgatatccgagagcttgtcggtaagccttctgatgcttccgtcgatcctctccttctccttttcgagctgttgagatttctccgcaatatcattttccttcagatggacttcagagagcttctcgtcaaatgagctctgctccttttccatatcctcgaggctctgcctgatatcattctcctcttttacgatatcgtcgtaggcttttttctggtcagccttctgctgatttaagagtgaaaggtcgtgttccttcgtctttttctcgacaagaagcgtattgtactggtctctcttttccttttcagtgacctgcgcctcttctctctgcctcgtggactcgtccatctggacgttgatttctgcgagtctgttcttaatgctctcgcactcgcttccgagctcgtcgagctggcgctttcttccgagaaggttctccgaccttttgaacgcaccgccagtcatggcgccgcccggcctcatcgtatctccttcgagagtcacgagatttaagctctggtggtatttccgctcgagcgcgatcgcgttgtctatagtatctacgactatcgttctgccaagcagatatgaaaaaatgccgtcgtatttattatcgtgctttactaatttatcagctgtatcgatgactcccttttcagagaatacgctctcaggcgttctcgaaggaaatccttttacagagcttaccggaagaaaagtggcacgtccgagtttttctctcttcaggtagtagataagctgctttgctgtctgttctgtatctaccacgacattttttacgcttccgccgagagcaatctcaatggcgacttcgtatctcttctcagtgcttactaaatctgcgactactccgtagattccggggtagagctttttctggtccatgacgcgctttacggcaccgccaaaaccctcgtagcgctcggcgatattttttatcgcatcgagcctcgtatgatagacagagtacttctgattcttttccttcagctcatttttaagtgagtcccttatcgcctcgatctgctgcctcttttttgaaatttcatcgagttcggctttaacagatgagagctgtttctcgagggattcgtcctctcttctggcctctgctatctgctcatcgagatctgaatttttctcttttctcgagagaaggcgggctgctgtctggctctttcttaaagtaagctgctcctttaaggccttgttctttgcgactaaggcctgatgcttcgctttaaagctgtttatttcatctgaagcagtgtttatcttcgatacatcctctgcgagctgttcagcggattttctcgcgttgtttaaaagatggttggtgtcctgctcctcggtctcaacagacatctgagaatcttttaattcctcgagctctttttccgcttttctcttgtcagacttgtgggactcgagcatctcagcggtctcagtgcggcggctttcgagatctaaggcagactgctttgcatattttaactgctcatttaagagattgatctgtccttcgcgcttctcgtttgcaacatccgcctgctgctttttgtcgcggagagaatcaagctctgcctcctttgcggcagcatcctcttttatcttgtgaaactgcgctttaatgtcgtcactttttttataaagatcgttcagctgagcctttgtaagttcctggtctgtacttattttcttatcatcggtggcgatctgagaagtctcgataaggaaagcattgatgtcaagagtctttaatctgtcgcgcttctttaagtactctttcgcggtctcggcctgctcttttaaaggctcctgctgcttttcgagttctcctaagatgtcctctaatctgacaaggctctcctcttcgtcgtcgagtttttttatggattctgcttttctctttttgtactttacgatgcctacagcctcgtcaaagagttcgcggcgctcgtctgattttccggagaggatcttgtcgatctgaccctgtccaatgatagagtaaccctcttttcctatacctgtatcgaggaaaagctcagtcacatctttaagcctcacctgtgaaccgtttataagatactcgctctcgcccgagcggtagactctcctcgcgaccgtaacttcctcgtaatcagtcgggagtacgtggtcagagttgtcaaaagtgatcgcaacgtatgcgtagcttaatggttttcttgtctctgttcctgaaaaaatgacgtctgtcatcgaagaagatcttagggtctttgcggactgctcgcccaaaacccacctgacagcgtctgcgatatttgatttacctgagccgtttgggccgactatgcccgttataccattgtggaatttaagtacgatcttgttcgcgaacgacttgaatcccatcagctccatctgttttaaatacatgaatcagtcctttaatacatcggccttgtcctcttcgtgaagtgatacaagggcattgaatgctgcttcctgctcggcatgtttcttggaacttccctcacctttgccaagtatagtgtctccgacctttgcaacagccgtaaaaacctttgcatggtccggacctgattcatttatgacttcgtaaacgagcggatccttgtgctttgcctgaacgatctcctgcagagcagtcttgcagtcgtgatagagcttcttgtgctcaatatctgtaagcacaaaagtcctgataaacttagatgcaggctcaatccctccgtcaaggtacatagctccaatgacagcttcgaacgcgtctgatgtgacagactttctctttctgccgcctgtcgcgtcctcgccgcgccctaaccttataaaatcacccagattgatcgccgtagcacagtatgcgagtgtaggctcgcacactaaagaagcacgaagcttcgacaaatctccttcgtgcatctgcggataatttttatataaaaaatcactggataccacttcaagtacagcgtctcccaaaaactccagacgctcgttatcagaaaaaggcttgagatttttctcattcgcgtatgaactgtgcgtcagcgcatgcctgagaagttctctgtccttaaactgatatccaatgtttgtcatcagttcgtctaaactagtattcaattcattcctccattaaaaaacaatgtctgcaggcagtataaataccacctgcagctttatgattataccgcctgatttatcagatcaagtgcttcctggacggtctcgatcttctcgagatcctcgtccttgacctcgatgtcgagctcttcctcgactgccataattatctgatatacatcgagtgaatctgctccgagatcgtctataaatttagaatccggtttaacctcatcggggttaactgaaaggacgtcgacgataatgtctcttaatttttcaaattccatatcactgttcctccttgttcatctctgctgcgatttttcctatgatatcttcttttgaaaatgccatgcactggaaaatagtatttttgatctctactgccttgctgctgccgtgcgccttgacgacgagccctttaagtccgagaagcggtgccccgccgtagcgtgaaacatcgaacgccttcatatgccgcttcagtgaaggtaaggccatcgctgccccgatcttagagcggaaattcgctgtaaggctctcctttaagacagacatcagcatcttcgcggtgccctcgtacatcttaagggcaatatttcccgcaaatgcctcggtgacaactacatctgcgacgccaaacggcaggtctctggcttcgaccggtccaatgaaattgataccgctgcactcttttaaaagaggaagtgtctgctttactaaggcgttgcccttctcttcctctgttccgatgcttaagagcccgactgtcgggttctttttcttaaggacgttctccatgtaaatggatcccatctttgcaaatgataccagatgctcaggtctcgcatcgacattcgctccgcagtcgataaggagcgatgcgccgttcatcgtaggaatgacaggtgccaaaggtgcgcgctttacgcccttcgcctttccgatgataagctgtccgcccacaagaactgctcctgtagaacctgcagaaataaagccatctgcttcgccatttttcacaaggttcatccccttgactatggatgagtccttcttgtgcattatggccttgaccggcggctccgccatctcgataacctcagtcgcgttgcagtagctgacgcggtctgtcggcatgtcaggataggcttctgccttctgccttatctcttcctctggtcctgcgaaaataatatgaagattgtccttcttcttcagagcctcatatgctccctttatgatctcgtccggtgcgttgtccccaccacaggcgtccaagactatttttatctctgaatccatgtttcgcctccataagcatgaatatactacaaggattattctcttgcaagtctataaaacacgcatccgtacaacttcgcgacaaaaatcgtaatttgtctttgtgtgtgaaataagatttaagaactgttccgttgcttcttcgcccttgacgccacttaaagcccttctgactatgttcatggcgaccatctcttcccttgtaaaaagcatgtcgtccctcctggtcgatgactttgcgagatcgatagccgggaaaattcttcgctctgataagcttctgtctaggacgagctccatatttcctgtgcccttgaattcctcgtagactacgtcgtccatcctggaacctgtatcgacaagcgcggtcgcaagtattgtaagtgatccgccctcgcgcatatttctggcagctccgaaaaatctcttcggcatgtagagagccgtcggatcgagtccgcctgagagtgtctttcctgatggcggtacggtcaggttgtaggctctcgcaagtctcgtgatagagtcgagaaggatcataacatcctgtttgctctcgaccatccttctcgcatggtcgatgacaatctctgaaatccgcttgtgattttccggtgtctcatcgaaagtcgatgccacgacctcgacatccaccttattgtccgcattggccttcgctatggtctctttcatatccgtgacttcctccggtctctcatcgatcagaagaattataaggtgtatctcggggttgttctgcataacagagatcgcaacctcttttaaaagagtggtctttccggctttaggctgtgagacgatcattcctctctggccttttccgatcggggacaccaggtctacgatccttgccgcggctgaaccaccctctctctcgagcctgatcctttcatttggaaagacaggtgtcagtttttcaaacggcgtccttctcgcattctcatccggagagatgccgttgaccgaatccatgaaaagaagtgcgccaaatttgtctgtcggattattttttctggtctcaccagtgatcacatctccggtgcgaagcctgaacctcctgatctgcgacggcgaaacgtaaacgtcgttctcgtctgtagtgtatccgttcccacgcaaaaatccgaaaccgtccggcagtacttcgagcattcctctgcatgggcgcgcatccttgtaccttggaatctcagcctgctccctggccgcttcaacaggtgattcatcaggagctttctgggctttctcagcattctctgcgccagcctgagagttctcagaatttctgcctctcctattctgatgcatcctgccgttattcttcttttgcttgtactcatcggaagacttcttttcctgattattcttttcaatcttcttctctgaagtcttcctgtcttttttcttgtcgttctttacttcgacctttttatcgttcttttctgcggtctgtttttcgtttctagtcccggtatgattttcgttctttgtctcagcctgtttttcgttattcgacccggactgtttttcgttattcgacccggactgtttttcgttattcgttccagcctgtttttcgttattcgacccggactgtttttcgttattcgacccggccttcctgccagaagttctccttacgttcttagtcgcatgtttctcttctgtcttttcctgtgccagctcctccgccgtctccgtcttctcaactgtgttttctgttttccggtccccgtccgtcggcagaagaatctcaatcaattgagcctttctcatcgaagatgcgcctttaattcccctctcctttgccatcgctctcagcgcggcaacctgcatcttttttaatgtatcttctgttgccatgaatgtcctttcatcgatttgattatatttgtgaatttgaataattggatttgtttttgaaaatgaaaactgaacggtattattataatcaaatgaaattttgttttcaagtgaaaaaacagggctgctgcaaaaatatgcagcagtcccgatcttcaggccttataaaatttacttcttcttagacttccctgtggttttctttgactttttgacatttttctttttcgttgtcttcttctttttggatgaagtcttctttttcgttgtcttcttctttttggatgaagccttctttttcgttgtctttttctttttggatgaagccttctttttcgttgtcttcttctttttggatgaagtcttctttttcgttgtctttttctttttggatgaagtcttctttttcgttgtctttttctttttcgaagttgtcttcttttttgttggtaaatggtaaataacccgtcaccttccttgttccggatctctttgttagaataactttaaaaactcagaaaaccttttctcagtttttcaagttatcaaacattttcacgggaggtacaggcatgtggattttatcaacgaagttgtaaaacaggttcgcctcaagattggtcaaacataattcaggagcgaaatcaaagtggtttgacgattgatagttctgcaaaaagaatggctacactagaaatcagtactactattatctgcgcaaactcaggaggaaagtcatcgaagactcaggctttgttgagctgcctcagttcaatcacaggccactgccgtctctgaaccggatatcataaaaaagtctgatcatttaagcggcaagttcaatactcagatgatcatcagaacaggaaactctgagatctgcataaacagtctactcctaagtctctgatagctgaagtccttgaggtattgaaagatgctgagtgacgctaaaggttttacgcacatctatctctgctgcaactatactgacatgagaaagggcattgatggcctcataaaaactgtcaccaatactttcggacttgatccggctgagcctggttccacttcctgttctgtggtcgccgttcagaccgaatgaaagctcttctttatgaaggcaacggctggctcatgtgttataagcgttttactaatggaaagctgcaatggccccgtactccagccgaagcaaaagtgatctcgcagcgacagtacgagtggcttatggagggactgatatcgatcagaaaaaagttatttcagatgctcctccagggatttactgaacaggatcttactatatttatgcacctgaaaacatacatatcaaggtgcctgaagcgctgtatttatgcggacttcaggctctttttgtgataaatatatagtatgaacggaccagagatcacagactcagaactgaataatctcccaaaggaaacgatcatttttctgttccttcagctgcgtgaagcgtatcgccagctgagcgcaaatgacactaattctggcacaaatgaaaagcttgttaagcagatcgaagatcttaccgagcagatcgatatccttacccagaaccgttttggcagaaagtctgaaacagagaatcagattgaaggacagatgtctatgtccgatctctttaataacattttaaacgagcctgaatctctcactgaaaacggtgttcctcctgaaaaagacatagatgaagttgtcaaagtcaaagagcatacccgtaagaagggaaagagaaaggaaaatctaagtgtgtgtcgagcggagatagtcatacacgaatgctcaaaagaagagcttgatgctgcatttccgcacggatggcatgagctcaccgaagacgtatacagtgagctgcaatgcataccagcaaagtttaagatccttgagcatcatgtaaaggtatacggtgggaaccatgatggagacagtgtgataagggcagatcatcctgcaagaattctgtctcacagcatactcactccagggctttttgccatgatcttcaacatgaagtatgtgaatgccatcccactgaaccgcctctgaggagatatggaaggtatatgtgggtgggtggagtggaaaaggagaaaagagtaaagctagtgtaggtggtatgtggtgtgtagggagaaggagtaggggtcggagtctggtgtggaggtggtgtgatgcatttagggggtgtggagaatggaagatagaggtttgtaatatactgcctgtgagtggggggaaatggtgctggtaagtggggggggggcgagcggtgatgtggatggagaagtgtagatggtggaaattgggagatctgtaggagatggggaggggtcggggtgttaggttaagtgggatttttcgttggaggttctaggagtgggtcgcggggggggttggggtagggttgtagggggagtatgatgtacgaattggtgcagggtgggggtgggagttcggtgtgaaggagtgcgtaggtctgcttggggtggtcatggcgggggggaaaaagtggcggggtgggtatcggaaggtgtgtgcgaggaagagctgtgatagtcatgggtgaaaagtggattacgtttgaaggggggagttctcaggggttgaggttggtgggatacgggatggaagggggggggggaagttgagtgtgtcttgattggtaggtggggtggagtaagatatgtccggattgggtaggtaaaaattagaacgaggggagtattaagtttaggtttgtggaggggtgagtagggtgggttgggaagaatagtggtgagggaaggggtatggcgagttggtgaatttggttttttgttgagaggaatggttgggcgaaggggtgggaggagggtagagagaaggggtatggggtggtgtgaggataggagggggggggaggataatgtacacgtgtatataatgtctaggttggtagggttcgattaagtttaatggtaggggtgtgaaacgtaaagaaggagaagttatagggggattaggaacatttgggagctgtgagggaggtggtctctaggagatcagaaggtatgatgtcattcttgaccggcaggacatggccggatggctcatatcagtctacaggtattatctgaaacctgttcatctgacgatgaagaagcagctgattaaatcgaagctgctccactgtgatgagacaccattcgtaatgccaaagaagtcaaagcagtacatgtgggtgcttcattctccgggaaaaggcggaggtcctccgatatatctttatgaatatctgggagcgaggaatggtgaggtaatacaggattaccttgaaggctacaaaggaatcctggtaacggacggatatcagccgtatcacaccatcatgaaaaacagcaatgatatcacagtagccgggtgttacagccacgtcagacgaaagtttgcagaaatcgtaaaggctgcaaagaaaggcgagaagctgacaccggcacaagagatagccgccgaggcagtaaagcggatcgatcagttttaccacctcgacaataagttcaaagaatcttctgatgaggaaaggctaaagaaccggcaggaaaacatcaggcccctcgtagaggacttctttgcgtgggtaaaaacatttgacagcaaaacgatatcgagtacgaagcttcgcgctgcattgaactatgccaagaatcaggaatactacctgaagaccttccttgatcatccggaagttccacttgacaacaacgatgcagaacgcagcatccggaagttctgcgtaggaaagcacaactggcacatcatagactcagtcaatggagcttcagcaagcgcactctactacagcatagcagagacagcaaaagcgaacggcctgaagccttacgaatacatgagatacctgatctcagaactgatcaagtatccgagagaaaaggttccaggcgatgaacttgaaaaactcatgccgtggtcagaatcaataccggatatctgccgaaagaaaaaaaacaagaaaaaataagcaagaataaaccagcccgaaagggctggaatttttgaaacttagagaacctgaagaaggtcaaaatttaatagtaacgcgtcaagaattttttttgaaggtgacgggttatctaccatttacttttgttgttgtctttgtggttttttttgctggcttttttacagtttttgtttgtgtttttgcctttgcaggagtttttgtaacatttccggatgcagagttattagcatcgactttttttacatttgcattggtaatattacctgcatctatttttttcactgctggatccgcagtaatatttcctgtatttatccctgatgctgtatctgtggtagtgtttgctgtggtatttcctgtatctgttgtggtgtttgctgtggtatttcctgtatctgtggtagtgtttgctgtggtatttcctgtatctgtggtagtgtttgatacatctgctttctttttttctgtatctgtttgagatgcgggtgcagctttggctttataccagtaatccatatcgacattgccgttaattccgccgacggctcccttgctggaatactgccacatatcgtagaggccattgtagtaatggatgaatttgctgtgggatgctacccacataaaatagctttttcccagagatgctccgtcaacgttcttagagagcagattatctccagaataaattcccggtgtgtagccacggctttttactgtttcacaaaatgccttgatgatacttgtacgagtcttcgaagaagccccgttgtcgattcgataatttttttcatattcgtaatcgataaaaacaggcaggctgatattatatcccttcagctggtcgcaggtgtaatttgcctctgccttggcttcagctgtagttgtggcggcgctgaaacaataaactccgacaggtactccggcttttatcgcagcgctgatattttctttaaatttttgatctgtatataaagcgcccttactggttttataacatccacggcctgttgctttgataattgcgaaattgacgttggattttaccgtagaccagtcgatatctccctgataatgtgaaacatcgataccttgcagagtgtcgtaagaagaatttcgaattgttccagttggagtcatttttgctgccatcctaagctttggaacaaagcttaagattccctcttcgtcagaggtccctgagtcttttccctgcatcgtgattcccatgtaagtcatctcttctttgcctaccgcatacgggtcagttgtttcagacgaagaggtggtctttgtaacagccgatgcataaaccaaaccaggtgcactaaacgtcatgatggctgctatggctgctgaaataattacttttgaaaaattcatttcgtctcctattactgctttttgtaattttaaaatcccacgatttttgcaatctagatcacattcacctgacaagatctcattgtctcaagcgctgcctcgtgcttctccggcgtgactccggcgcaacacgcagaatcgactgaaatctttatctccggcataaatgccttaagaagcagcgcgtttgaaactacacatatatcagtgcaaagaccgacaagttctatttccaccggctctttttcgctgatctctttaattttttctgcgagagacacagatccgaatgtcggcttgtcaaaaatatgatcagctcttatcagctttgaaatctggctttgaatctgccagccatctgtgcccttgatgcagtgctcgacaggaagatttctgccctcctgcgtctctaaatagtttgtcgggtgcgtatcacgggtagcaaaaacgtcatctgaagaatactctttaattttctttatcacatcagggacgatggctaaagcctctctggtgccgagagatccgtcgatgaaatcattttgcatatcgataacgattaagatttttcttgacatgggaaaaactcctgtatttattttatcataatctgtgccatttttttataaagtttcaaaatccggatgtacgtttcagcatacagtttattctctcgctaaatcgcagaagtttccggctatcgcggagctgcttgttatcaacatacgtcggtcttttcccgatcagctccaatttgcacaggcttccggctccgtagtccggccgtttatcaatatagagaatattttttgttattacctccagtgaccaccgaaaaattttcaacataggtcagaaagaaatccagatatgacaatagatttttcaagttttcactatagacaagattcaagtgttaattgttccaaatacacattttatcatatcaacatgcattaaaaaagctttattttgctccaatgccttggaggcaacaggcttcataacagcccatattgataaaacaatatttttttaatgcctgccgattctaaatatatgtaaacttccggctccgcaaaagcctatattgaaaatatgccagacttgcacaccccgatgacaagcagccggacttgcacataccaatggcgaactttcgagaatcttaaatgcagccaccgcgagtcgtacagcgaacgaattgagcgttttcgttgcgcgcgagcgcgctagctgcggcccgggtgtccacccgcctgaaccataaacgtatgtaaaccatacattggacagagggccgctaataagcgcgcgcgagcaagcagaaaacgctcactgagtgagctgtatgaccgcggtggctgcatggaaaacctccaagagttcaccaaatcgatgccttcactggctttccttgcgcgcgagcgcgctagctgcggcccgggtgtccacccgcctgaaccataaacgtatgtaaaccatacattggacagagggccgctaataagcgcgcgcgagcaagcagaaaatgctcactgagtgagctgtatgaccgcggtggctgcatggaaaccaaaccctgcaagaattcaccaaatcgggcaaaaataacctactgtcccataacagctttggcgactacgtctgcaacctccggcatgaaagcgtcggcgatgatgttgtcgcatgacagctggtcgtcagggatcagagaagcgactgacttcgcggcggcgagcttcatatcctcggtgatagccttagcgccgcatgccatggcacccttgaagatgccagggaaaacaaggacattgttgatctggttcgggaagtcgcttcggccagtagcaacgacggcagcgccaccggcctttgcctcaggaggcatgatctcaggtgtcgggttcgcgagggcgaatataatggcgtctttattcattgaggcgaccatctccttcgttacgattccaggagctgaaacaccaatgaagacatcggcgccctttaaagcatcggcgagagttccggtctttccggagagatttgtcacctcgaccatttttttctgcatccagttcagatggtccatatttgtcttagagagaatgccggtgatgtcgcacatagtgatatctttgaaaccgtatctcagcagaagttttgtgatcgcaactccggctgaaccggctccgtttaccacgatcttcgttccctctactgtacggtgcgtgacctttaaggcattgatgattccggacagcacgatgatagctgtgccgtgctggtcatcgtggaaaacagggatatcgagctcttctttaagtctctcttcaatctcgaaacagcggggagctgaaatgtcctcgaggttgatgccgccaaatcccggagctatggcctttacggctttgatgatctcctcggtgtcctgtgtgtcgaggacgatcgggaaggcattgacaccgccaaactctttaaagaggacgcatttaccctccattacagggagtgcggcgtaaggtccgatatttccaagtccgaggactgcggaaccgtcagagacaacggcgatcgtgttgcccttgatagtgtagttgtaagcctcatgcttgtcctttgcgataagtctgcagggtgcagcgacaccaggagtgtaggtgactgataagtcgtgtcttgttttcacaggtgtctttggctctgtactgatctttccgtttaatttgcggtgcagctccatcgcctcttcatcgatagtcatgttagtctgcctcctgatttacatatttaataagtccgcctgcgtcaatgagtttctgcatgaacggagggaatgcctgtcctttaaatttctcaccggtcgtctcatctgttacgacgccgctgtcgaaatcaacggaaactatatcaccgctctttattttttcagaggcttctttgctctcgatgatcggaagtcctatgtttatcgagttcctgtaaaaaatacgggcaaatgtctccgcaataacacagcttacacctgctgcctttatagctatcggcgcatgctctctcgaagaaccgcagccgaaatttttgccggcaacgataatgtcaccctttttcacatttttgatgaagtccctgtcgatgtcttccatgcagtgctgggcaagctcctcaggtttggtggagttcaaatacctggcaggaattatgacatccgtatctacattgtctccatatttataaactaatccctttgctgaatccatgatgcctcctatactgttgccgggtcagtgatacggcctgtgatagcgctcgctgctgctactgcaggtgaagcaaggtagatttctgaatcggtcgcacccattctgcctacaaagttcctgttcgtcgtcgaaacgcacttctcacctgaagcaaggattcccatgtaaccgccaaggcacgggccgcatgtcggcgtggaaactactgcaccagcctcgataaatgttcttaagtatcctgcgttcatcgcatcgagataaatctgctgcgtggctgggattacaataacgcgaagtcccttctttactttctttccctttaaaatatccgccgcgatcttaagatccgaaatacgtccgttggtgcaagagccaataacgacctggtcgatctcgatatctcctgcctcatctactgtctttgtattctcagggagatgcgggaaagctactgtcgggcgaagctttgagaggtcgatagtaatggtctttgtgtactcggcatccgggtcggcctcgtaaactacaggctccttggcattgtgctctttaatgtactcgagagtcttgtcatccactgggaagataccattctttccgccggcctctatcgccatatttgaaatagtgaatctgtcgtccatcgaaaggtatgaaacgccgtcgcctgtaaactccatcgactggtagagggcgccgtctacaccgatcattcctatgatatgtaaaatgatatcttttccactgataaacggagccggctttcctgtaaggacaaatctaatggcggaagggactttgaaccatgcctttcctgtggccatgcctgctgccatatccgtagaacctactcctgtagaaaatgctccgagcgctccataggtgcaggtgtgcgaatctgcgccgatcacggcgtcccctgccgtaacgagtcctttttcagggagaagggcgtgctcaatacccatctgtcccacgtcgtaaaaattcgagatgcagttctcacatgcgaactgtcttacctctttgacgttttcagcgctcttgatgtccttattcgggacgaagtgatccattacgagagcgatcttgtccttgtcgaaaacggacttgtcatcgagattctccatggcgtgaatggccacaggggaagtgatgtcgtttcctaacacaaggtcgagattcgcttcgatcagctgtccagcctctactttatcgagtccggcatgctttgcgaggatcttctgtgtcattgtcattcccatagcaaacttttcctttccaacagcatgttgttacgctttcttcattttattattttgtggcacctttgtaaagcttataatcttttaaaaaaagacccggctgccgcgtttttcacgcagcagctgagtcttgaaaatttttgattgaaaaagcagatttctgtcaagatcagttgttgatgagcttgctctcgtcgctccagctgtacagctttctgatctcctcgccgaccttctctgaaggatgctcctgagccttctggcgaagcatcttgaagtgtacctgacgtcctgccgggctcatgtcgagaaggaagtccttggcaaatgtaccatcctggatatctgagagaacggccttcatatgctccttaacatcaggtgtgatgatcctaggtccggaaacatagtcgccatactcagctgtatttgagatagagtatctcatgcccatgaatcctgactgatagatcaggtcaacgataagcttcatctcgtggatgcactcgaagtaagcatttcttggatcgtaaccagcctcgcagagaacctcgaatcctgtctgcataagctttacaacgccgccgcagagaactgcctgctcaccgaagaggtctgtctcagtctctgtacggaatgtagtctcaagaagtcctgcacgggctccgcctaatgctgcaccgtaagccttggcaacatcccatgcctttcctgtagcatcctgctcaacagcgataagacaaggagttccctttcctgcctggtactcagaacgaactgtgtgtcctggtgccttaggagcgatcatggcaacatccacatctgctggtgggatgattgtatgataatggatattgaaaccatgtgcgaacatcagcatgtttcccgattcaaggttcggctcgatctctgccttgtaaatgtcagcctgcttctcatcaggtgtcaggatcatgatgatgtctgcccacttagctgcatcagcagtagacataactttaagtccctgtgcttctgccttagcctttgactttgatccctcatagaggccgactgcaacgtcgcatcctgaatccttgaggtttaatgcatgggcatgaccctggctgccataaccaatgatggcgatcttctttccattgagatatgacaaatcacagtcctgctgataaaacatccttgcttctgacataaaatatcctccttgtcaagttactgtgtttgaaagcggaactatatccgtttcctgcaaaattaaagtgaatgtttcttcccgtcctcgtcaatcaagactacgttcttcgtgcctctggcaagtccggtaagaccggtacgggcgagctccagaatatcgtaatcctcgagcatgttgaggaatctctcgagcttgtctgcgccaccagtgacttcaaggaccatagaatccttagtcacatcgacgcatctcgcattaaaaatgctgcatatagaaagtaccgactgtctgtccgtatcccgtgcgctgatctttacaagcatcaggcctctggtaactgaatcattcggctcgagcgtcttcacatcgacgacatcacagagcttggcgacctgcttctcgatctgctccaatatcatctcatctccgtgggtgacgatcgtgatcctcgtaaatctcggatctgcggtgactcctgaggagaacgaatcgatattgtaccctcttctcgagaatagtcccgacacatgactcagaagtcccggggtattttcaacgagtatcgataaaactttctgcatcctttttccttccttcaactgtccctaattctatcactataaattcttatgtcaatagttttattcactatcggagtgaataattttcaatacaaaatatttcaccgctgtagtgagtaaaattcaacacaagctgtatagacatcattttctatgtaaaagtggctgtcagagctgcttctaagggtcttatagagaggcactctcctggctttcatcatggcttccttcattgtccaaagccttaaaaactcatctgttctgtcctctgagccctcgacggcaaaagcctcttcctctgaaaaaaagcgccgtgagagtcctgttacatctctgcggcgcgccctgctcttctcctcaatatcgattccaatgctaatccctggggtgtcagttatcgcgacacaggcagtgttcccactgtgacttaccgaaaaatcagcccttccggatgcaatataaggcctgccgctctctgcctcgcggtattcagctgcctcaatgccatatgcctcaaacgccttaaaaataagagctgaggctgccctgtactcccagctgtctctctcgtgcctgtatgggtgcatcagctgttcgtattttaagatatcacaagctgcacctgaatctttttcaatgaaaaatatgtccgtcattcctgttccatcgcatcgatcagagccgggatcacctgcttctttctggaaacgacgcctggaagcatctggaagcttccattctcatcctcaagcaccggcttgtcaggaaaagctgcgcggactatgtctccgctgtttcctccagcgcagacgagacgggtcgactggtccaaaatattagtaagcatcacatagacctgatttaaattcctgtctgcaagaaccctctcaaggaaatcgccaaggctctttcttacgctgttaagctgcttgtctgaaactgcagagatctgcgatactccgaagtctgtatctccctgactgaacgtcttgaaatccgtatagaaaatctcgctgatagattttctggaaaagttcgatccagcctcgaacatcgccatagcgtgtttttcgatattgacacctgcgattttggcaagctcctcggcggcaaccctgtcggccccggtgcaggtcggcgacttgaacataagagtatcggagaggatcgcagaaagcatgagtcctgccatctgtggatttacctttacttttctctcctgatacatctgatagattatcgtcgaacagcagcctagtggcatgtttctgaagtagataggtgatatcgtctcgagggatccgatcttgtggtggtctatgacctctaagatctcagcctcgtttattccgtcgactgcctggtttttctcgttgtggtcgaccaggatcacccgctttttctctggattcaagaggttacggcgtgaaaacattccgacgtagcgctggtgctcgtcgaggattgggaaatccctgtggcggacctttccgatcacacggtttacgtcgtcgagatagtcgtcctcttcaaaggagacaatatcactcttcgtcatgaaatacctgatcggtatactctggttgataagtctggctgtcgtaaaagtatcgtactctgtggcaataaggacacagtctatagcctctgcggtctttacgacttcagggtcgacttcctttacaccagtgactatcatgcagcccggaatctcctcgagaactgccttctggtgctcgactacatttcctaagatgacaagatcgtcgccatccacttctgaccggatgctcttagtattgccagcggccacgaccacttttccatggttaaaatatgcgtgctcatttccgcagataagtacgccattcagcgtctcgataatatttttgtactgagtcctcgcgcggccgagctccctgttgtcgtacacatccatgtacgagtaggcgatatctccgtttacaatgagtccgtcgagcctgccgtctgactttacgatcgggagagttacgacatcgagctgtctcatcagagcccaggccttcttcagggaaaggtgggcgtctacgccctctgtgtgcctgtaattcatatccctgatctgtgtgccgacactcgatactgtctcaggctccctgacatgaaatgtcttcaggacatacctggtctcatcatttatcggaccagcttttttcgggacaaaatccccctcttcagtttgatttttaagatttgcgtatgcgatagccgcacagatggaatccgtatcagggttcttgtggcctatgacccagaccggggtactatgttttaatttttccatatatgataattaaaaaaaggggcagtgccccttggattcagattatgtcaaataaatgcagcaaaataacagcagttaatgcaagatttgcgataaggaagataatgaccgggataaacttgtgcttcaggctctggtacttctcctcgaatgagatatccatctcgtccgtgcggtccattcccttgatagtctccttgatgttccggtaagcctgaacattctcagagtggatcttgtcagcgaggtcctgccttacatcgtcgaggctcgagctctcagccggctgggtaagcgtctccttaatctcgtttactgattcatttacagtgttaagaagtacctcaatcttctcagctccagcatgattctcctctgaaatcttatcggagatgttctgattcaaatctgaaatatcagacttgaccgatgtgagcatcctgtcgacctgagtctcaacggtcattacgagattgtccgcctctttctgcttcgtatcaagctcggactgcagagctgcgatctgctcctctttgtcagctatgtcggcttcccgttcctttacgagagcctcaagcgctacaaccttcttctgcttcgcgccaataaggcctgacagcttcacagccttgtccctgaatgcatcgatctgtactaaaagagcatcggagccgtcgtagtcgtcagtatttgaaaactgtgtatttacattttcgtccataggaatttgtccctctgttgtttaatttttaactaatatagtgtaacacatattattgaagcaggtcaaggagttcatcctttgaaaagttcataaagctcctgccgtcgccatttaaaatctcatcagcgaggttctgcttctcctcctgcatcaaaaggattttttcctcgatagtgccctttactatcagcttaaagactgagaccttcgacttctgcccgatcctgtgtgcacggtcagtcgcctgattctcggcagccgcgttccaccaagggtcgaaatgaataactacatcggctcctatcagatttaatcccgtgcccccagccttgagtgagatcagaaataccggtacctcgttctcattgaaatcatttaccagctcaagtctctttttctttggcgtcgatccggtgatcaggtaatagggaattccccgctgatccaagtctccctcgatcagctgcagcatcgatgtaaactgcgagaaaacgagcatcttatgaccgccatccatagcctcctctataagttccatcagaagctgtctcttcgcagagcctcccttgtaatcctcgattattagtgacggatcgcagcagatctgtctgagtctcgtgatatctgcgaggatcttcatgcggtttttgttgaaatcttcctgactcgtcttttcaagcaggtttttcatgcggataagctggctgtcgtaaatttttttctgtgaaggctcgaatacggtatagcgcacctcctcgatcttgtccgggaggtcccgaagcactgtctccttttttcttctaaggataaatggcgatgtcatcgcggcaagcctctttgtaatctcctcgtccttgtcatttacgatcggcgactcataatttgtcctgaaggtttcgtagtcgtacaaaaatcccggcatcagaaaatcaaagatgctccagagctcagagagcctgttctcgatcggagttcctgtcagcgcgaacctgtgggctgcctttacgatctttacagacttgctgattcctgacttcgggttctttatatactgtgcctcatcgaggatcatatagtcgaaacttttgccttcgtagagcttaatgtcgcgccttagaagatcatatgaagtgataaggacgtctgattcactgttgtctattatctctttccggcctgccttcgggccgtctacaggcgttacggtaaggcccggagcgaacctcgtaaactcgttctgccagttgtagaccagcgatgcagggcatacgataaggcttctcttaagcgtcccctgctcgctctcatatagaagagccgagatcatctgaagcgtcttgccaagtcccatctcatcagcaaggattccgccgaagttatagccggcgagtgtaaggatccacctgaacccctccttctggtaatttctaagcacgttttttaaagacttaggaacatcgtagtctgcatccttcgtggtcttgaaattcttgaccagtgtcttgaaatttctgtccctgtctgtcgcgatctcgtcgtgctcttcgagcatcttgttgaggtagagcgccctgtaggccgggacatccatttttccgtctgtaaactcctgaacggaaacgtggagatcctccatcatctcctccagagcagcgacagaatcgttgtcctcgaatgacagaaaatcaccatttttcaggcggtggtattttctcttcgccctgtagcttgtgagcacgtcggcgagctcctccatcggaatgtcgctcgataagacattaagcgacaacagtccgctgtccacggacactccgaccgagagatgccagccgcggcgcaccgtaagcctgttgaactggtccgaagtatttacgtcgcccagcttcatcagagcgttcacgccctctgttatgatattaaatacagtgtccggatccttgtcacaggagaacctgcctgttttttcatcgtagttcgggaaaaatccgttgaccgcgtcgattatctggttctcgcgctctatatcacggtaaaagttatcgccgccctgcacctcatttttatcggtcagattgtatgaaaaatcgccgtaaactgccctcgcctcgcagtacacgtcctcctcatctgcatctaagaaaaatgcgaacgtcgattcaggcggcagatatgcctctatcatctgctcgtcctcatttttcaggtggacgtatttttcaatctgcggaagtatatggtagtagaactgggcaagtttgctgcgtcctataacgaattcgatatcgccgttatcggaggattctatgaatggtttcagaactttcgcattctcccttgaaatcttcgcaaaaatgccgccgctgaagtagtaggctcccctgattccctcgatcaccggaggcacgtatccgctcagcgaaatcccgttgaactctccgtccggatcgagattcgcattagctgtaagagagatcacaaggtctttttcctcggccttcaccggactcctgacctcgtcatccatgtcctttgccacgatgtccaaggactttccctcaaccatatcgaaaaattcatcgaggcgctgtccataaagcgtgaactccttcgctgtcatggtcttattgccatcggtcagatcctgtctgtaggattcctcctctacatacgagactatgaaatcgtacattttctttgaggtatccgtaaaatcctgcttcgcaaagagaatgctggatttcttgccaagaggatagacatctctgcttcgatatttgtcaataaggtcgtaaaggctctttaccaggtatgggcgatccgtcccgaccttaaaatccacccggagctggggacttgtcccgtagtaccagtggttattgtaatagtaatttctctcagcagaaaccagcttgagtcgcggcgtgatgatcacgtttttgtcaagctttgtgccatttggaacaaaaccattctcggcaaagcctgccagaagcttttgtcctgtgatgtctgtcgagtcggccacattcggattctcgatcaggtaattattcgtaaggataagagctgccagaacatgctcacagagcggttccttcttttcacgatccgaaagcggatagattccgtaatacgaatcgtatctgtcgcaccctggaactccgcagtgatagtacagcatatcctctgtcagaaggataagctttattacgcgcccgccatggttcctgccatatcttgcagagatgtcacccgaaaagctggccgtcacaaagagagcgtggttgtcatcgtaatcaggcacgtaatcgtatctgttcgtatttacaaaaccagtcctgacctcagtgatagtcatctcatttcttgagatgatctccctggccttttcaaaggctccttttgtaatcgtataattttttaatgcctttgaaactgtaaaaaaccggtactgcctctgataagcagggagatcgctgtcgtcctctttcggcattggaaacacctcttccggagacatcaaatccttctcatttcctgaaagtctgccgtggcttttcaactgatccagataatcaaaaaaagcggctaagtgtgcgcaccgctttccatttaaaaaatcttcacagctgcagtacagtgacggaggcatattatctccattgtcaataatctgtaccgtgttcgtgtatccaaatggatcggtaacatttccggtatagagattattgtccctcgaatacagctccactttgccgtattttgccaggtcttctgcgtccaaaaggacggactttttgaacatttttttccagttcatctgtatctcctttttgtaacctgaatgttattttaccacaagaaaagcggtaccgcaatcgcggcaccgcctgatttcagatgtgaagtatgcctccacatctgatcgattcttaaattatgtcgaaggattagtcggccttgtaaacgtctaccatctttgtcaggtattcgtagtgctcctttgactgctcctctgactctgcgaacagcttggctgccttgttcggattgaactttgcaagagctgcgtatctgttctcgcccttcaggaagtcctgatagctgccagtaggcttcttggaatcaaggatgaatgcgtccttaccttccttagcaagagccgggttgaatctgaagttgaaccagtaacctgactcaacagcaagcttctcctcagtcatagcctttgccatgcccttcttgataccatggttgatacatggagcataagcaatgataagtgatggtcctggataagcctcagcctctgcgatagccttaactgcctgagccatgttagcgcccatgtcgatctgagcaacatatacatagccataagacatagccattccagcgagatccttcttcttagtctctttaccacctgcagcgaactgagctgtagcaccgcaaggagttgacttagatgactgaccacctgtgttagagtaaacctcagtatccagaacgaggatattgatatctctgccagaagcgataacctgatcgaggccgccgtagccgatatcgtaagcccatccatcgccaccgaatacccactgtgacttcttggataagaaatccttctcttcaaggatagccttggctgcatcgctgccgtccttctcaagggctgcaacaagcttatctgtagcggcaccatttgtagcgccaacttcgaatgtatcgttccactctttgatagcgtctgcaagctcgcctgtagcgttcatatcatcgagctgtctcttaagtctgtcacggatagctctctgagcgagaagcataccatatccaaactcagctgcatcctcgaacagtgagttagaccaagcaacacccttgccctggtcgtttactgtgtaaggagtagatggtgatgagttgccccagatagatgagcatccggtagcatttgcaacatacattctgtcaccaaacagctgtgtaataagcttagcataaggtgtctcaccgcagccgccgcaagctcctgagaactcaagtaatggcttcttgaactgtgaacccttaactgtgttgatcttaaacttctcaacaacctcttccttctcaggaagtgatactgcataatcgaagtacttctgctcgtcctcgttctcttcgaatgagctcattgtaaggcagcttacagggcagacattagcgcatgaaccgcagcctgtgcagtcataagctgaaatatcgatagcgaacttgtatccaggcatgccgttcatatccttcatcggcattccctctggagccttagcagcctcgtcagctgtcatagctactggacggattgcagcgtgagggcatacaagtgaacactggttacactgaatacacttattaacatcccaaacaggaacatctgtagcaacaccacgcttctcgaaagcagctgtgccggaaggtgtagaaccatctgcatacttcttaactacagatacagggattgtgttaccctgctgagcgttaaccttaacctggatgtccttaacgaactcaacggcatcagctctgtcgccagtgatttctcttgagtagtcatcatccttggcgtctttccagctctcaggtacgttaaccttgtgataagctgtagcaccagcatcgatggcatcccagttcatctttacgacatcatcacccttacgagcatatgaagccttagctgcatccttcatgagtttgagaaccttctcctcagggatgagctttgtcagtgagaagaatgctgactgaaggacagtgttgatacgctttccaagtccgatctccttaccgatcttaacaccatcaatgatgtagaagttgatgttgttctgagcaatgtatctctttacctggccaggaagcttctcatcaagctcatcctctgtccactgagtgttgaacaggaatgtgccgcctggaacaaggtcctgaaccatgttgtacttatagatgtaagctgtgcagtggcatgctacgaagttagcctgtgagatcaggtatgtagatctgataggctgatgtccgaaacgaagatgtgaaatagtaacaccgccggacttctttgaatcataatcgaagtatgcctgtgcgtacatatcggtgttgtcgccgatgatcttgattgagttcttgttagcacctacagtaccatctgcgccgagaccccagaacttgcagtttgtagttccctctggtgtagtaacagggttctccttaacctcaagtgaaaggttggtaacatcatctgtgataccgatggtgaactgtggcttctctgtatttctgaatacagcgatgatctgtcctggtgtagtatcctttgaaccaagtccgtaacggcctgtgtaaacagggaccttctcgaactctgttcccttgagtgctgcaacaacatcaaggtaaagaggatcacccatagcgcctggctccttagttctgtcgagaactgagattctcttaactgacttaggaatagctgcaacaagggcttccttaacgaacggacgataaagtctgactttaactacgccgaccttctcgccttccttgcgaaggtaatcaatagtctcatcgatagtatctgtaactgaacccatagcgatgatgatgctctcagcttctggatcgccatagtagttaaacagtgcgtaatttgtaccgatcttctcgttaaccttgttcatgtacttggtaacgatagccggaagagcgttataacgctcgttgcaagcctcacgagtctggaagaacagatccgggttctgagctgagcccatctccttcggatgctctgggttaagagcgttctttctgaactcctcaacaaggttcatgtcgagcatatctgcgagatctttgtaatcccatgtctcaatcttctgaatctcgtgtgatgtacggaatccatcgaagaagttaatgaatggagtatgtccctcgagtgctgcaagatgtgcaacaggagtcagatccataacttcctgaacagatccttcgcaaagcattgcgcaacctgtctgacggcaagcgtaaacatctgaatggtctccgaagatattcagcgcatgtgtagcaacgcaacgtgctgatacgttaaatactcctggaagtccttcacctgcaatcttatagaggttagggatcataagtaaaagtccctgtgatgcggtgaatgtggtggtaagtgcgccggctgcgagtgaaccgtgaacagcgcctgaagcacctccctcagactgcatctcagtgatctgtactgtctggccgaaaatattctttctgcctgcagtagcccactcatcagtagcttctgccataactgatgaaggtgtgataggatagatagctgcaacatccgtgaatgcatatgatgcatgtgcggctgcatggtttccatccatggtcttcattgatcttttgatcattgtctttcctcctactactatactattgacgaccttcatgcctaaccattacatgaatacgcggcacgatagccgtttttgtccgcctttttaaatatagtatttttgcacaaaaaattcaatgatttttacaattcttaggtgttttttatacgatacagctctatcattttagccattaaaaaaaccgccccgcagggcggtaacaagcaggccaggtaacaagcaggctatataatgaagttcttttcgctaaactcgagtttctcctttggctcgctctctttaatctcaaagaacgacctcgcacatgactcagacttcgcttacgctcgtcttcgtctctgtgtcttttgaagttctgtttgctaagctcgagctacgcctccggcttgctctcgctaagcgcacagaacgacctcgcttcggattcgagcttcgccttcggctcgctctcatctcgaagctttcggtcagtcgtccgactcctcgtcgtctgtcgtattatatacagttctctttctggccatctcatctgactcgagatactcgtcgtaagtcgtgactttgtcgatcattcctccatccggcagaaactcgatgattcggtttgccgtagtctcgacgatctcgtgatctctcgatgagaaaaggatcactcccttgaactttttcattccctggttaagcgccgtaatagattccatatccagatggtccgtaggctcatcgaggatcagaacatttgacgcttcgatcatcattctcgaaagcagaactcgaactttctcgcctccggagaggaccttcatcttcttgttgccgtcctcacccttgaagagcattcttccgaggaatcctctgacataggtcgcgtcctttatctcggagaactgcgtaagccagtcggctattatcatatcgttgtcgtcgaaaatctttgaattgtcctttggaaaatatgactgggatgtcgtaacgccccacttgtagcttccactgtccggttccatattgccagagaggatctcgaagagcgtcgtctttgcggcttcatttcctccgacaaatgcgatcttgtcatcgtgtccgactacgaatgaaacattgtccaggactttctttccattgatggtctttgtgagtccgtcaactgtcagaacttcgtttccgatctctctcttcggtctgaaatcaataaatggatattttctggaagacgggcggatgtcatcgagctgaatcttctcaagtgctctctttcgtgatgtagcctgtttgctctttgcggcatttgccgagaatctcgagatgaattccttcagctctttgatctgctcttccttcttcttattctcttcttttctctgctttaagatcagctgtgaggactcgtaccagaagtcatagtttcctgaatacagctggatcttgccatagtcgatgtctgcgatgtgcgtacaaactttatttaaaaaatatctgtcatgcgatacgacgatgactgtattttcaaaatttataagaaattcctcgagccagccgatagcgtcgagatcgaggtggttcgtaggctcatcgagaagcagaatatccggatttccgaaaagtgctctcgcaagaagtaccttgacctttaatgcgcccgggaggtcgcccatttttttctgatgattctcctccgatactccaagtccgttcagaagtgtctcggcgtcactctctgcattccatccgtccatatcggcgaactctgcctcgagctccgaggccctgattccatcttcatccgagaaatccggcttcgcgtacagtgcatctttttcctgccttacatcgtagagatgctggtttccctggattactgtatcgagcacgatctggtcatcgtatttgaactggtcctgctccaggaatgaaagtctctgaccaggtgttatcgttatctcacctgtggtcggttcaagacgtcctgacaggatctttaaaaatgtggactttcctgctccattggcgccgatgattccatagcagttgccctctgtgaacttgatatttacgtcctcgaaaagtgccttctttccgacacgcagcgaaatgtttgaagcctgtatcatgcttttcctccattgtattctgcaaaacttttcttatcatacaagaaaaataacctattttcaagtatcccgccaaaaatctcttatccgttcctttccggcatctgtttatctacgcccatccgggctccttttacagactccggctcgttttccatctccagtacgtaatcttctgcttgcttttacggactcagaagcattttccatctcaagtccgtaaatccacacttttatttacggactcacagctatttttcagccccagtccgtaatcctctgtttgcatttacggactccggctcgtttttcatctccagtacgtaatcccttgcttgcttttacggactcagaagcattttccagttccagtacgtaatcttctaacttcatttacggactcacactaatttcccttccccagtacgtaatacccaaggtatctttacagactcaggctcgtttttcgtctcaagtccgtaaatccccactcgcatttacggactcacactcattttccttccccagtccgtaatcccctgcttgcttttacggactcaggctcatttttcatttacaatacgtaatccaattatatcgtgctgaataaaatatgtgaaaattcaaaaaaaattgccaaatcattataatcgtggtataattccagtatctttttcacattgttgaaaaacaatgaatgaatccaactgtcgtcagtgaaaattccaagtgtttcagagattttggattcattattctgcgttgatttgtccagtattgtgcagcagaaggatgcacaacaatggacggggttttaaaaaggagggagtctctatgacaagggaagagcttatcacattactcaattccaggaagaagtatctggaaacaatcatctcatcgtgcgagaaaaaactcgcgtcagcaccagaaggacatttgatagcatcgaggtctcatggcagagcgcagtattatttttgcgatgattctgatttcaatcgtacatatctgaaagacaaggatctggcagaaaagcttgtttccaaggactatcactctaaagttttatcaagtgccaaaaaagaacttggtataatatccagattcttaaaaggcatttccatagttccaatcgaagaaatttacagacatcttccatcaatgaaacaagagcttgttcaacccctctgcattgataaggaaacatatgcaaagcaatgggctgaggccgaatacccaaagcttgatttcaaaataagcgaagaatttatttctaacgatggcaaacgataccgctcaaagtccgaattgctgattgccaatgccttaaaagatgccggcgtcccattcaggtatgaatgcagactcgacctgaagggttacagctccgtatatcccgatttcacagttttaaacaaacgaaccggccatatatattatcacgaacatcttggaatgatggaaaactccgattatctcattaaaaatctgcaaaaaataaacgcctacgagaagaatggcataatgcagggcaaacagcttatcctgacatttgagagtgagcatgtcaatctcgccatgaacgttataaataatatcatcagggaattttatatttgacacagcatgataaaaaaaacactttatctacatgcagccatattcaggaattacttgtaacaaaacaagtgccaggaggcaatcctcctggcacttgtttattaacttcgcccatccgggcatcactacgaactggagaacttttttcaattcaaaactataatctcatgcttggatttacagactcactgctatttttcagctcaaatccgtaatctcctggcttcatttacggactcagcagcatttctcatctccagtccgtaatcccatgacttcatttacggactctctgctatttttcaactccaatccgtaatctactgacttcatttacggactcacagctatttttcaactccgatccgtaatctactgactgaatttacggactctctgctatttttcgtccccagtccgtaatctcttgtcttcatttacggactcagctgcatttttcatccccagtccgtaattcacaagctcaatttacggactcacagctatttttcgtccccagtccgtaatctcttaactgcttttacggactcagcagcattttccatccccagtccgtaattcacaagctcagtttacggactcagactcatttcccatatccagtccgtaattcacaagatcagcttacggactcaatctcaatttccatctccagtccgtaatctcttaactgcttttacagactcagcagcatttttcatacccagtccgtaattcacaagctcagtttacggactcagactcatttcccatctccagtccgtaattcacaagctcggcttacggactcagcagcattttctatcctcactccgtaatccacctcagtgtcccttcggctttctgtacaaaagctcactctcgtaggtgcggtcagcataaagcaggcggaagaagacgaaaatctcgactccggtcgcgcaccagatggcatagtcgccaactatcatgcataaagatgagcagacggcggctccgccgacaaagaaggcgaccatcagggcatgtcttctgaaacggttgaaattctccggttttctgtggtgaagatactgaacaaggtggcttcccatctgccttacatggttagtgacaaaagtcgtagccataccgacgccctcggcctgtctgaaagtgttgaactgcatagcagccaggaaattcaaagaaatctggctgatctggtcaggcgctgactttggaataaagccaagtatgatagtgactattgcctcgatgccaactaacagcgtgtcccagcgcatcagatgaagcggcttgatagagtatgccaacagctcgcttaacattattccacctaagtatgcagtaaacggaataaaataatagagagctccgccccagtcgccttttcccagatgaatagcaagcattacgaggtttgcagtctgggcgttgcagaaaattccacctctctgtacaaaagtatatccgccgaagacacctccggcgaatatcaacaaataaaaaatatactgtttttcacattcgagaaacttcgtgtcttctctcgtgcttgtgtcagacaagttattttcctccaaaaacttgaatataaggaagttcttttcgctaaactcgagcttcaccttcggctcgttctcgttaatctcaaagaacgccctcgtttcggattcgaccttcgctttgctcggtcttatcttgaaactttcgtgcaatctcaaagaacgccctcgtttcggattcgaccttcgctttgctcggtcttatcttgaaactttcgtgcaatctcaaagaacgccctcgtttcggattcgaccttcgctttgcccggtcttatctcgaaactttcgtgcaatctcaaagaacgccctcgcacatgactcggtcggcgcttacgcttgacctcgtctctgtgctttcggtcagttcttgaacgagtgtatcggcgccggaatcctgcctttgcggtttacgaaatcctggcagtcgaactggtttacaggcataataggtgcgtgtcccaaaaggccgccgaactctacggaatctcccactgtctttccgataaccgggatcaggcggacagctgtcgtcttctggtttaccattccgatagccatctcatcggcaataataccggagatcgtagtggcctttgtatcaccagggattgcgatcatatccaggccaacagagcagacgcaggtcatggcttcgagcttttcaatagtaagcgcgccggcttccacggagtcgatcattccctgatcttctgaaaccggaatgaaagcaccggagaggccaccgacataagaagaagccatgattccgcccttcttaacctgatcgtttaaaagtgcaagcgcagccgtagttcccggagcgccggccttttcaacgccaatctcctcgaggatgtcagctacagaatcaccgacagccggtgtcggagcgagcgagaggtcaatgataccgaacgggatatggagcatcctgctggcctctttggcaacagcctgaccaactcttgtaatcttgaatgcagtcttttttatagtttcacagaggacttcgaatgactcgcctctgacatggcttaaagcagtctttacaacgccagggcctgagacgccgacatttattatcgcgtcagcctctgaaacgccgtggaatgcgcctgccataaacggattgtcatcaggagcgttgcagaatacaacgagcttcgcgcagccgagggaatcgttctcctcagtggcgagcgccgtatcttttacgatctggcccagaaggcggacggcatccatatttatgccggtcttcgtcgagccgacatttacagatgagcagacgaaatcagtcgacgagagggcctcagggatagactcgataagcatcttgtcctgagtagtcatacccttgcttacgattgcagaatagcccccgaggaaattaactccgacctttttggcggccttatcgagtgtctttgcgatcgtcacatagtcctttgggctgtggcatgcggcggcaccgatcatcgcaatcggtgttaccgaaatcctcttgtgtacgatcgggattccgaattccttctcaatcttatctccgaccggaacaaggtcctttgccactgtcgtaatctttttgtaaatattttcgtttaatttgtcgagatcagaatcgatacagtcaaaaaggctgatacctatcgtaatggttctgacgtcaaggttttcgtccgagaccatgcggttggtctcttcgacttctaatatgttaatcatgtaatcctcacaatacctggaaagtttttaaaacatcccatttcgtatttggcacgttagtctgtaaacctggactttggggatgacggctgccacagatgaatggcgaacgattgtcgcgttgggagccatcagctgtgacatccgttatctattgtacaggctgaacaaggaagttctctacgttaagctcgcacttagcctatggattgtgctgcaagtgacttgcatgcaacgcgcgtaaggcggcaaaatacgccgcctaagcgctcatagcaatcgctgacctaagagaacgccctcgcttcggattcgaacttcgccttagcctcgttctcatcccgaagctttcggtcagattctgtgcatcatttcaaaaatttcttccttctggcagcggatgtcgactccgatatctttgccgacgtcggccagacctttctgaatatcgccgaacgactgatctgcggcgctggtgtctacgatcatcatcatcgtaaagaaaccatcgaggatcgtctgcgaaatatcgaggacatttgcgtgatgatctgacaggtatgtgcatacctttgcgatgatgcccactgcatcttttccgactacactgataatggtgcggttcttactttccatttttgctccttttcctttttccaaaataaatcctgccaaaatattatggcttggtggtcaaccctttaaccaccagaccattatataacgaaaaatgatatgtgattgttttaaaaaaataggtaattgtattttatacaatgatttggcggtcaacgcgtgactttcgacacttatatcatacaattacccgctctgaaacttcatgcctagaagcgactgtaatattgaaatcacggcccttgtaaggattgtcgccatcagtcacctcgtcgcagacagtctcaagcgccaggcggccgtagttgttctgctccgaaaggtggcctaagaatacgtgctccatattgtcatttaaaatttttccgagaagctgccccgagagattatttgacagatgcccgtaatcgcttaaaatacggcgtttgagctgataagggtaaggcccgacctcgagcatgttcacatcgtggtttgcctcgaggagcacggccgaaaggcccttaatgtttgaaactatgtagtcatcatattttcctaggtcagtaatgactccgacttttttgccgttgctgccatctcttatgatgtaggccaccggatcggctgcatcatgcgagatgcggattggctttacaaggagacttccaatctgaaaaacctgatcaggctctatcacatgaaaaagactctcgtcgacttttcctatacggccatctcttaagattgcctttatcgtgccctccgtcgtatagaccggaagaccgtaacggcgcatcacgacgccgagtcccgacacatggtcaatatgctcgtgcgtcacgagaataccggccatatctcttgtcgtaagatcgtaggtattcataccggcctcgatcttttttccggaaatcccggcatcgatcatcacgtgtgtgtcgtcgtttcccgcgcagatgcagttgccgctcgacccgctcgctattgaaaacatctccatcattctaaatcaatcctcagttcatcgccatctttgatggcatcggcgtaaccgcatttgacaccgtttctcaaagccgttactgtacgtccgttggcctgacccacatcgaagttcactttagccaggacatcagcgaaaatatagtcgtttctgccagagaggctgacctttgcaccattgaaggtaacatagatcacatttttcggaatgcccatctggtcagcagcttcttcagtcagtggagtggacggcctgtccggtctatttgtaggcgcctccggctctcctgccggaactttaaactcagaatctgtctgttctttgtctgatgtttttgattccgcagcttctcctgtctctgcagctgtactctctttgtcccctgaaatcttttcaactcctgtatcttctgtgccgtccagatcagaatcagatttctccggaacgtccgaaagatccgtgtagccgtcgagatccgaaggctggtagactgcctgatcgtggccatagccggtcacagtccagtctatagcaaagttctcatagatcagcgtattcatgtcggcaacatttgaattgacgaggatctggtggttctgatctacctcgacgtccataaaggccgcgagctcgccgaccgtgtagaaatctctggtctcaatgctgtcaccattttttatctcgtaagagccaggctcgagctcaccgtttacctcgacaaacttcgggcattttatcttggtcccattcacaataaacgagataaacgacttcgaatactcgtcgagactctcaatacgcataacgccttgatttccagcggtggaaccggtgatcgttactgtggcgttcggaataagtatcgtattaagcgatgcctcgtgtccattcatcatgacacgggccgactcgccctcggtgccgcggaccatcctctcctcgccatttacagtaaatctcgtctcttttccacgctttgggaaaagctcttcggtgtccatgccactctgcatggcggcatctacaatcttcagatgaccattgtcgaaaagcttcatgatctcaccgttgaagtggatcattataaagttgttcttctgctcgtaataattcaggcagatacctatcggagtaacatagagcgggtccttatgtattccatccgggaaggtgatattcttcatgacttcttcgccacggagagccacccgctcgtgaacgactccgagtttgtctgccagatgtgtcgtaaagccgtggacttttccgccaccaccgactacgaaagctgcagccacagtcctatctccatttaactcgatgatcttctctgcgacggcgtcggtgattttttccatgacagggtcagtgatcttccagacatccttggccgggattgtgtgctcgattcccatgatatcagaatatgtgaccttttcctttacagtcgagtccttctttatctgctcagccgtgtcaaaatccacgagataagcctgcacgaggacatccgtcagctcgtcgccggcgaacggtatcatgccgtaggccgtgatcgttccgtccctcgtaatgcagatatcggaggttccggcacctacatcgacaagtgcgatattaagcattctgtaatttctagggattgcgacggcaatagcggcaataggctcgagagtcatgttcatgactgaaagtccggctctctcgaccgcagaatagaggccgtctacaacgtcctcaggaaggaaagtcacgataataacttcctccacgcggcttgccttgtgcccttcgagatttgaaaagagctcgccgttaaggtaatacttcatcggcgaatagcctacacagtaaaatctgtacggtccgccgtccatatttatatcccgctgcgcctgatctactcccatcaggtctaaggtattaatatcttctcctgtgacaactctctcctcgtcgaaatccatctcgactctggtcgttacagtgcgaagcacacggccggcggctgcgatgcagacgtcgtgaagtctggttccgagctgttcgtcgaggtcgtcagtcacttctcttataatgtcagcaacttttccgatgtcgtgaatctgtccgtcgagcatcgcacggctcttgtgctctctgctcttcatcgcgacaacggtgaaactgccatcctctgtctggtatccgacggttccgacgacatttctggtgccgatatcgagactgtagaccagctcatcggcattatccggaagctctatagtgtcatcttccgcctcttttacctctataatgtgcttcctcctgtcttccgcaaggagtctgtccatctctttactcacagctgaaaaattgtcctccatacccctggtattgtcgatgacgacgtcacaggcattcctgaactcgtcgtccggaagctgcgaagccagtatctggtcgatcttctcatcggtatagccgcgtgagctcttaagtctcattctcctgactccgaccggagcatagatgtaccagagctcatcgcagacctgcttgtagccttcctcgatcagaagagcagcctctaagaaaaatacatcgacctccctgctcttccttgcatattcggcgcggcggatgatctcctcccgcactgcagggtgaacgatatcgtcgtatttcctgcgcttggcctcatctgtgaaaataagcttagcgagccttcccttgtcgataagcggcttacccggagccgatgccacctcgcggccccagatattttcattcttgaactgctccctgatgatgtcatagcaggcgtgacccggaaggatcagctgcttagcgagatcatccgagcgcaggacctctacgttgtaatttttttcaaggaaattcagaacctcgctcttaccggctccgacccctcctgtaattcctataaaatgcatgagttttctccgtgttttagctgtaaaaatggactgttttccacaacatctggtagtagtatatcacacttggagttttttgtaaccgtgaattcgctacaacagctctgcaaacagacgtaaaaacatctgccacagtcccatgatcccttttcggccgactttgtagtcgagcgtcacatcgctgcactcggactgtgtcttttcaaaatcgtgtttagcatctatcaccgcgtcgcagtagccgtagaaaataccattctcaaagtggtggtaaaagctccggtaatccagatttatagtgccgcagacggcgaccgtatcatctgagacgcagagctttccgtgcataaagccaggtgtccactcgtaaatcttaacacccttaaggcacagcgcatggtaaaacgaccttgtgatcgagtagacgagcttcttgtcaggaacacctggagttatgatcctgacatcgactccgcgcatggctgcgagcgagagtgcagtctttaattcatctgtgataataaggtagggcgtcataaaccagacgtaattttcagccctgtttatcatactgatatatacgtcctcgccaacctgcagattgtccattggagaatctgaaaatggaacgacaaagcctttcgccgatgtttcaggcacagcggtcatatacttgtcgtagatcttatccttttcgaagtgctttttcgtggcgttccagttctcaagaaaaatgaccgtcatcgagttcactgcgctgccgcagattcttatcccgcagtccttccaggctttgtaaggccgctcgatgttaaagtactcgtcggccagattgtaccctccggtataagctactctgccgtctactattgttatttttctgtggtccctgttatttaagaatctgttcaggccagggaagaacgggttaaacaccctgcactttatgccaaggccattcagctttttggaaaaggctgtgtttataaatccaatgcttccgaggtcgtcgtagaagactctgacctcgactccggccctgactttttctacgaggatttcctcgatgcggtgccacgaaattttatcgtcgattgcaaagtactccatgaagataaagtgctttgctctcctcaggtctttaagcatcgactccagagcatcatttgtatccgaaaagtaggtgacatcggtatccctgtacgctggaaaatctgcctgattcttcaaatagtaggctatgccgccggccccggaatccctgtccctgatgtcctgtgtaatatcgtcatttacgttcaaaagcggctcgagcttttcatcgatctccctgtagcgcttcttcatcgtaaacgtgtgggcattcagaccgaccagtagaaacatgatgatgccaaagatcggcaatgccagtatcaggatgatccagggggttttaaaagctgagttgtagcccgtgttgtagatgaaaaggacaagcagcaccgccagaactctggtagagagggaaatccactccgaataatcattcagccttgtgaagaggtttactatcagatagatctctgcaatgattgccgcaagtgcgacgatgaacctgaatattccgttttttctggcagcctttctctcaggtgccagcttagtgtgctgagtaccagtcattgccttcctccagatcaacttcgagcggcactttcagtgctgatgcgttttccatctcctcttttagaattttctttgcctcagcctcttcagacttcggtgcctctatcaaaagttcgtcgtgaacctggagcaggagcttcgacttcataccctctctcctcagcctctcaaagacgtgaagcatcgctatttttataatatcggccgcgcttccctgaatcggcgcattcatggcgactctctctccaaactgtcttctcatgtactgtgagtcattcagttccggcaccggccgtctcctgccgtacatcgtctcggcaaatccattcgcttttgcagatgctacaaggccatccaaaaatgagtggagccccggataggccttgaaatagtcgtttatatactgctgggcctgctttctcgaaatcgagagattctgcccgagcccgaacgaacttatgccgtaaacaattccaaaatttactgcctttgcggagcgcctctgaagcggcgtaacctgatccgcaggcacatggaatacgagcgcggccgtcgcagtgtgaatatccttatcagccctgtaagctttgataagattttcatcgcccgacatatgggcaagcaccctgagctcaatctgcgagtaatccgcatctataaaaagtgaatcaggatttggcagaaagacttttctgatctgctttccaagttcaagccttatgggaatattctgaaggttcgggtcagtgctcgaaagccttcctgtcgcagttactgtctgctggtaagtcgtgtggaccctgccgtcctccgaaacacagttaaaaagcccatcggcgtaagtgctcttaagcttcgcatattttctgtaggagagcacatcagcaactatcggatagtcttcagccagttcgtcgagtaccttctgagaagtcgagtaaccggtctttgtcttctttccctttggaagtccgagctttccaaagagtatctcaccgagctgctttggagagttgatattgaactcctccccggcctcctcgtagatcttcgactcgagagatctgatctgcacctcgagcatactgccgtactcctgcaggcggtcggcttccatataaatcccggtcttttccatgtcgtagagcacaaaaataagcggaagctcgagctcttcgtagagcttttcagtgccgctttccttaagctcctttgacagtctctcgtgtgaggcggccacctcagcggcatttttgcagactgtctcattcagcggatccgcaatatacccctcgatctttacatcgtcgaaatacctgtgaagcgcttttccgtagcttatatcagattccaccgactcatcccaggccttctgctcggtcgctataatgaaatcgtatagtgccttcgccgcgctgttctcctctgggatagtctgagtaaatgagagctgtccgctctcctcctcgtgtgtcccgttctttctgatttcaaacgggaagccacaggcttttccgagcgaatggagaaggtcctttaagtcatagaaaataatggtctttccatctttgatacgctgcttcgcttcgcttaagaattcagacagcaccttctcgtcttttttgtcaaagaatgcaactcccgatgtatcgactgaagaaagttctgctgaagctgcatcgcagcttaagtccttcccttcgagtccggcatctgcctcattcgggattttaaaatcaagagccgaagcctctttcaggaaatcatatcgcgcttttatctcagatgtcttctgctctatgaccttcccggctccgaaaaagtcgactgacagtggatcttttagaattttttcaagtggtccgtactgctcacagacactctgtgcagttgcggccccaagcgcacactcaagtgcgagctgatcagctcctacagcctcatttacttcagaaaggtggcttccgttttcatcgaactctatcagaagtacagtcgtatcagaagatgcgtagactaaaagatcggatcttacagtgagcaggacattgcccgaactctttgaagagagcagcgcaccgaccccgtgatagatatcgtcggtctctataaggcagagaccttttttagcgcactcctctgcgatactgtttacaagcccgtcttctgcactgtagaataaatagagctcgtctgcactgtattttgctgtggcagccgagagcaggtgaaaaaaggcgcctgtcttctcttctctttcgcttgtaccgcaaaaaggcagcccgtctgcggctgcctttgctatgctatttacatcagctataaatctgaccattatatagccctcgtggcctctttgagccatgctgcttcttccttcggaagacgcggagcgatagtctcatatacgtctgcgtggtaagcgtttaatgcctctctctcgtactgagtcagcatctccgggatgaccggctcaaggtcgatcgggcagtatgtcaggtccttgaatgaatagaactggccatactcggtcttctcgtcctctacgcagagcagctcgctctcgattcttataccgaactcgccctcaaaatagagtcccggctcatcggtcgtgaccattccaggaacgataggatagtttgccccggacctgtgaagattccatgcgaagacattcggtccctcgtgaacatttaaaatatgtccgacgccgtgacctgtgccgcagcggtagtcgagtccaaggtcccacatcggtccgcgggagaggatatcaaggttcgcaccgcaggctcccttcgggaacttcgccttcataagtctcagatggcttcttaaagtctcggtgtaggccttcttctccttctctgtaacaggtcctaaagcgatagttcttgtgatatctgtagtacctctgtaatatgtaccgcctgagtctacaagcagcattccctccggagcaagctccacctcgtgatcatgtcccggctcatagtgcatcagggcagcgtttgctttgtaggcgctgatagtgtcgaaacttacttcgatgaaatcatgggccatttttctgaactcgaggagcttgtcagcggcactcatctcggtgatcttttcttttccgacattgtgctttaaccagtaaataaatctcgtgacagctacaccgtcgtcgatatgtgcgtcctctgtgttctttatctcgacagagttctttatggccttcatctctgtcgtcggattgtaatccgtgcggatcagagtcactgagcttggaagctcatttacaagctctgagtttacgactgtcggatctataagaactgacttctcatttatcctgcgaaggtctgtgtagatcgaatcgtaaggcaggagccttatgccgttgtcatttaaatactcgtgagtctttacatcaaatgactgctcctgcgcatagaggaggcaggcatcctgtgtcagatagagatatgacatgaataccggaactgacggaatatcgtttccacggatatttaaaagccatgcaatgtcgtagagactcgtcagaaggtgtgcctctgcgcccttttccctcatgacttttctgacatcatctatcttctgctgaacgctctttcctgaatacttgtcctctaagatatatacaggctctgccggcatcggctttctctctttaaaaaatgcatcgagaaggttgatatctgtcctgatatccgcgttgtatgaatcgactactttgtcaatcttttcataccagctgtacgggaagagcctgccatcgaaggctaagacttttccatctgagaggtggctctcgataaactcatcggccgtcggaacaccctcggtgccgatctcatagagcctgacaccgcttccatccatctgctctctcgcctggatgaaatatctgccgtctgtccagaggccggcctcgtctccagttacgataagagtcgcattggttccggtgaaacctgaaatgtactctatctccttaaagaaatcaccaacgtactcagacatatgatagtctgcaagtgtcatcacatatatgtctacgccttccttttccatctcgaggcgcagtctctttagatttttcccagtcatttaatttcctttcatctgtcccatttgtcagagagcgaattgatctggtctgcaaatctggccagatccttgtttgccatgccctcgcacttctgaataactgacataagtctctgtccagctgcaacaaggcgggcaaatacattcgacgcaaccctgatctttccagacctggtcctgcgtactttttcatgacttccctcttcgaccatctctcccgtgataaggtcaaatgcatcgcccgaatatggagcgtatgccgcaaatcccgtgtgttccgtcacttccttcgcatatccgtctacaacgtcgtcatcgccatgtactacgaaaaccttctgtacaggcgcctcaaaactgcttatccactttaaaagctctgtgtggtccgcatgtccgctgatgccaggcaggttctcaatgcgggctgcaacctttacatcctcgccgaaaagccttacttccttcgcaccgttcagcaggttaaatcctaaagttcccgggacctgatagcctacgaagaccactgtagattccgctctccagaggttgtgctttaagtggtgtctgatacggccagcctcgcacatacctgaagctgaaataatgaccttcggctcaggatcgaagttaatagccttcgactcctcaggcgtaacagcgactttcagtccagggaatgaaacagggtttatcccgcggctgacaaggtccatagcttcctcgtcaaagcactctgagacattcattgaaaaaacatgagtggcctcaaccgcgagcggcgaatccatgactaccgggaaggtgttcttcacatgctttaagagtttctcttccttgatcctccttatcgtgtagagaatctcctgcgtcctgccgactgaaaacgcagggataactacatttccgccgagaacaagagtctcatcgatcacctgagccaacagcttcgcaaaatccctcttcgggccgtgttccctgttgccgtatgtggactctgtcagcacgtagtcagcctttttaagaaattccggattcttaataagcggcctgtccgggtttccaatatcgcctgagaagactacagtcttcgttacgccgttctcagtcaggtcgatagagatcgaagctgacccgagaagatgaccggcgtcatagaatgtcgccgtgatctcatccgagacatggatctcgtcgtgatacctgaccggcacgaaaagaggaagtaccccatacacatcctccatcgtatagatcggtgtgacctcttctcctccggacctcttggcctttctgttcttccactccgcttcagactcctgaatgtgagccgagtcacgaagcataatgtcgcagagatcacatgtcgcttcagtcgcaaagatctgtcctctgaatcccctctggtacagaagcggcagaaggcccgagtgatcgatatgtgcgtgggttacgaacacatagtcaatatccgccgcagctacaggcagatcctgattcacatacagatccggcccctgctgcataccgcagtcaactaaaaacttcttatccccgacctcaacatagtgacagctccccgtcacctcatggtcggcccctataaacttgatcttcataatataccccttcctgtaaaaaaagccgcagcttggccgcggctaaaaatcactgtttatttttgagaaaatcaggaatctgtatatcccgctcctgaacgctgctcttcggaggctcaggtcttctcatacccgtaaagccgccggaagtctgagtctgtgaagtgctgtgagatggtgtaacaggactgtcgttcttgatgcgattgagcatctcctccatctccttggaactctgctgtgcggcacgagcctgggcctgtgctgccggagacggatgtgatacaggaggtgtaggtggagtgtacggagggaacttcattcttccgttctcatccttctgtggtccagcagggttgttcttcttctggtcctcagcaagtcctgtagcgataaccgtgactctgatctcgtctgtcatctcttcatcagtcagctcacccatgataacgttggcctggtcgccgaccttctcgacaatgtattcctgaatgtcgttgacatcgtagagggtgatgtctccggagatagatacgagcacatccgaagcgcctgcaatatctgtctcgagaagtggagaagaaacagcctgctgtacagcctgcttcgccttgtcgtctccctgtccttcaccgataccgatatgtgcgagccccttgtcctccatgacgttcctgacgtctctgaagtcgaggttgatatccataggtgtgtagatgatggaagtaatgcctcttacagcctgctgcagaacctcatctgcaaccttcatagcatctctgaaagatgtccgtctgtctacaataccaagaagcttgtcgttcggaatcacgataagtgtatctacattatccctgagcttctcaataccgccgatagcgttctccattctgacacgtgcctcgaaagtgaaaggcttcgttacgatagcaacggtaagaatgcccatctccttcgcgatctttgcaataacaggggaagcaccggttcctgttccgccgcccataccgcaggtgacgaagaccatatcgtagcccttgacagccgaagtgatatcctctgcactctcctctgcggccttctggccctcttcaggcttacctccggccccgagtcctttggtcagtttctcgccgatctggagatgattcggagctttgcatcgctgcagaacctgcatatctgtatttaccccgaggaaatccactccgttaattccgacttcgaccattctgtttatggcattattaccgcctccgccgactccgatgacaagaatctttgcgccttcctgctgtgtcggtgcatccacatatattcttggaccggatgcgtcgtttgtactgctcaccacttcgttcaagggtagttcctccttcttatttccaatacgagaatttcgtaaatgtcaaatttatacacttatatataataagatttttcagcaggtttcgcaaccctttttatctaaaaaatcatttggttttctttttttcaaatacaatatctgtattatcctctgtaaaatcctcaaaatgtagtattccagcgctccctttgactttcggaagtatgtatgacaggcgcaggagcttgtctttgagtctgtccgccgtgccaaatgaagccgtgacctttccgcaggtaagtgtgatctggccgctgtctccgaatgtcactttgctgatatcaaggcccatatttttcatcgacttaaatataacggacagtgccttgactctgttctcggccgccggataggcttttccgacgactgctgacttttttgtcgtaagcccctctaccgggaccgctttgccgagaagcctcggatcgacttcagttactatcccgttcctgtcaatatagacatagtttccgtttttgtccttaagccgtcccgtaagctctttttccttaactgtgatcaccaggtcgtgcagattgtgaagactcaccttcgtttcctttacgaacggaatctccggagggcgcagcgtgttctttacaacatcccaggcgccgttgtttctgtacttgtccgccatcacatagccttcgatctcactcgcgccaagcagggtgtttccccttaccgtgacattgtttacattgcaggcaaaaatcagaaaaaccgcagttcccaggatgataaggataataagtataattatgtttatcttataaaatttcgccggtgaatagcgatgtccatctctttccatcacgcctcctcatcgagcgaaagattttcgagtgatatctgccgcgacacggacaggactatgcctatctccatcagtatcccgatcatagaactgcctccgtaactgatgaacggaagagtgacgcctgtatttggaatagtcttcgtaactacgagcatatttaataccatctgcagtgaaaggtgcacaaacacccctatcaccaggaacgatccgaacatatccttcgcatttactgctatcaggtagattctccagagaagcacgacatacataagtatcaggcagatcgccccgaatgtcccgagctcctctactatgaccgaaaagatcatatcgttctgtgactcaggaaggttgccaagcttcgtatccgatgcgccgagcccctttccaaaaaagccgccggatcctattgcatagagtccctgaaggacctggaatcctttgccggatgtcgcctgctcagggtgcagccagtactttatacggtcacttctatagccctctccaaaaacagttgccacgatgaccgctgtcattcctatccctgccactaccgccagtcgtgccttccttttgcttgctataaaaagcatgataaagccgatgcctgcaatgattatggctgtgcttaaattcgatgagagaaccggcacgatagagaatgcaataagaatcagacattttaaatcaaatttaaaactgccgaaatggttcctgttatgcgtgattacagcagccatagatatgataagggctatcttcataagctcagacggctgaaaggaaaagaacccgattcttatccatctcgtggaaccgttactcgaccttccgacaaaaagcacggcaatatttaaaagaaaagtcagggcatagatcacgtttgcaccagctttgtaaatattatacggaataaatgcgatacctgcacaaagcaccgctccgatcaggacaaataccgcctgcctcttcagataaaaagccggatctccaagtcttgtagacgccgtgaaagcactcgaggaatagagcatcatcaggccgaacaaaaccagcagcacaactacgccaagcagaatatagtcaaaatacttcgcatggctgtaatctttaaattttgctatttttgcgcctgttctacgactcattccttacatcttccttacgtgctctttgaactcgtctcccctgatctcatagttcgggaacatatcccagctggcacatgcaggtgaaagcagtacacagtcaccgctcgatgcctctgctgcacacttgtctacagcctcctgcagagtgtcggcaaattcataatctttaaatccgtgtttatcgcagcaggctgcgattttgtcctttgtgacccctataagcacgagttttttaactctgcccgggaatgtctcgacccactcatcgtaggtgcttcccttgtcgaagccgcctccgataagaagagtaggtgcaggcattgaaaggaccgcctttatagcggcatccgggttcgtgccctttgaatcgtcgtaatactttacgccgttcttctcgcagacgaactcgattctgtgctcaacagccttaaaagaggtaaggctctttcttatagaatccatcgggacgtcgagagagagcgagagggccacagctgcacacacattctcgtaattgtgcgcgccgattatctgaaggtcactgacatcgatgaccttctcctccaagccatctctgtctataaaaatggcctttctgctctcatcgtagtagagaccgttctccacttttcttttacttgaaaaatatactacatgagtctttaatgtctttccgaactcccttaatacgtcatcctcgtagtttaaaacagtgacgtctgaaggagtctgattctttacgatcgactccttggctgcgatgtagttttccatcgtgtggtgacggttcagatggtccggagtgatatttaagattgctgcggcgtgaggatggaaagtatcgattgtctcgagctggaacgatgagacctcgatcgcgatcctcgtgtcgtcttttgtagtagcggcctcgtctgtaaacgggataccgatatttcctacaacccttacatcgtcatagtaatcctttaaaatatgtccggtcagagccgtcgttgtggtctttccgtttgttccggtgatagctgcaattgtcccatgtgaaaatgagtaagcgagctccacctcacccgagagatggatcccgcgattcttcagatcttctacaaacgggatatcgagcggcacaccagggcttaataccgcctcttttatgtcctcatactgctccttcggcagttcttccgtgtaaaacggcagacctttaagctgtggatttttctttagaaaatcgtccgcatccatatcagagctgttaaacagtacaacatcttttccctctgcaagaagcagcttggctgctgctactccgctctttccgagaccaactacaagatacttgtctttcatttttttcctttccatatgatcataagataaggccgagcagcgcaacagcgcagcagcccaccgtaaccagcgtaaatgcgataactatctgcttctcagagtatccgctcttttcaaaatgatggtgaataggtgccatcttgaacaggcgctttttcccgtgagtcagcttgaagactccgacctgaaggattacggatacgacctcgatcagataaataaacccagcgatgaggataaagatcggcatatggagaaggtatgcggctcctgccacaaaccctccgagtgcaagggaacctgtgtctcccatgaagacctttgccggatagtgattgtaaaccagaaatccgcagagggcacccgccatggcagcgcagaccggttcgatatctccgtcgagcagaagtgatgcgatcatgaaaaatacagcgaccactatcgtaacagatgaggcgagtccatcgagtccgtctgtaaagttcgtcccgtttactgtgccaagcactgcgaaatacaatatgactatcgcgagccattccggaatatttacaagattctgcgatgtgaaagggatcatgatcgcaaggtctacatcggtaaattttataagccacactgcaaaaattgtagtaactataatctgcaaaagcatcttctgccacggaaaaagtccgtctgtcctgtgaagtgcgactttaagaaagtcatctaaaaaacctatgattccgaatcctatagcaaggactaaaattggtagcaccttcggatactttgcagctccgatcaaagttcccaccagaagtcctgcaaggatcataatgccgcccatagtaggcgtcccgttcttcgcgacatgggtctttaaataatccctctcggtctggctcgcgtggagctttttaagccacgggataacgaccggcccgagtaatactgaaacagcgaaagctgcaataagtggtacgactatctgtaacatgttttctcctttgtagagatacgctctcattttttactgtttttcttcttcgaagtcttctctatattatagtacggaagaagggtcttgaaaatatcgtgagctatctcctgagcgaatttggaatgtgcctggtctggtgcgttcggctcatcgactacaacgtagacaaggagcttcggactttcgaccggcgcaaaccctataaatgataccagataattgccctgttttctaggctgtttctcagctgttcctgtttttcctccgatggaataacctttgacctgggcagtgacaccggtacctccggtaactaccgacttcagatagcttctgatctgatctgaagtttcctttgagatagtctttttaagaagctccggatcattctttgaaactgtgtttccggaatcatcttcgacctttgtcacgactgtcggcttgtaatagtttcccccgtttataagtgagcagtaaccgctcgcgatctgtatcatcgtgacattgaagttctgtccgaatgcgttggtcgcaaggtttactggagttctctgcagctccttttcagagtaaagaagggtgttcgtccttggctctcccggaaggtctacaccggtcttctgtccgaagccgaacaggtgctggtagaattcaaaattcttcgctccgagcctaagtccgatctgcatcagggaatcattgcacgaatccatcagtgcttttctgactgtctcaattccgtgatgggactcacactttacatagacgttgtccgcaaacttcatgccgccgtcgcacaaaaatgtatccgaatccttaagacgtcctgtctcaagtcctgctgccactgtaaaaggcttgaacgtagaacccggctcaaaggtatggcttacagggaagttctgccacagcccgtttaaggcgtcgagctgatcttttgatgacatgccgctcagttcctgcttcgtatacagactagagagcttcctcggtttattcagtgaaaatgacggataagtcgccatcgcatagatctggccgttattcgggttcattacgagaactgcggtgttctttgaacctctcttgtgatttccggcagccttctccattctcttgttaaatttggtgacagcgttatttacagtctgctgagtaaaaacgtcgagagatgtctggatcgtgttgccgtttacaggctcgatgacactgttttcgacggagttatcctcgttctgatatccaaaggagcggccgtcggtgccgtttaatacagaattgtactgattctcaagtcccgtgactccggtgtttcccgatgcgacaaagcctataagctgcgaagcgaggtttggataagggtactgtctcttgtactctttttcaaaccagatgccggcgactgccttcttccccttttttgaagatgaaaaatcagagaaagccttcattctctcgtagctttctcttttctttaagactgtatactgactcttcggatgtttttcaacggcatctgtcaccgcactctctttaatatctggaaaatactggtgtacgtactttgcagtgctttcgatgatcccttttttattctttttttcttcttttaaggccttgcagtccaagacaacgttgtagacatcaatagaagttgcaagagtcgttcccttgctgtctactatatccccccgcttatagggaataaccctgttctgataggacatctggcttaaaacctgctttgcgtatttgggtccgtcctttgcctggattgaaattacccgccccagtataacgcaaaaaagggccagacacgcaaagaatacaagcgtaagagtggcctgcattctcttgtatatcctgttccctcttctgtgatttctatgatatttttgattaacgctcataaaactctatttattatccacggtcatgtaatcctgttcgtccatagtataatacactatctgtccagactttgcatacttcattccaagctctttcgtagctttcttcttgacattggaaaggttggcgtctgtgttgatctttgagagcagtgctgaattctcggcctttatatcagatatctgctgctcacaggatgaaatatttctgatcgaagatgttatgccgttctcaagaaatacaaaagccccgaacattacaaaaagaagagcgcctgcgacaagggaaattctgaaacgtctcctcttgattctgaggagtttggcattttttctggcgcgggccctgcgcttgcgttttaattcctccctctctcttctaagcctctcctcgtgctctctctccgttacaaatgcatgtgcctctgaaccctgttcaaaaatatatgtctgcttcatttaactctcctcctgactggctgggaattctgtgatgtcgctcttacaaagaccctaagctttgcgctcttcgatctcttattttctgttaactctttttcactcggaagtatcggcttttttttaagctgatacccctttgaaatattcccgcagacgcataccggaaagtccggcggacacgtacacgggtactctttctttttaaaatggctctttactatcctgtcctcaagtgagtggaaggttataatcgcaagtcttccgtcctcttcgagcaggtctatcatcgtatcaatcgtgtcggtaaggactgtaagctccctgttaagctcgatccttatcgcctgaaacgtcctcttcgacgggtttccgccggtccttctgaacttctccgggatcgactccctgataatacggttcaggtcgcccgtagtctctaacggtctctcttttacgatattttttgcaatgcggtcggcaaatttttcctcaccgtaatctcttattatcctcgtcagatccttctcagaataggtgtttaaaagctctttcgccgtaaaatccgaatcccggtccattctcatatcaagcggggcgtcgtcggtcttataggaaaaacctctctccgccgtatcgagctgatacgatgaaaccccgagatcaaggaggattccgtccactttttcaatgcccatagatgagaggatctctcctatatgctcgtagttgtcatgaactatagtaactctgtcactgaaaggtgaaagccgctcgcccgccgccgctatcgcgtcggtatcctgatctattccaataagtcttccgccttctgtgaggcgctttgctatctcaaatgaatgtccggcgccgccaagtgtgccgtccacatatattccgtccggctttatatcgagagaatctatgacctcttcaagcatcaccggataatgtttgaattctgtcataatgtaagccccagatccgcaagattgtcagccacctgatccatattgtcaaacgagctggcctcatcccacttttccttgtcccagatctctatgtgagtcaggtttcctgccaggacaacgtcttttttcagtcctgcatactcgcggagatttgccggtataagtatcctgccctgcttgtcgatatcgcagctcgaagcagacgcaaagaaaaatctcgaaaattttctggcctctttactggcctttatagactgtttgaaattttctcctacttcctcccaggtatcataagagtagccgtagagacagccgtcaagtccttttgtgatcacgaactgggcaccaaggttttcacgaaatttagccgggattatcaccctgcccttcggatctatagtgtgattatactcacccatgaacataacggctgtcacctccttcccggctcaccacttttgtggcactttccaccacttcttaccactttgttacaattttatacattatcgagacatttttcaatgaaatggctgttcgatttcccttgtaaaacaaggagtggggcgttgtgggggcattttttcaagccggaagttacaatatattgtggcagcaaaaaaagcacctaccagatattacggtagatgctttactttgtgcaaatgttacaaaaattacgttcggaacaggtgttgcgaacagactgtcgaatcagtatttatagaccactttcgtaagcgtatccttagctgtggcttgatctgtaaaatactctataatcgcgcctgcgaatgagagcgccgtgccgagtcctcggctcgttattacatttccatcgcgaacgaccggatccgtcttcttcagggcacctgtcaggccatcctccattcccggatagcaggtggcattcctgcctttcaagatacccgcataacctaagacagtcggggctgcacagatggcagcgacgagttttttctcggcgttgtacttctttatcagtgagatgaccttcggattttccttcagattagtggtcccaggcattccgccagggaggataaccccgtcgtatgcgtccggatccaggtcactcagaactctgtcgcagataaatgtgatatttctcgcactcgtaacctgccttgaatcactgacagacaccatgtcgatatctattttcgccctgcggagcatatccacctgaatcagagcctcacactcttcgcaaccgtccgctataagaatcgctacttttgacataataccatcctttctctataatgaagctgacaaacacagcttaggagctcaacatggaaatagaacgcaaatttttaatcgataagggcaggctgcccgaaaactacaaaacttacccatccaagtctttaaaacagggatacgtactgcatcgtccctgccttcgtataagaaaagagcagtcaggtgacagcgatcccagatacattatgacctacaaggacaacggcgggctcgcaaggcaggagataaatatcgaagttcctgcggatgccggtgaaaagctctttactaagtgtgatgggcacatcatcgaaaagacgcgctacctgatcccggccggagtgaaggacacctcttcaggaagggatctgactatagagctcgatgtcttcgaaggagagtttctgggacttgtctatgccgaagtggaattcgactcaaaggattctgccagaagctacaccccgccggagtggtttggaaaagacgtaacggagatcaggggcttttcgaactccgacctctctttaaacggtcttcccggcatcacagataaagcttaatctctaagccttgtgccctcgaagtgttttctggtcccaacgcactttaacagctcttttatcctgccgtccagcggcccgtcgtctattactatatcaatggacgctgccatattgtctataaaagtatcgtttaactcgtcattctgggccatgtgctctattatcatatatttctcatcgaaatcatctgtgtcgaggaatgcgagcatatcccttacggcaggagtcttttctgtgtcttcgtcactgtcatttaccgtagttatcgtggcaggtgacgggcggacgacgacctctggtgaagaagcgggctttatgaccgtaggcttttttacagtctcgatcggcttgtttatagcggtcctcttctccggaaccatcgtattattatcggaagcagctgtcctgctatcctcttcactctccaccctggtaaatatcctctcgaacttatccttagggatcgagatatttacatatccgccgtagagctgctgaacaacgatctcctcggactcagtcgtaaacgagatcgctgtggcgataacctggtacgggttgccgtttttatccttatatttatcaaatggtctgatactcatataaatccttctatctatgattcctgcatgaaatttgacatataaatgtgctgtgcgatgcgcctcgttccgaagtctacgacaatggtgccgtagctggtctgggatgccagacgcgtggacagcagtatattatttaaaatatcggcatatccctgcgggtgccccgccgcaccgtctcccgcagtcgagagatagttcagcgcgaaggtgtggtcatcggccgcaacgtttcgcagcatgtcgaggaacgcatccctcttctgccctacattgaacctgtacctgtcctgaacccagagcttatccatgccatttaaggaatacatcacatacggaagatcgacgcttatcttagagccctggtcgttccagttgaaattgagcccggcgctgccatagtccagggcatctgaaaatcttcggatcagtacgatcctgcccctgactttcgaaagcttcggtatagaatcgtaaatataccagttgtctctgtgctgattgatctccttaaaaagcagactctcgaactccctggcgttgtcgctcttgttctcatcctttacggcaaacagcaccgtctcggacggatgcgctttcaaaaacgcatagatctgatctacgatctcttcaaatcttagctgctttgaaaaaatgctgcccgacctgcggcactttccaaaattgtgcacgaagcccaggaaatctccgttctttccggactcgacttcgagtctgatatcaagatacctgaagccattcgtcagctggtcggctatcgacatactctgtgtctgtaaaaaatatcccgggaaaatatgctctgcggcgctgtcgtgagtgcccggaatagaaatagatgaaatcggcgtgtcgtcgtctatctcctgcatccactccgtagtcggtttgtattgcttcgagtcggtcacagcatcttcgatctgtccgctgcccgaatttgcaaagcagacaataagcattacaaaaacaaccagagccgagatcagtctgtccctgttttctctgaaaaacctttgcatacatgtctcttttcgtatatcatttagttgcgctatttattttaccacaaacgccccggagtaaaaaggggcagtctgtttttcttatggaggaaatatggttcaaagaaaagacctgctgcacctgagtttctacgaaaaaagcccgtatctcggaagtgacgggccattgaggtatcgcattgaaaagtctgaagagggggaggatgacgcgaaaaagaaagtcatgaaagtgaccatctggccagggccgttctctttcgacaagacccctgaagaaaaaatgtcctctgtgaactttgaattcaaagaggaggcacttgacgaaatcgcaaaatggatttccgaaaaatcatctgagatgaaagaatcctgatccaattaaatgatacgcacccagagatccggcttggtcttcctgaagccaagctttttcacaagtccttttgatgagatatttttcggatcgatctctgcgaaaaagtggctgtggcctttttgtatcgcaagagacatcactgcagatgtcgtctcaaatccaaggcccgtatgccacagacccggatcaatgacatagccgagctcaagccacggatcttctgtccgcgacagctcaagtgtcgggtcagtcgtataaaaaagctctgccggcgggtccatgtactcgagtccgcaccttcctattagctttcccgtgctttttaaaaagacattccacatgccaaaatcatacaggtcatagatattgtcgaagtactctctctggtagactgtctcctgcgcgagcgggtagaggttttcgatataatccgtcacatggggcttcgagtagagcttagtcatcggcaggacatctctttcaggatcgcactgccttattatcgtgcgctctgtctctaagatcaccctcggcaccctgtaaaaggcgtcgtgcacttttttaatgaattcatcatcgagcgccgaaagcgagtctatgatgtatctcccggagagcttttcatttctctcatagcagatcaccgccacttgctttttcttaagttcttcggcatcctctgccgaatcacagactgcgacatcgtgtgcgatatcgggcgagagcgcattgtttttaaggaaagcctcgtcctctgccgttttattttttagaaaaaatctgacctgtcccattcattcctttctcttgattttgtcaacatctttattataattagaagcaaaccgaaagacaagaggcacaatatggcactttacgcattgggcgaccttcacctttccttttcgaatccggaaaagtcgcaggagcgctttggaaaaatctggaaagatcacgagtggaaggctaagaaaaatatagaaaaacttgtaaaaccagacgacacgctggtgcttaccggcgaccactcatggggaaacaacctcgtgcagtctcagcgcgatctggaatttatcgcagcgtttccaggcaggaagatcctgctgcgcggaaaccacgaccacttctggaaggctaatcagactaaaaagcttaacgatatcttcaaagggaggctttatttccttcagaataatttttacacttacaaagactatgccctggttggcaccaagggattctgtttcgagggacctttctatgtcgataccaggacaaatatgatcacaggctatgacagagacgcctttgagcactcgaaggagctcatagagcgcgagaggagccggcttgtgacaggaatcaatgccgcaaaggaagccggcttcaagaaatttatcatctttctccactatccgcctacttcgatcttagagaccgactcgacctttacccgtatcgccgaggagctcggggtcgagcaggtcatctactcgcacagccacggcagagagcgttttcacgacagcatccatggaatgcatcacggtgtgaagtactctctcgtatccggcgactatctgaattttaaaccgataaaagtattgaaataaaaaagagcccgctgcagaaactgcagcggacctttttgtctgtcagagagtcttgaatctctcgattgccttctttgtattctcgtgagtgccgaaagctgtcagtctgaagtagccttctcctgaaggaccgaaaccgcttcccggtgtacctacgacatttatcttctcaagcaggtagtcgaagaattcccagcttgacatattgtcaggtgtcttcatccagatgtaaggagcatccttgccgccgaagcaggtaaagccagcggatgaaagtccctcgcggataatacgtgcgttctccatatagtagccgacgagctcatctatctccttctggccttcctctgagaagatagcctcaccagctcgctgtacgatgtaaggcgctccgttgaactttgttccgtgacggcgggcccacatgtcgtgaagagaagcgtctcccgacttcaggctcttcggaactacagtgtatccgagacgaagtccggtaaatccggctgtcttcgagaacgatctgatctctatgcagcagttctttgctccctcgcactcgtagatcgagtgaggaacgtctggtgatgaaatgtagtgctcataggctgcatcgaaaataatgatagagcccttctgatttgcgtagtcaacccacttctggagctctgctttcttaagagtagttcctgtcgggttattcggaaggcagaggtagatgatatcaggtgtcttctcaggaagctccggcacaaatccgttctcggcggtagaaggcatataaaccaccctgtcccacataccggtattcggatcgtagtttccgcagcgtccggccattacatttgaatctacatatacagggtagacaggatccgtcacagcgatcacattgtcctctgagaaaagttcctggatatttcctgaatcgctcttcgcgccgtcagatacgaaaatctcatcagatgcgatgtcgcatcctctgtccttgaaatcgtgctttgcgatggcgtctctaaggaactgatagccgagatccggtgaatagcccttgaatgtcttcgcatcagcctgctcatcgacagccttgtgaagggcatcgataacgacctttggaagaggctgggttacgtctccgattccgagcctgatgatctccttgtcaggattcttttcctgaaaagctgctaccttcttcgcaatagtcgaaaacaagtagcttcccggtaacttcagataattcgtgttaacctgatacatctgtttctccttatctatttgaaaaaaatttacctggtccatatatgtttagaaaaaatcatttacccggttcgtagatcttcacatcgtccttctcaaacgaatccggaatatctatatgtcctgtaaatacagtagtcgcaggtcccttgagccagactgtatcattggccctgtcgtatctgactgtcaggtcacctccaagaaggtgcatcgtgacttcctcgtcagtcagtccatttacaactgctgctacagtcgtagcacaggcgcctgttccgcaggcaagcgtctcaccgctgcctctctcccagactctcatccggatattcttcctgtcgaggatattcgcgaattcggtattcgtcctcttcgggaaggtcgaatgattctcgaaaataggtccgatatgtggcagatcgagtgtcctgttgtcctcatctgtaaaaatgacgcagtgcggatttcccatcgaaacacaggtcacacggtaaatattaccatcgacctccataggttcgtttatcatcttctctttcgggaatgtgaccggaacatgcgatgcgataaggtctggagagcccatatttacaaggacttcagcaacctttccctcctttacggtaagctctaaggtctttactccggcaagagtctcaacagtgatagtcgtcttatccgtaagtccattgtcatatacgaacttcgctacgcatcggataccgtttccgcacatctcacctttcgagccgtcggcgttgtacatatccatcagaaaatcggccacgtcggacttttttataaggatcagtccgtccgaaccgatgccaaaatgcctgtcgctgacgaatctggcgatagaagaaccatcctctataacatccttcgtgcagtcgacatagacatagtcattaccgcagccatgcattttcgtaaaatctatcgatgtcataaaaatcctccttagcccttttctattatacttaaaatctgctccagttcaagtgtgccgccaaaaatatcgagcgcgctcccgatcgtcacatctatcctgccatccgtgagtttttttatctcacgcaggtcgtcgtagcttccgactcctcctgcgtaagtcaccggcagtccgtcgtaatctgcgagcacactaagaagctgctcatcggcgccggccttctttccctcgacatcggcagcgtgtatcaggtactcgtcgcagctgtcctctaagtatctgagcaggtccaaagaaagcttctggtccgtaaatttctgccagcggtcggttacgacgtagtaatcgccgtccctctttttgcacgagaggtctaagacgatatgctctcttccggccgatctcacaagccttctcagacggtccatctggatctgtccatccgaaaatataaagcttgtaaaaatgccgtgactcgcgcccgcatccagaaattctcctacattttcgtcatttaatccgccgccaaccataagcccgcccggataggcttcaagagcgagcatggcctgtctcttcgaggcctcatactcgtcggtcccgcgggcattaagcattatgacgtgcccacccggcaggtccttttcccgatacatcgaagcaaaatatcctgcatcgtgagccgagacaaagttttcctttgcgctgtcactcctgtcatcgaggcttgagcctacaatctgcttaacctgtccatcgtggatatcgatacacggtctgaatctcataataaagtacctctggcttttttaatgtaaatggcagtcgaagccctttgccattttaaaaatacccccggcagatttacctgccgggggtattttagcatacatctgatcgttaatcaatcagctattttttagtccatagcgttctcattttcaagatgctatgcatccgagatcagtcgtcatcctttgagatgccatccattctgtaaaggaactgaactgatccctgcttgccatcggcaagacctgagaagctctggtagtcctcgccggcatctagtgctgcacgaagctgatttgcaagaggtttgatgtctccgttgtaagagtttacaagtttttcaatgccttccttgtcgagctttacgattccgtcatgaagcttatctgcaccgcttgtgagcttttcggctccgtcagcgagagtgttcgtgccatcatagagtgttgaaagtccactcgtcagagtattctgtccgttgaacagtgttccggctccgctgtagagtctgctgacaccgcttgaaatctgacctgcaccacttgaaagcttcgaagctcctccggtgagcttactgttatttgccacaagagtattgccgcccttgtaaagctgatcaacaccatcgataagagtctctgccgctgtcggaagtgatgagtacttctttacatcgagcttgctgatgccggaattgttaagcgaggtgtaaagctcattgattccatcggacagctgcttgtgtccattggcaagctgcttaactccagcattggcctgggtcatgccgtcgctctcggtctttgatcctgtagcgagtgtgcttgaaccgtcggcaagctgcttagctccatctgccagtgtctttgaaccatcggccagtgactttgatccagttgcgagattcttagatccatcagccagtgacttcgatccagttgcaagctgctttgatccggctgcaagctgctgtgatccttcagaaacctgcttagctccatttgccacctgcgcagatccatctttaagttccttcagctgtttctgagttgtttcatttgtcagcatgtcctgaagtgactgttcggctgtattgagtgcatcacgtgctgattgtacacgatgcagaacatcaagagctgtatagtaagtagctgttgctgttactgtatcgttgctatttgcctttgccagagcatctattacttgagtctgattttctgtaagttttgtaacgacaccgtcaatatttgcaagcgtgatcttatcgtctgttaaaatttttgtactttttagaagagatataagactttgatttgtgttcaagcttttgtctattgtctctgtcagctgttcctgcgatattgtgccaaactgcgtaccaagccctgaaagctgagtctcaagctgaccgattccggcatctacctttgcagcaccatcagatactgatttggctccacctgccagctttgaagctgaatctgaaagtgtcgaagctccatttgatacatttgcagcaccattcgatacatccgatgctccactcgatacacttgaggcgccagtcgatgccttcgtggcaccatcagataaacttgaagcgccagaagatacagatgaagctccgtcagataccgactttgcgccagctgtcagctgatccatgctctttacaagtccaggattctttgcggtgccatcgccgttatatcctgcgaggagctggtcagaaccactcttcaactgacttacaccagttgaaagtgcagtaagctggtttgccaggtcgttaaagtttatcttctttaaagctggaagctggctcctgagtggagagagtccggatctaagtgttccaatgccgccgttcagctttgaaactcccgctgtgtactggtttaagccactggaaagagatgaggcaccgctcttgaatgttcccatgtttgaattcagggtgccgaggccgtccttcagctgtttagtgcctgaagcgagtttgctgctgccgtctttggcactctttgcgccacctgcaagcttctttgcgccgtcatttaactggctggtgccgtctgcgagctgctctgagccatcctttaactgatctcctgcatctgagagcttatcaatatcatttgagattgtattagatgacttggagcttgatgtaatagtatttgaggcatctacaatggctgtcatctgagtctcaaggtcgaaattctttacatctgcctcgatatcgagtgagtcaggaagctcgacgtccttgtcaaatttgcctccggctttctcgagtgaatccttaagtccaggaagcgcgtagccgatcactactgactttgtgccattctgaactacacggccgtttgtgaccttaatattcgtgaaatcatcgtttaagaccattccggtgatggcagcgaacggaactactgtcgttacactctcaccatttacattttcagtgtaggtcgaattgttcgtgtactcgtagtgaatctttacatgaccgctctttcctgcaaggtcttttggctttacctctttgtcatcgagagtataggtgacttttacagaaaccggggcttcctttgtcgtatggccctgatagtaaatatccttaccatttgcctgccaggttacttctgtgccgttctgggtaaatttctcattgccgtttgtgttcttgatgttcttaaggtcagcgacatcttcgatcttatccgcaccatccttatttacaaggtgagaagctacgatcgtatctgaaacagttccgtctgcctttgagatcaggtaaactgtctcgtccttgtcaatatccttgttcgatacctttacatcgtcagtgcttattatgtcgtttgtggtctgctctgtcgtggctgccttatcagctaaagcagtgtactgaactgaacttgtacttacaagtccaactacaagggcacctgctactaccctgatgatgtatttctttcggaaaatttttttaagctctggtaacttcatttatttttcctccaatcatgcctttgcggtgtttgtgtttgtttgcgtgactgcgtttttatttatgaaacctgcactcgtatgaatgatgaccttatcaaagatcatgaacatcgatgggagcaggaagataactactgccatactgataagagctcctcttgccataaggttgcacatagaagagataatatcaatatctgagtatactgcaactccgaaggtagtgccgaagaatgtcagcgccgatgcaatgatcgaagtcatagacccgccgagggcatctgttatcgcagcatgcttttcaaggccgttgtaacggtttaccttgtaacggttcgtcataagtatagcataatcgactgtagaaccaagctgaatggttccgattacgatgcttgcgatgaacggaagcgtcgttccagtatagtaaggaattcccatatttatgaagatagcgaactcgattactgcgacaaggatgataggtatcgagatcgacctgaactcgattaagatgatcaggaatacgatgattatagatacactgtttaccctgttgaaatcagtgttcgtgatctccataaggtctttcgtacaaggagcctcgccgataagcattgccgacttgtcatagttctttatgatcttctcgatctgattgcactgcttgttgatggcatttgaagctgttgcgtagtttgatgtaactaccataagctgcttgtcaccttttttgagtttagttctgatactgtccggaatagcgcttgaagggaccataggtcctgtcagtgaatccatcgaaacagccatcttgataccatcgagcttcttgatatcgtttatcatctgctcagatttctgggaatcgagcttgctgtcggcgataatgatcgaagtggcgcccatcttgaactctttgttcattttttcattggccttcttactcttcatagagtcaggaagcttgctcgccagatcgtaataaaccttcgtgtgagcctgtccatagaaggccgggaagataagaagcagaaatattacgaaaaatacgtagcagtgttttacgatccactttgaagtacgtccgagatccggcatgatgaccttatggttcgtccttcttacgatcgggtcaaataccaggataagtgatggaaggatcgtaacacaggaaataagtccgaagagtacgccctttgccattacaacgccgagatctaagccgattctgaagctcatgaagcacagtgcaatgaatcctgcgatggtcgtcgtagaagatcctgctatagaaccaaaggtctttgcaacagcgtgcgccatagcattcttattatcgtcgaacacggtcttctgctcttcgtagctgtgccagaggaatatcgagtagtccatagtgacaccgagctgaagtactgctgccagcgcctgcgtcagatatgagatctgtccctgcaggaagttcgttccgaggttgtacacaactgccattccaattgaaacaaggaagaggattggcacaaatgctgaatcgagagtcagcatcaaaacgatagtacacaggatcactgccagaaggacatagaatggaacctctttcttcgaaaggttcttcgtgtcattcgtgactgaagccattccagctacaaaacactgcttcgaaagtttcttgtccatcgcgttcagagcgttcatcgtacctgtttccgatgttccctgatcgtacaatacaaacatcaggtcagaattactcttagcgttgtggatgaacttgtaaacttttgtaggaagtgcttccttagggatgttcatatcaccgaacgatccataccaaagtaccttttttacgtgaggaattttggaaatggtgtcagctgtttttttcagctgtttgttatccattccttctataacgaccgtcgagtaggctcctgtcccgaatttgtcaagaaggatgtcctgtcccttcatcgtgtcgatattttccggaagataagagaggatatcgtaatttaccttggtgtgcacatacccgataattgctgggataagaagcagcacacttgcgataaggattaagaatctacccttaactaccgcctttccgaatttaagcattgaaaagatcactccgtttctatcagccaaagaggccgagtgctaaatttttttctatccagttctaattataaaagtttaatctctgattgaaatattcaatcggggatttaatgtctttttcaaatatacatttcgggctgattgtcaatctgagggtaattctatttatacattcatgtttggaatgtatatattatcagacttctctgagtcaaatggtatggttttctttcactatataaacaaacgaggcggtgaaaaagctgcaaattttgtaaaaaattacctttgcattttttcttattgatgagctatgattttatatgataaaaatatatttaacccgctatctgtaagagcagccgggacgttggcagacggaactccgttggaagacatctcctcgctgctctttttttgcgcgtaaatttgggacagcggggacggttctctttgtcccattttcaaaattttcagaaaatgggacaaagagaaccgtccccgctgtcccacaggaaaggagcagaaatgccaaaaactaagatacagggtgttgtgttcggactgatcatgtcctacgcaatggcctacggtatggaagtgtacaatgttgcgatcaaggaaggttttaacctgaacatcggcggtttttcgacgatgacaaaccacgtatttctcgacgcattgattgaagcgtcctacatgggaatatttgttttcatcacttcgagcctctggggcaaccggattggcgctgctttcgcagcccgccacacgaacccggaaacggacaacccatacttctgccgtgtcatgcgccaggctggaaccgtcgccatcatgtgcccgaccatgagcatgatcgcctcgatcctttttaatgtgatccttgcgcaccagcccatctgcaatcttcctgccatctgggtcggaacggtcattaaaaatcttccgatggcatttttctggaacatgttcgcagcagctccattcacacactggctgttcgggaaaatttttccagaaaaaaaataatccatccctgtgctcttacttctggcagaacaaggagtatttgtggataagaaaaatcaggaaaatatgccggagaaatcgctgccgcagccgctgccattattatgcttaaaaaattaaactcttcccggttaagataactggtggaatattctgtcgctctgtgatattctttttctatgaatattataagaaaaaactctactgaacaccttagatttgacacctcaaaaaatatccctctcctgacctttgattcgctctcaaaggagtcctgcgccatgcacggctttacgacaagactcggcggcgtaagcagaggatttttaaagagtctgaattttaaagaagagctcggcgatactgctgaaaatgttgccgaaaatttccggcgcgtatcggctgcttttgatacgactccagacagaatcgtcctgagccagcagacccatactgcaaacgtccgcgtcgtaaaagaatccgacgccggaaagggagtaaccctcccacgcgactacagcgatgtggacgggctcgtcacagatgtgccgaaccttgtgctttcaatattttccgcggactgcgtccctgtccttttcctcgacccagtcagaaaatgcatcggtgcctgccactccggctggagaggcacagtttcccgcatcagtctgaatactattcgtgcgatgcatgacaacttcggctccgctccatcagatatcatctgcgcgatcggcccctcgatctgcattgactgctacgaaataagcaccgacgtcgccttacaattcaaaaaagaatttccagagcacactccagaaatccttctcgataaacacaacggccactttcagctcaatctctggagcgccgtctcaatcacattaaaagaggccggcgtcctgccagatcacatccacaccaccgacatctgcacctgcgaaaatcccgacctcctcttctcccaccgggccagccacggaaagcgaggcgtgcagggcgccttcatcaaacttctctgacatgggacagaagggacggttggagcggttgttatgctgtcgcgagtccgcaggacgaagcgagagcattataaaccgcccatgcgatagccgtccgcgattgacgagtccgtaggacgaagtcagagcggaaacggcgaaccgctctttttgtcccatttttagattattcagataaatcataccatttaagtctgaagcagcgccgcagatggccgggctcgctccgtaggatttttctgttcgcgtgcgcgcgcctatttgcggccttctggccaatgtatggttttcatgcgtttatggtttaagcgggtagccacccaggccgcagctagcacgcccgctctctacgaaaaatcctaaggtcgcgcgcccgttccattctgcgacgctgcttcttggttaaaaggcgtccgtatccgcagaactgctttttggttaaaaggcgccgtatccgcagtgctgcttttttctgcacggatatctgtttggccacgttttcagtatagtccctctcggggtgaaatttatacaatggctttcctccagtctcaagatagatcagggaagaagtcaaattcttaaagagctttcaaacattctcaagatgtgtgggataatgctcaaaaatcttaaagagtatatttcaaatttttatatacagccattgcttctgaatattctacaaggcacttaagatttccagctccgcgacaggctatattgagagcgtacatttgagcgtttaagattttcaacgcttcgtgaatctatatcgagaatgactttttagtctttaagatttttagtctcatgtatatccatactgaaactgcgagaacgaagcttgtatatttcaagctccacgaatttaaatattgaaacaattcttccataccgcgaagcagacagacacatttgtatatttccagctacgcaaatctctacatttaaatcatttcatacataccggctgcaggcagacacatttgatgattttcaactacatgtaagcctatattgaaagtaccactaccgcggagccggaagataattctttacagtgtgcttaccccatatccctcccatgcggagcttctttgtcccattgcacctccttaaaaataaaccattgcagatacaaatgacttcacctcagaagcagcgccgcggatggtcaggctcgcgaccttaggatttttcgttgtaagcgtgtgcgctagctgcggcctgggtggccacccgcttaaaccataaacgcatgaaaaccatacattggccagaaggccgcaattaggcgcgcacacgcgaacagaaaaatcctactgagcgagacctggccatctgcgacgctgctttgggctaaaaaaagcataattatctgaataatctaaaaatgggacaaaaagaaccgtccctactgtccctatttggctctgaggagttttcgggcggtatttatctgctcctcggttggcggatttacgttctgcagtgtgtatgggattccaagctcctcatacttgtaaattccgagagtatggtaaggaagcacctccacacgcttgactgtctttaaggtgtcgataaatttccgaagctctttaagctctttttcatctgtggtgattcccggaacaaggacatggcggatccacatcggaactccgaggtctgacatataggtcgcacaatcgaggatgtttttattcgtgtggccagtaagcttaatgtgctcgtcatcgaaaatctgcttgatgtcaagcatcacgaggtcagtgtatttcataagctcattgaactttgaaaaaaatggttcttcccttgtaaatgggccggcagacgtatcgaggcaggtgtttatcccgcgctcgtggcattttttaaatagatcgatcaggaaatcaatctggagcagagcctcgccgccgcttacagtgataccgccttcttttccccagtagggcttataacgcagggccttctcaatcacttcatccgcagtcataagctccggttttgtctttttggtaccattcggattccaggtatcaggattgtgacagtaacggcacctgaaattgcacccaataagaaacagcacaaacctgattcccggaccatccaccgagccaaacgtctcaatcgaatgaacacgcgctttaatactttccatatttttcctatctatgaatatctttactaaattctgtacattacaataacagctgccgcagataaatggtaaacgattgttgcgcttttcgttgtgaatgagcgcgccagctgcggcccgggtgacaaccgttcaaacagaattgctaaaaaaaattgcgtcagcaatttttataaaagcaattctgtgcgttttgtcagagggccgcaaataggcgcgcgcgaatgaacagaaaagcgtaacctagagaaccattatctgcggcagctgtttagaaaaatcctacagtcagatcaaagatgatcgtggaatgtacggttgattacatcgagctgctgctttctggtcaggtcgatgaacttaacagcgtaaccagaaacacggattgtgaagttagcgtactcaggcttctcaggatgatccatagcgtcaaggagcttctccttaccgaagacgttaacgttaaggtgatgagcaccctgatcaaagtaaccatcgagaacatttacgagcttgccttttctctcatcctcatcatggccaagagaatccggagtcatagtctgggtatttgaaataccatcgagagaatactcgtaaggaagctttgcaacagagttgagggaagcgagaagaccgttctgctcagcgccataagccgggtttgcaccaggagcgaatggagtgaatgcctttcttccatcaggagtagcacctgtagcctcaccataaacaacgtttgaagtgatagtaaggatagaggtggtagcatctgaatctctgtaagtatggaactttctgagcttgcccataaaagtctttaagagcttgacagcgatctcgtcggctctaggatcgtcgttaccatacttagggaagtctccctcgatcttgaagtcagtggtaacaccctcatcgtcacggatagcggttacttttgcgtacttgatagctgaaagtgaatcaactacgtgtgagaaaccggcaataccagttgcgaaagtacggcgaacgttggtgtcgataagagacatctctgctgactcatagtagtacttgtcgtgcatgtagtggatcaggtcgaggatattgacatagagaccggcgagccagtcgagagtcatatcatacttgtggatgacctcatcgtagtcaagaatatcagaagtcataggagcaagctccggtccaacctgcatatggtggccctgcttatccttgaacttctcgtccttaccactgttgatagcgtacagaagagcctttgcaaggttggcgcgggctccgaagaactgcatctccttaccggtctgagtagcggaaacgcagcagcagatgctgtagtcatcgccccagacaggcttcatgacatcatcgttctcatactggatagatgaagtatcaacagagatctttgcggcatatttcttaaagttatcagggagatcactgctgtagagaacagtgaggttcggctcaggagccggtcccatgttctcaagggtgtgaaggaaacgatagtcgttctttgtaaccatgcttcttccgtccataccgataccggcgacctcgagtgtagcccataccggatcacctgagaagagctcgttgtatgaagggatacgggcgaactttaccattcgaaacttcatagtcagatggtcgataagctcctgcgcttccttctcagtgataagtcccttatttaaatctcttgtgatatagatatcgaggaaagtagagatacggcctactgacatagcggcgccgttctgctgcttaatagctgaaaggtagccgaagtacagccactgaacagcctccttggcagtctttgccggctttgagatatcaaatccgtaagaggcagcaagcttcttcatcttctttaaagccttgatctgctcagcgatctcttctcttaagcgtacaaccttaccagtcatcatatcgttgtgaccagttgcagccttgtcctcttccttcttctcgatcaggtaatcgataccgtagagagcgactcttctgtagtcgccaacgatacggcctcttccataagtatcaggaagtccggtaacgatatggcagtgacgggctgtgatcatctccggagtgtaagtatcgaaaacagcctcattatgagtcttgtggtattttgtaaaaatctcgtgaagctgcgggttcggtgtgtacccgtaagtagtcagtgcttcctctgccatcctgataccaccgtatggcatgaaagcacgcttcagcggcttgtctgtctgaagtccgacaatctgctcatcatccttcatagaatcgtcgatataagccggtccgtaagcatcgatatctgagacaacgtctgtctccatatcgagaactcctccctttgctctctcctgcttctgaagctcctgcagtttgccccagagtttgttggtgcgttcagtcggtccctcaaggaagctctcatctccatcatatggagtgtagttcttctgaatgaagtcacgaacattcacatcgtcgttccaatggcccggcgtaaagccttcccatgcatcaaaatttgtcattacgacctcccaattaggtgtatgtgggttgattggtatcttaacatgttaggcatagcttatttgttagcatctcctaacctgcaaaaaatataataacctataaacatattcccgtcaattggaaaaacaacgtttttaaaaaaaagcatgactgtctcaaccgtttcactgtttcataatggagacagcttttcgggcttcttttaaatcctcaaattctcccgcatggataaactgaacaataagatttccaagcgcagtgccctcgaccgggccgcaatataccggaagtccagaagcctcggatgtaagtttgttcaaatacttatcctggcttcctccaccaactacgattatgcaggtaaatttctttccagtcagcttttcaagctgctttactgtctttgcatagtcgtctgccagtgagttgtagatgacctgcatcacagcgcctgtctcgtctgggattggttcattcttttcggcgcaggcttttttgatttcatcgatcatcgaaaccggcgcaagaaacctctcgtcatctacatccactgtagtctttatgtctgaaaacttctgcgcacttgcgataagatccggaaatgcaggctttggatcaagctctctgcgcacattctggttcatccatagacccatgatatttttcagatatctgaagcggtgctcgtagccaccctcatttgtaaaatttgcagcacggcttgcgtctgatgcgattgcctctctattctcgacgcccatcagcgaccaggtgccagagcttaaaaatacagaggtgtcattttttgcagggactgatagaaaagcagaaccggtgtcgtgagttgccggaagtatgacttcaatatccgctccagtttctgaagctatctccgggcggagtctgccaagcggggtgcctggcatctgtatttcttgaaaaatatgtccaggaaggccgagccggtcaatgatctcgaaatcccagtcaccggtttttgcattcacaagagccgtcgtcgtggcgttggtgtattcatttgccttgacgcccgtcagcacaaagttcagataatccgggatcataagaaaagtctcagctttttcaaaataatccgggtgctcttttttcaaagcaaaaagctggtagatcgtattgaatttctggtattggattccggttttcgaatagagctccctgaatgaaataaccttaagtttctcaagttcttcgcaaattccattcgttctcgaatccctataggcaacagcatcgccaattatttcatcatttttatctagaagtacgaagtcaactgcccaggtatctatacccaaagtctctggatagaagcctctttttaaagtctctttaattcctgcgatcacgctgtttttcagattctctatatcccagcatttgtgcccatttttttcgatgagaccattttcgaagcggtaggtctcggtcatatttatctttttgttatcaaccgttccgacaatgtgccttccactcgaagcgccaatatctaccgccaggtattcgctgctcattcaattacctccagtggtacgttaaggatctcagccacttttcttatggtcccgatattgtggccgatacctgctgccatgtggtgtgtcgggccggcctggctccagcggtttacaaattcttttgctccgcatgaaaatctcgtgcgcatatttgtatcgccgaatccatagattggaccgtcctcatttacgccctctgcggctacaaatttgaaattgccgtctccgtcctgagtgattgcaaggtaggtaatgtctccagccggcggataaaactgtgtcagataaccgccgcctgttttaccatggaaaacaggaacgatcttcatagtcggcttcttcgcctttgaaatatcgtagtcgccggaaccagagtgccctatgatgcagatgtcgtcgtcaaaatcaatcgaatacatctcagaaagctggccgcttccgcatattgtcttcatgatgctcatcgccattgcgaccttcatatcaccttcaactgcgcaggcagtgccctgttttataagcattgaaaatgccgggataagcatagaatcgagcacaccggcctgtccttttgcgaaaccatcgtaatgcgaagcgataagcccgagtttttcgtctctgacccatttttcaaaggcaacgacgtatttggccattgtcctgatgtcactctcttcgtattcacctgttatgtcaaaagtgccgtggatatcttctacctttgcttcgatagcagcctgatcgtctatgttgtctgcgattgcccacattttttcccagtcgaactgcttagtgtagaggccgagccttctgtagaggttcgactcatcgatatagagatccatcattcccgggtaaggacggccgatctgcgcaatgttagtgtctctgaatctgcgtctgacctgagcagccctgcaccagtcattgatctcgcacttagcctgctcatctccgccctcaacaaccccggtgatcaccgcgtgtctcttaccaaagcggttcaaatccgcagccatctcgccgacagccccgcaggcgtaatacttgccgagccagtcagggatctgtgcatttttataatccggaactcttaatttctgaaggtttacaagaatgaccggtacatcgagatccttaacagccggaagcatattgtaggatgtcgcataagttagaagctgtaaaaatacaaggtcaacgtcagccgccctgaacttatctccagctgcctgtgcctcctcctttgtcgtgacaagtccgccatcgactatctctatggtgtcaggaagcatcttcttaaaaacttcgtactgtcccttaaactcaggcaccagctgtgggaactgcggcagatatgcaccgagtgcaattgaaaatactccaactcttgcttttgtatctactaacatgatcagtcctccggcatctgcccaattgtgttgtcttttttctcatagagaaatttttcattgatatgaactccgaatggcgcattcagctctctgaactggtccggagtaatggtctgcctcttcacatttgaaatggacataacttttacaagaacctctgctgctttctcagccgtgtgtataagcccaaacgcttcgtcaaaagtgcggccgcagacaaacgttccatgttgagcccagacgcagatgtcgtgagtcctcataagatttgcggtgtaatctccgatctcttttccgccgcagagcatccatggtactatgccgatcccctctggaaaaacaatcggggcactcagttgccatctcatagatttctctggtgaaaactctctcatcgagcggcagcacatatgtcagtgcaattaagtttgtcggatggcagtgatagacgatcctgatatcagcatctctcttctttagtacgtccagatttgcgaggtgagttggaagctccgaagtcggtctgccaccattttttaagccccagactttcataaatctggtgccctctttatttaacctgatgattgcgacgttgttctctggatccggctgaatatttctgaaatattttcccgatccgcttaccatgaagtactctccaccgaggtccggaaatgcgctgtcgtcctcgtgtccagcctgccagccgatgtcctcccagacgcctttttcatcaaaatcgtccttcagttcctcgacatcactgtctttaagtctgtatgtcaggttgccgccatttctctcgtgccatccctgattaaatccatccatcgccatacgggcgtacgcttttaatagttctgagtctatgaccttcatatatttttcctcctgttattattttgatattacgccctgtagggttatatttatagaacaggatttgtaaaaaaatgcgtcctattttgcgcttttcgtagtataatctgaatagtgtaaccgctcaggttttccagaatgggactcatatatgaagaaaaagttaatcaaaagactctcgaaaatcactcctgaggagcaaaaaattctggatggtaataaagatatagatagaagtatttactaccattcgaagcagaatgagatcgatgcggcactgctgctgaagcaggggcgactgattgatatacggccaaatacaaggtttgtacactttccggagcacacgcataatttcgtagaattcgtctacatggtgcaggggcataccactcactacatcgatggaaataaggtcgagttgaaaagcggcgatctgctttttatgaatcagcatgcgaagcaggaaatcgagccagccggcaaagatgatatcgcagtgaattttataatactgccggcatttttcgatgaagtgctcaagaggatcggagacacaaaatccactctctgcgattttttgatcgggtgtctgaccagcaaaggtatcgggggaaattatctgtattttgatgtatcggacgttttgccggtgcagaacctgatggaaaacctgatcatcctgatgctcgactcgccggagaaaaaccgccagatcagccagcagacgatggctcttctttttctgcacctgatgaatcagaccgaacaccttcatatggccgatgactcgtacgacaaaaaaatgatgctgaccctcctcgactacatcaacaccgactacaggaccgcgagtttctcatcgttttgtgaaaaaaaccacatcgacatttacacgatgggacgcatcatcaaaaaaaataccggcaaaaatttcacccgcctgctctcagaaaagcggatggacatggccacatggttcctgaaaaacaccgctctccctgtcaccgaaatttcgctgtcagtcggctacgaaaacacaagctacttctaccggctctttgaaaagacgtacggaaaaagtcccaaagccgtcaggctgggacaatagggacggttctttttgtcccaaaatctgacaattctgattttgggacaaaaagaaccgtccccgctgtcccatttatgaaaggagaattaaaatggaaaatgttaaatcaccctggccggatcccgagggagttatcccggttacggacaagtcgcctgaggatgcaaatgtcacgacacgaagatttctggacagtctgcacgttgaaatgcggattatcgattcggtcaagccggatctaagtacaaatatttttggtaagacgtacagcactccgatcatgatgcctgccttttcgcatctgaacaagacaaattcttctaagggaaaacccatgtctgaatatgctgcggctgctaaagagcttaacaccttaaattgggtcggaatggaaaccaacgagacttttgaggagctctcaaaggagggcgctgatactgtccggatcatcaagccttttgctgatcacgaccgaatattttcagagatcgaatttgccagaaaatgtggggctgtcgctgtaggaatggatatcgaccatgttgccggaaaagatggaaattacgatgtcgtcgatggactgccgatcgggccggtatttttcaaagatctcttggaatatgtaaaagccgccggagttccatttgttgtaaaaggcgtactatctgtaaatgatgccctgatggcccgcgacgctggcgccgctgctgtattcgtttcacaccatcatggcagagttccgtttggcattccgccactttacattctgccgaagatcaaagaagctcttgccggaagcggagtctccattttctgcgactgctcgatcgataccggttacgatgcctacaaggctttagctctcggcgcagatgctgttgctgtcggacgtggaattctgatgccgcttctcaaagagggccgcaaaggagttgtcaggaaggtaaaaggaatgaacgcccagctttctgaaatgtgcatctacaccggagtcaaagatatgaagtcgttcgatccaagcgtgctgcacagactgtaaatccaaaagaggcgatccattttgattccatttttcacatatcaggacgatattccaaaaggctccggataccagattttttctgcgacgcactttttctgccttgccgctgtcggtgctgtcatggcggtaatcgccgtgatttttatcagatgcagagaaaaaggccgcgacaggattcttaaagaaattccgatttttctgctgtgcatggaagcttcgaaatggatcgtgctcttctccattcacaaggcaaacatcggaatgctgccgcttcacctctgcgggctcgcggtctacgactttgtgccggcctcgtttcttccatcaaaaaaagcccgggcatttttcggtgaggtggccgtgatacttctcggaccaggttcggttttcgcgctgttgcttccggactggtcattctacccggtctggaatttcttcaatatttacggctacatctggcacgagcttctgctgctctacccacttcttctgcttatcgacaggcgcgtaaaaccgaggatttttcatctgtggtatgaaatcgtatttctggctgtgatcgtcccgccgatatttatttttgataaaaaattcgactgcaactatctcttcatcaactggccggatgaaggcacgccgctgtcgtggatggcatcgtttatgggagttccggggtaccttatcggctacgctgtaatggcggtttcagtgatggcacttatatatgtaccatttgagattgctgctggtatatcaagaaagcatatggagatacaaaaatgaacgataatgacgccatcgctgcaaaacaatataaaaaaatgacgacaactccggtcagagccactgctttacattctcggaagcacgaagaccatttacccgtacgcaaggcagtatgcgatttttataatacttgccggcccgctgcagtcggcatcctgcacgttgaataaccagctcaggtaccacggccgtgcaaatcttgcaatgatcgggcttctcgctggaagcattgtaaatatggttatggacccaatcctgatgtttggtgtcggaatgggcgttacaggtgctgggctttcgacaggactatcgcagacgatcagctttttcatactgctctatatgttcaggtcaggaaaagttgtgaccgacgtttcgcttcgtcacgcttctcattcagcgcgcacatatacaaacattatgaaggttggcttctcgtccctggtgaggcaggctctaaatgcagcttcaacgatttttttgaacagagcatcgatcccgtacggcgacgcctgcatcgcagccatgagcattgtcgggcgaatccaattttttgcaggctctgtaatgatcggactcggtcagggcctgcagcctgtagcgtcatttaactacggtgcaaaaaaatacagccgcatcgcttcggagtgggctgtacttcatcccgctgatacttattctgccgcattttcttggtgtcacaggcatcgaaacagcccagccaatcgccgatgttctcgcagcatttacgacgctgccactcgcaataagatttttgaggtcgctgccagggaaggatgaataaaaaagatgattgccatttttagctatcatcctcttcgtttctcttctgttcttcaaggaactcattgtactttgcgttcgcctcttcgctctttttcttctcgatccagcgtcttctgtcatccatgattgcaagcatctcatcgactatcagaacatcactgtttggcctgacgtttctgagataagatgccattcgctgcatcgtttttactgaatttaaattcttggcgacagcctctcccaattcttctgggaagccaagatttacgacttcatctatcatttcctgccgcgttttttgaaaaaactcttcatcattcataataaaatctcgcaacacttatttatctgctaaatagtggatcaaggccttataaatgtgtaaatttaaaaataagaagagccattggctcaaccttttggtataatgtaaatcgacgaaaataaacaatgtacctagaaggaggaatcaatggctaaactcaatattacactaaatcaggaagaaattctacagttactttcagaaaatgtgatgatgctttcaaagttttactgcagaactgcttaaacagtatgctcaaggcggaatctactgaacagcttaaggcagagccttatgagcgcactgaagagcgcacagacagccgtaatggcagccgtgagcgtgaccttgtccagaggcttaaggtgccaggacaccgcaatcagccgttcaagacaatgatcttcgacaattattcaagaagtgaatccgctcttattgcaggcatggcagaaatggtggtatgtggggtctctacaagaaaagtgtcgaacgttgtcgagaagctgtgcggtactggaatatccaagtcagctgtatcggatctctgtactggattaaggctttgaaagtatcatgactgttatgcaccttcctgctgggatacgtcagtattaccgcacttcgaaccatatagaacgaatcaacagggagcttaagcgcagatccaatgtaataggagtatttcctaatgaggcatcgcttgtccgccttacaggttctgtattgcttaagattgatgatgcttatgcaggcgaatacgtggagtttggcaaaccaacataccagaagttgttatcttccgacttacgcaatgattttgaaactatagctgaaaatcagaagggaatgctggccgcctgatattcttttttgcaaaaaggtaatttacacacaaatttggatttaactatttactactgagataactgcattcagcaaatggcttaaatatgccgtttctatggcacttagccttcccggaaaagagttttcaaccaaaagccactacagactgttaaaagttatctcaagttttcaaccttatattgcggatagccaaaatttctatcctcccgctcttacgagcgggatctggtaacttcatagcgatacctaaaggaatattatttctatccacccgctcttacgagcgggatcgtaaaaagcgtaaagcctgctgcctttgcaggatttctatccacccgctcttacgagcgggatcaacattggcgaccaacggagcgggaactctttatttctatccacccgctcttacgagcgggatcacatgagtcaggtcttggaagacgatacgaaatttctatccacccgctcttacgagcgggatctcagcattcgtgaaagcacgaaaagccatcgaatatttctatccacccgctcttacgagcgggatcacatgagtcaggtcttggaagacgatacgaaatttctatccacccgctcttacgagcgggatcgaacagccaaaattctattataaggttgttcatttctatccacccgctcttacgagcaggatcgccagtgtacgttgctccagcaacaacccttcatttctatccacccgctcttacgagcgggatctcagcattcgtgaaagcacgaaaagccatcgaatatttctatccacccgctcttacgagcgggatcatcgtcaaggcaagtttgcaggaacgttataaatttctatccacccgctcttacgagcgggatccgtccttattcaaggcataactataaatataaaatttctatccacccgctcttacgagcgggatccattttccgtgataaattcacggttgttgtgtatttctatccacccgctcttacgagcgggatccttgctccctaaaggctctatcaaggctattaatttctatccacccgctcttacgagcgggatcagtaagagctttagtctgagatacagtccagtatttctatccacccgctcttacgagcgggatccgttgtttcggttgagagcggttcctctccggtatttctatccacccgctcttacgagcgggatcggtcttccttgtcatagatcacgagcatttcgtatttctatccacccgctcttacgagcgggatccgtgcctgtattcgagtaggagtagcttttatatttctatccacccgctcttacgagcgggatccaagcatcatgctgtagttgtcccagataccatttctatccacccgctcttacgagcgggatctctgccggagtcagtgtagggattccgacctgcatttctatccacccgctcttacgagcgggatcgcaagttgatacatttcaacttgacaagcctatttctatccacccgctcttacgagcgggatccaatatcaccgtctcgaccgtctatttcttcaaatttctatccacccgctcttacgagcgggatcgttagcccgagcctggtattgtagtcagctatatttctatccacccgctcttacgagcgggatcagtggatgaactcacagaatccataggtggcatttctatccacccgctcttacgagcgggatcaactacattaagagctgcctatgagctcggaatttctatccacccgctcttacgagcgggatctgcgcccattgcagcaaacacaccctttatgcatttctatccacccgctcttacgagcgggatcacggacaaattcttcatcagagagcgagtctgaatttctatccacccgctcttacgagcgggatcaatagaaagactccaggatgaaaggtctatgatttctatccacccgctcttacgagcgggatcccctattatcaatcctgatggttcagcgaactatttctatccacccgctcttacgagcgggatccaaacgagggcaaggatgagccaaatactggatttctatccacccgctcttacgagcgggatcccccagcagttgttgaatcaatgattgcataatttctatccacccgctcttacgagcgggatcgaactccgcaaggttcatgttcgtgatgcctttatttctatccacccgctcttacgagcgggatccgagtgcagttgctgcaatcaatgagataaaatttctatccacccgctcttacgagcgggatcaagagtgacctacacggcagatatgcaggcaaaatttctatccacccgctcttacgagcgggatcctatcatctgtatcacctctgctctttcttacatttctatccacccgctcttacgagcgggatccaaggtgcgtgaagcactaaaagaaggttgataatttctatccacccgctcttacgagcgggatctttttcttcaagacttcttatataatctgtttatttctatccacccgctcttacgagcgggatccttgctccgatagtatctgtaatgcttgtgatatttctatccacccgctcttacgagcgggatcgggaacagatcatggtgttcttcatcctatatttctatccacccgctcttacgagcgggatctttttcttcaagacttcttatataatctgtttatttctatccacccgctcttacgagcgggatctgaagctatggataaagtagctgaagccaatatttctatccacccgctcttacgagcgggatctttgtcgcctgcttcatatataacatttgcatatttctatccacccgctcttacgagcgggatcagacaggcagggagttcctgatccggccatacatttctatccacccgctcttacgagcgggatccacctgtgaacaccgtgtatggaattaacttatttctatccacccgctcttacgagcgggatcgtaccaccaccaatctccgtatatccaccgtcatttctatccacccgctcttacgagcgggatcgagtaagcgcatggctaacgggatttttcattatttctatccacccgctcttacgagcgggatcccaactggaatcttgccagagtgcacaattaatttctatccacccgctcttacgagcgggatctggaatgtatatcagattcctaatgaacgtacatttctatccacccgctcttacgagcgggattgtcaagtgttattttcaagttgttttcaagtatttctatccacccgctcttacgagcgggatccttccattccttctagtattgttcgtcctattatttctatccacccgctcttacgagcgggatccagacttgataatatctttgccggctatcatatttctatccacccgctcttacgagcgggatcggtgcagcaaaagtaacgtcatttttgcagaaatttctatccacccgctcttacgagcgggatcgagcaagcgtatggctaacgggatttttcattatttctatccacccgctcttacgagcgggatcgaacgttacattatttgcatctacccagttaatttctatccacccgctcttacgagcgggatccattcgtcgagaacatgacagacacctataactatttctatccacccgctcttacgagcgggatcagacatggatgttcgattatagtcctaatcagatttctatccacccgctcttacgagcgggatccttcgttctgctctacgaacaaactgacgaataatttctatccacccgctcttacgagcgggatccgaagtcggcgtgaaccttgcaaaaggtgtagtatttctatccacccgctcttacgagcgggatcaggcggtcagtaagtcgcaaaagaatcaggaatttctatccacccgctcttacgagcgggatcttcttttcttcgtttactacctcaataaatttatttctatccacccgctcttacgagcgggatccttgccactttcggcttgcttgtggtgttcaaatttctatccacccgctcttacgagcgggatccaaatatcataaaccttcttaatgatctgattatttctatccacccgctcttacgagcgggatcgaatttactatcttctgtaaaattaccatacccatttctatccacccgctcttacgagcgggatccagttatctgaatatcctatcgtattctttgatttctatccacccgctcttacgagcgggatcatcggtgaccggctcgaagcgtccagggcgataatttctatccacccgctcttacgagcgggatccgggagaaaaaagaagggaatgcatcaactgatttctatccacccgctcttacgagcgggatctgtacctcttgaccatacaaagttagtacttcaatttctatccacccgctcttacgagcgggatctgatgtagaggctactaagagagtctctaaagcatttctatccacccgctcttacgagcgggatctgtatctcctacgtcgtcttcgtcggtatgaaatttctatccacccgctcttacgagcgggatcgtgtcggcggtcttcttcatctctcggtagtatttctatccacccgctcttacgagcgggatcctatgttttctgcttcgagtgcggaaagaaagatttctatccacccgctcttacgagcgggatcgatacagtactcatcgttctttatgaatatatatttctatccacccgctcttacgagcgggatctctaagggaacttaccaaggcagacctctcataatttctatccacccgctcttacgagcgggatcctgcttgaagatgataagtataaaaagggcatatttctatccacccgctcttacgagcgggatctcattgcttttgcgaactgctctgcatagcccgatttctatccacccgctcttacgagcgggatcgcactggaagagatcatcgaggcatccgattatttctatccacccgctcttacgagcgggatcgcactggaagagatcatcgaggcatccgattatttctatccacccgctcttacgagcgggatcctgcagcttcaggttatgctacatcctgttcctatttctatccacccgctcttacgagcgggatcgcaccctctccaagatcatcaggaaaataatcatttctatccacccgctcttacgagcgggatcgcaaggtgatagaatctgcgtgttattatgtatttctatccacccgctcttacgagcgggatccgatcatcagaagcactctctgaggctttctgatttctatccacccgctcttacgagcgggatcgggtatcaagcggtataattttacataataaaatttctatccacccgctcttacgagcgggatcgattggaaagctgataagggcgatgtacaagatttctatccacccgctcttacgagcgggatctgcagaggctttacagcattgacaagaggcaatttctatccacccgctcttacgagcgggatcctgccttgaagttgtcataaagcgtcatagatatttctatccacccgctcttacgagcgggatccctaggcatctttctgaatatacataataggcggatttctatccacccgctcttacgagcgggatccagactggcggttccatcactcgtgcgataaaaatttctatccacccgctcttacgagcgggatctctcaccgttgaggagtgggaaagcgagttcctcgaatttctatccacccgctcttacgagcgggatccaaggatctcctgggcttctatcgacggcataatttctatccacccgctcttacgagcgggatcatcaacccaaacgtcataaggcacacggtcggtatttctatccacccgctcttacgagcgggatctttccttgtcatcaaaagcatagtcaagaatatttctatccacccgctcttacgagcgggatcgatgagtggtatgaataccggtgttgcaatggcatttctatccacccgctcttacgagcgggatcggtgcctgaacaaactctgaccccgtaaacgtatttctatccacccgctcttacgagcgggatctgggctagaactgcagacggagcaacagtaacatttctatccacccgctcttacgagcgggatccttatccttctcaattttgatctgcattcctatatttctatccacccgctcttacgagcgggatctgacggccatcgtgatctgctgcatggacatatttctatccacccgctcttacgagcgggatcttgttcgtgatgttttcgatcgtttctccgatatttctatccacccgctcttacgagcgggatcaagctctgcggcctcatcgtctgtcagctctatttctatccacccgctcttacgagcgggatcgaacgagatggtaagaaatgccaatgacgttgatttctatccacccgctcttacgagcgggatcacatctgcaagacttcagccctcttgtcgaaatttctatccacccgctcttacgagcgggatctgtcctatcacttggataatcgtagcaataatatttctatccacccgctcttacgagcgggatcatatgcaggaaatttatgaatggtggggaatcatttctatccacccgctcttacgagcgggatcagccagtcccttaccacatcgacttcatctcaatttctatccacccgctcttacgagcgggatcactgatcatcatatacttcgtgcgtgaccttatttctatccacccgctcttacgagcgggatcacaaggattactgacggcttgagtttatcaatatttctatccacccgctcttacgagcgggatcagtggtgcggtcgattttatcagtaatgcagtatttctatccacccgctcttacgagcgggatcctcctggattccatgaagatgagcggaggacatttctatccacccgctcttacgagcgggatctcgttgtaaaccgtgagggcgattgtgtcgctatttctatccacccgctcttacgagcgggatcatgctgggctacgtgatcatgcaagacccgtatttctatccacccgctcttacgagcgggatccgagttgcgagtaggcgattttgtcccaggtgtatttctatccacccgctcttacgagcgggatccttccggagatcagcttcacggacgacatgtatttctatccacccgctcttacgagcgggatccaatcctttccaacagcctttctgatctgttatttctatccacccgctcttacgagcgggatctatcacggaacgacttacctcggagtagcactatttctatccacccgctcttacgagcgggatccgaagcgacgacaacccgatcacggacatcctatttctatccacccgctcttacgagcgggatcccttccggagatcagcttcacggacgacatgtatttctatccacccgctcttacgagcgggatccccacccagcaatgaaaccgggcgaaaaagttatttctatccacccgctcttacgagcgggatcgttaatgcgatgatggaaaggatagttaggtcatttctatccacccgctcttacgagcgggatcaccatttgaaccgtgctacagagccacagagatttctatccacccgctcttacgagcgggatcacggagttgaaaaggtttttagctccctgtgatttctatccacccgctcttacgagcgggatcggcagatttttaacaaaaaaatagaaaatatccaaatcgagttcatgtaaatctgccaaaaatatgagctcaaataaaaaaaatcaaaccgcccttaagaaaattcgcacaaaaatgggcggtatattttgtgcattattcacaattatagtatcgaaaattatgtttatttgacgtttagagaataattgctccaggttcagagagtttgaaaaaaagtctgtaaaagttttcatatagggtctttcatgatacaattattttaattcatggagggcctattattatggcaagaagagaaaagcaaccagtacaccacgttcagattacgatggcaaaagagccatcaccaggggcttctgcaggagtatgatatccgggatgcaaacgacatccaggaagccctcaaggatcttcttggtggcaccatcaaagaaatgatggaggctgagatggataatcatcttggctatgaaaaatcagagcgtacggcgattccgaaaagaccgcacctaccggaacggttacaagacaagcgtgtcaactccagctacggcagcatggatatcgatgtcccgcaggacaggaattccacgttcgagccacaggttttaaagaaacgccagaaagatatatcaatagaccataaatcatctctatgtatgccaagggaatgagcactacacagataacggagatcattcaggatatctatggctttgaggcttctgagggctttatctccgacgtgacagataaaatcctgccgcagatagaagaatggcagaacaggccgctttcagccgtaatccgatagtgttcattgatgccatacacttctcggtccgtgatgacagtgtggtaagaaagcttgcagcatacgttgttctcggcatcaacagtgacggcaaaaaggaagtactggctattgaagtcggcgagaaagagcagcaagtactggctgtctgttctgaattccctgaagaccgtggagtacaggatatcctgatactctgctcagacgggcttaccgggatcaaagatgctatatcgacggcttttccgaaaacagagcagcagcgctgtattgtgcatatggtacgcaacacccttaaatatgtcccgaacaggacatgaaagcatttgcaaaggacttaaagactatatatacggctgctgatgagaaaactgctcttaccacatttacactacacactacaacagcacgagtaactgaaaatggaggaccagtatccttatgcgatgacacggtggaactaactgggatgccatcagcccgatattcaagttctccaaagacgtcagaacgctttctacacgaccaatgccatagagtcactcaattcatccctgcgccgtctgaaccgccagaaagcgtatttccgagctcacaggcacttacgaagcactgtatcttgcaacctgggagacaacgaagaagtgactatgccaatcagaaactggaacaagatccgaggagaattaaagatcatgtatcctgacagactgccggaataagatcagatgccgtatttacggcattcccagcttagagctcttaattgacttctagtctaaggtccattctgtcagggcagagccgctttgcggtgccgaaggcacccttgacagaatgaacctctcgggctttatcatacttaagagctctaagccttattctgcactgttttgaaagtacaagtagctaccagtaaagctataatctgctgtaatgtcaataatacagattgacagaattatttctgaactctctgacatgacagctgatctatgcaatattatactcaagtgatacagaagaatatatttaaaatattttaatctatatcactgcaacttttcatgaaagatctgtttttacagaaaaaaattcatactctccaggttcacttaattctactgtttcctttttcccgaggacgtatacgtcatatttcatatattttccaagcttgtaaattctcacagaatcaatatccggatcaatcatttcatcaagctttattttcaactcagtcattttcgttggatccaaattcagctcaaaaaccgagttctgcactctctgaccgtaagattcacaaattttggcaaccttttgcagccggcgacctttatcagattcagtatcaatatcataagtcagcagataaagcaataaaagtcacctccaatccgtaaaaggtggatattcagaaatatctcctcgtaagtactgtcccaataattgagcctgtaaaaaaggcagaacttttatagggacttctttatcccatagcttatatcccactttcgtttctttatatttttcccaatcagtcaagaccttcttctttccttcagaagtcaaagaaaatgtaccttctgattcttcaaaatcttttgccgtaattttctttagattgaccgattttattacatatgaatctataactggtgtcctgaattcctcgactaaatcacaagaaagtgaagctctacctggatgaatctcatgtaagtagcccaaataaggatcaagtccatatgcacaaactgcagctgtgcatgtagtagtttcaatcgtatatagaagggataacagcgaattaaaacagtttttcggtggccgtcttgatctctcaacaaacttcatttcactatcgcagccttccagcaattcatcaaacgtggaaaaatattttgctgcacaatctccttctatccctcttatctgttctactgaatcactatccaacaagacatttatttcagatgccaggtaggacctaaccttctcaacatttggatgtctggcgctgtatctagccaaaaatgccatctgattgactgttttccctaaaacaatattcttagctatttttatcttttcttcacttttaaaagcgtcatactgtttcattctgagagatacattaccaacttctgtcccgttaaaagtgcccagataccttccaaatggagagatataagaaatgctgatttttgatctgttgcaagacgaaagaaggtaagctgaaatagttacattcgcaatgactattatttgtgatagtgaaacaagaggaattcttgtaataattcttttatccttccctatctcaacagaatcatgatccacattcaggtagaggccatcagtcattatgtaaagtattttacctactactatcattcttgcaccccatagcccataattttttcatatatgctgtaaccgcaagtccttttggctcgcatacatcatagagagcgcatttctcacatcttttccgatacttaattggaaaaatagaatctgcatttttcccagaatacaattcttttagctcatcacggatggattttattgtatttgctgtctctcgtctcagttcatcagatacctctatatcaagtctgtccttggaatctgcataataaataatccctttatcaatatgagtatcatacatttcctcaagacaaaatacctgagcgcacaactgcatttcatattcacgttcatcacgcagttttccgtgtttaaattcgacaggttttactgaatatacaccattaagaaaagctatatatgacccattgtctgtatcttcatcaaattctacgttatcacaaaatccatgaatctgatacttttcagatgagacatataacctggaaaccactatatgtggtcccctcttagttatatgtctgtcatctacaactctgtgctcatacttgccttctaccatcgccgaggatttcaaatccatacattctacatacctgagataaaatcttctactacagtatgcgtattcgcttatccaggataagaggatttcactttgtgattcttccataggccttacttaaaactaatatcgtccagattcatctttccgacttcgtctttaccccatgtaacattatcaaaaggattatccttaattcctatctctactcctgatggtacatctgagatatcaagtgtaacattataatctgaatatgctctcggagtatctacatcttcctttttagaaacatgaaacagatcaaacagcttgtgagctccacagcatcccagcattgcctccttctccttctgctcgggatcgttattagcatctgcaacacctatatgcttaaaaataataagcggagataccacactcataccagtctttgatgaagaaacatcattattatacatctgaagcagtgcttcaaaaagaacatccaaatcttcttctgagaagccattcttccttgcaagatttgcgctaactgtaccctttacgagatagagaccgtatgggataaactgttttgtacccatagtacgtttcttgtcaggatccatttttgcatcagcctcatcaaactcttttaaggtgttaaaattgccatctgtataatacatccttgtgacagtgatgctctgaggatctatcgggtctactgattttgcaaaagccagctgaactgttcctctaatctgaccagcatttcttcctgtagaaagcactcctccaaatgtacgcccatcccagtatttctggcagaagacttcagctggagagatattctttccattctttttttcttcatcagaatgaatacatgcatcaaggatttccttattaatcgaagtgccattctttgcaaaaatatccatcccctgcttatcaccataagcatccattacataatttctgattcttctcttcaaagctgcatcagttatataaccatatccggtatccggatcctgtctcgggagattgcccatatctgggtctccgtttggattgcagttctcagcttcaacaagaagcataaattcataacgattcttgagtttcatagattattttcctccgtttttatcatcttctaaatcagtactggtttcttcatttttcttataaaatgcctgtttctgctgagcaaatccaaggtcaaatgcaccctgctcctttacagaaagcctgtcagggaaatacgtgcctattttttctgatatctccccaaatcttttttcaaaaacactcctgtaattcgtcagcctgtcctcgtaaacctttatataatcatctagcaacgagaaagccttggccggactctttttagcctgcttataaaatctcgatgataaagttctgttgaccttctttccagactgttttaatgtaaatggtaaataacccgtcaccttccttgttccggatctctttgttagaataactttaaaaactcagaaaaccttttctcagtttttcaagttatcaaacattttcacgggaggtacaggcatggatgttaatccaaacgagttgtaaacaggttcgcctcaaagattggtcaaacatattcaggagcgaaatcaaagtggtttgacgattgagtgatttctgcaaaaagaatggctacactagaaatcagtactactattatctgcgcaaactcaggaggaaagtcatcgaagactcaggctttgttgagctgcctcaggttcaatcacaggccactgccgtctctgaaccggatatcataaaaatctgatcatttaagcggcaagttcaatactcagatgacatcagaacaggaaactctgagatctgcataaacgagtctactcctaagtctctgatagctgaagtccttgagtattgaaagtgctgagtgacgctaaaggttttacgcacatctatctctgctgcaactacgacatgagaaagggcattgtgcctcataaaaactgtcaccaatactttcggacttgatccggctgacctggttccatcttcctgttctgtggtcgccgttcagaccgatgaaagctcttctttatgaaggcaacggctggctcatgtgttataagcgttttactaatggaaacctgcaatggccccgtatccaccgaagcaaaattgatctcgcagcgacagtacgagtggcttatggagggactgaatatcgatcagaaaaaagttatttcagatgctcctccagggatttactgacaggatcttactattttatgcacctgaaaacatacatatcaaggtgcctgaagcgctgtatttatgcggacttcaggctctttttgtgataaattatatattgaacggaccagagatcacagactcagaactgaataatctcccaaggaaacgatcatttttctgttccttcagctgcgtgaagcgtatcgccagctgagcgcaaatgacactaagattctggcacagaatgaaaagcttgttaagcagatcgaagatcttaccgagcagatcgatatccttacccagaaccgttttggcagaaagtctgaaacgagaatcagattgaggacagatgtctatgtccgatctctttaatacattttaaacgacctgaatctctcactgaaaacggtgttcctcctgaaaaagacagatgaagttgtcaaagtcaaagagcatacccgtaagaaggaaagagaaaggaaaatctaagtggtgtcgagcgggagatagtcatacacgaagctcaaaagaagagcttgatgctgcatttccgcacggatggcatagctcaccgaagacgtatacagtgagctgcatgcataccagcaaagtttaagatccttagcatcatgtaaaggtatacggtgggaaccatgatggagacagtgtgataagggcatcatcctgcaagaattctgtctcacagcatactcactccagggctttggccatgatcttcaacatgaagtatgtgaatgccatcccactgaaccgcctctctaggaatcagaaggtatgatgtcattcttgaccggcaggacatggccggatggctcatatcagtctacaggtattatctgaaacctgttcatctgacgatgaagaagcagctgattaaatcgaagctgctccactgtgatgagacaccattcgtaatgccaaagaagtcaaagcagtacatgtgggtgcttcattctccgggagcggaggtcctccgatatatctttatgatatctgggagcgaggaatggtgaggtaatacaggataccttgaaggctacaaaggaatcctggtaacggacggatatcagccgtatcacaccatcatgaaaaacagcaatgatatcacagtagccgggtgttacagccacgtcagacgaaagtttgcagaaatcgtaaaggctgcaaagaaaggcgagaagctgacaccggcacaagagatagccgccgaggcagtaaagcggatcgatcagttttaccacctcgacaataagttcaaagaatcttctgatgaggaaaggctaaagaacggcaggaaaacatcaggcccctcgtagaggacttctttgcgtgggtaaaaacatttgacagcaaaacgatatcgagtacgaagcttcgcgctgcattgaactatgccaagaatcaggaatactacctgaaccttccttgatcatccggaagttccacttgacaacaacgatgcagaacgcagcatccggaagttctgcgtaggaaagcacaactggcacatcatagactcagtcaatggagcttcagcaagcgcactctactacgctagcagagacagcaaaagcgaacggcctgaagccttacgaatacatgagatacctgatctcagaactgatcaagtatccgagagaaaaggttccaggcgatgaacttgaaaaactcatgccgtgtgtcagaatcaataccggatatctgccgaaagaaaaaatagagcaataataaaccagcccgaaagggctggaatttttgaaacttagagaacctgaagaaggtcaaaatttaatagtaacgcgtcaagaattttttttgaaggtgacgggttatctaccatttacgttttaatgattcatcctgcagcttgtctatgacagcaagccatctgccacactgatagccgatgctatcgttatctggcgttagttctttttccatttcgtatcctccatttcttaacaaatatattttttccagttccaaaatacaaacagcattcacttcacttatatgtttatccaaagaaatattagcatcaggattaaaacctataaatttggtgtattgctcagttgctagtttaaaaaaacgttcgggtatctgacctcctgcataaacagcttttagaagtgcggatttttcctttcgaaacatagtatactttccatcttttcctccgtccttactattaagcttcaatgcatacagtacttcaaaaatatttttaattatcctatcataatagacactagactttttctctttatcaaagtatgacgactcaattgcactgtcctcataccatttattaagattctgatataaagctctatacgtgtcgctgtattcattctcgaacagcattcttcccttactcggaaatgaaatacccactaagtgatacttataatcacttttaaacgtctcaggaatctggcctgtttcagcagctgttagaagttctttatactctttgctttttattctgttttcctgagcttctgcctgtaaatctttggtagacttttttcccggtttctttttttgccatctcgaaaccatcgtttttatcacatcgttttttatttttgaatcataccaccagcaaatgccaaaatcaggattatactggtctgcttcatttaaaacaaaatccaatccacttacaatagtatttgcttcagactcactcatgggacagtctaattcagatccataggactttgttgcagctaactgtgaatctccagggcctctcattgagcttgaaaaaataggtattcctgatcccgcctttccaccaaccagctgagggtatttgcctgaaatcgggacaatatctttaccagttacttcagaaaaatatttaccagttgtttcatttttcgattcacttaatccagccttctgtttgtaccagtcaagccatgataagtctgtttccacattttttgttcctacacgaaaagatatgttgtcagaagatatctttattgatgaactcgccagctcagaaagaactttatcgcgaattatctcatcagaatcatattggtcaaaaaagtctgcaatcggttttaggatacctactccttcttctcttcctatctgtatttgtttgacaaagttattgtgttttggaatatactttttttcctctttatccttgtcttttttgtcctttgaaagcacagaagaatacaacactactattgcataatctatcaaaaactgtgccgaagagtttcctgtaaaaccttttaattgaaaaggcttgtcagggcaaagcgttttctcctcactatcagatacagatattctctgataatttcctgcttcatctaatacaatgtgagccttgatcaatttttttctaaatcccggtgtaggctcaagtccgaaatttacagccaaatcataaaacgacttatacattactcctccttctgtctgatctgcttaaatacttccaaactgtcataatccggtatttttacaattccatttatcatatacgcgtgaaaatatgacggagcatacgattcagaattgttctcagctttcttaattgatgtcacaattggggtatgtctatgctgatcaaatatatcatacagcactatccctaagtccctgctttcctgtattggcgttctgctatcatccggctcatcaaaaaaacacatgtattctttcgaaccaaaatacggttgataaaagcatttgcctttcttcaatcgtctttcaaaatgaccgtaaaacttttcttcagctttatcatctttttctttatattcagctgtaggtatcattcgggcatgtacccgataatagacatccttcagcatatatgaatgtctctgtgttctttcagcatctacatcgatagaatctaattttttcgcatcggcctttacttttacctcatttctcataaaagttagagtattgattggattcataacatcaatctctgtaacctgatatctgaactctaccggcttacatagtatcgcttctaatatgcctctgactgctgacggcgtaggaatgtcataagtgctcctttccacctttgattctgtccgggtaaacagagcaaaatctccccagacatccaatacgatttcacgatttccattctcatctgaaactatcaaaatacaaaacctccttctttttcttctttgattaatccttcctttagatcgtatatatcaacgtcctcaactatataccagttaattcctatttcattgcctgtgtcgctgcttttagctgataaccgtctgcaatgcctgcctaaatattcatgtatttttttattaccatataatctcactgtcataacccttgattccttcatctctgatttggttatgcaataattttggaaggaaagctgctgatgtatctgctcaaattcctttcttttatatggaacaataacattcagctcttcattatcctctatcagtttataattctcatacagtttatgagtatccagctcttctatcgcttcagtaatctcacttttatccgaattttcttctgcatcccctgaatatatctctctataataatcagttattaaactattatcgtttgtatctagtccagatttttctatgatatttctggtaacaaagctttcatttctatatgtgattcccggatagccatttttaccattatcctccagtacaaatacatgaaattttccaatagtgtttccgtttctgttaatacgtcctgccgtctgaatgattgatggaagcggcgcacactccctcatccctaccggaaaatcaaggtctacacctgcctcgatacactgtgtagcagacacaaaacagctgagtccttttgaaatccgttcccttatagcccttatggtatctgatttatgctcagaacagagcgcagatgaaagaaggaaacaattctcctcaccatacttttctttaagcagtttaaacattttaagtgcttttccagtcgtattgaatacaaataactgctgatctaaatcatatatatctgccagctcctcatatgtagaaggctttttaacctctgatgaaactatcagctttctgatttttccatattctttataaaggtcatgaacattcggtattatctccgtaaaacataaatcattcaaattgcttcttaatctatagtcaggctgagtagctgtagacaaaagaactgtagtattaaaatactcaggcaaagcttcgagagacttcatagtcacatccaacagataagaaggaagtgtctgtgcctcatcaaatactatgacagaattggaaatattgtgaagctttctttcctttggagctgctccaccacaaagtgtctcaaaaaaactgactgacgtagttacgataatcggatagtcccacctgtctgaataaagcttgatttcttctggtatttctgactgactgtcctgttccagacaattttccttcccaaaaatatcacagtactcagaggcattctgttctataatagacaagtatggaagaactacaaatatccgtttctgaccatttcgttttgcctgctccaaagcaaacttgataagagcatgggtctttcctgttcctgtaggagccgtaagagtatatagtcctgtcggcaattcactgccagctttagcacagctgctatatactttatctcttaaaccattcaggcctgaatctgacctgccataacccttataatctcggtaatcatcaagtttttttaagagatcatttggattaagtttcttttcttctttataagcactgtaatcgatgtcgtcataaaatgccgctgtagatgaataatctgcatctacaagacacgaatatatcattctctcatatagcattttcgcctctggcaacatctcatcagaatttggaagtttttttcctgaaatgattttgatcagattattctctctcacatagtctgttatctgattcagctctttctcactggcgagagcgttttctttatgattatcagtaatggttttcttttctgaaaagtccgggtaagccatgtattcttcatcatccagcgctctatcagtgagctcaccatgaagatcactatggtggctttgaatagaattgcatattatctgagcaaaaaatgggtcgtttataatctcttcatcaccataactggcagtattccagtaatattctgccccaacagcagaatggtctatgccatgcacgattccagctaaaactccctggaatttttccgtatgctttcccagatcatgcagcaatccagcctgctctgctatctcgcttccaccaaatgacgatgcgaagaaagaagcaagatcacctgtatttttcagatgatctatcaggtattcatttttatctgctcttgtatgtgaaaaatactccataacccctccattaacaagataaccatgttcaaagacaacattttgtcttgctcttttctggccatgataaagtccgtataatggtgcaaattccaaaattgaaaagagccattggctcaaccttttagtataatgtaaatcgacgaaaataaacaatgtagctagaaggaggaatcaatggctcaactcaatattacaataaatcaggaaaaaattctacagttactttcagaaaatcgtgatgatgctttcgaagatttcatcaaagaacataactgacaaagcacccaaaagctgccaggcagggatccgtacagagcttcagaagatgcaaaaagtttgacaaccatttacaatggtccataacgcaatttacaacaagctgtcttgcatctttgaaaatattcatgtaaaataagcctcatgaataatgaatatgacctcatcgccctggatatggacgatacgctcctgaggagcgacaagacaatatctgaaaagacacttgcatcctttaaaaaagtccgcgaagccggaaaatacgttgtgatctgcaccgggcggccggtgtctgagattggcccgtacgataagcagtttacggatctgcagtattacatctgcgaaagcggcgccctggtttacgaccattttgcaaaaaaagttacggcccgccacactatagacgcttcagcgacagaagacatcattgacgtaataaaagacagggatgtcatggtacaggtcatggtaaatggcgcttcgatcgtcgaaggcgcgaaggttccgaacatgacacactattgcatgggcgtctacgttccactttacacggcggttgcaacgcacgttgacgacatcattcctgtgatccgtgagaactccggccagattgaaaaaataaacatttatcacacgagccgtgaagagagcatccgcacttctgaagcactcgctgcgagaaatctcccaatcgagcgaatttacgcagagaccgcttcactcgaactctctccgaagggcatacacaaaggtgttgggatttctgacctggccagattcttaaacattccaattgaaaaaactatcgcagtcggcgacgccgacaacgacatcccgatgcttaaggccgccggtctcgcactcgccgttggaaatgcgaatgaccacgcgaaagccgcagccgaccttatcatcccatcagccaacgacgacggctgtctctacgcgatcaacaagtatattcttggcgaataatctggagttattacatgcgactggataaatacattgcatcctgcactgggctgacgcgcaaagaggtaaagaagtccctgaaaaaaacgccggcatatgtagctggcgaaaaggtctcggctcctgagacgcaggtcgatataaagaccaaagtcgtatttctcggagagcatctgcactacagcgaatttacttacatacttatgaataaagccgccggatatgtctgcacgaaccgttcaggcaggaacccgacggtctttactttgcttcacgacgacatcaaggctaaggacctttttacggtcgggaggctcgacaaagatacgaccggacttcttcttataacgaatgacggcgatttttcacatcggatgatccatgccaaaaagcacgtcgacaagacatattttctgacggttgacaggaaaatccccgaatccgccatagagcaattcaaaaatggcgtcgatattggcgatgaagatctgaccaaaccggccactctcgaaattctctccgataccactgcgaacctgaccataagcgaaggccggtttcatcaggtaaaacgaatgatggaggcagtcggctgtacggtaactgcgcttaagcgcctgtcgatcgggccgttcacactcgacgaaaatctgagtgaaggcgagtatcgtcttttcaatgacgaagagatggattttgtgaaaaatgcaggcagataagaccgcgaaaaaatactggagtttaaaaatggagactcgaaatcaggcgaaagaagttggaaatactgacggcaataaccgcgaaatttttgaggatatgtcgattccgaaggcgctggcaactatggcggtgccgacgatcatcggacagatggttgttcttatttacaatctggctgacacatttttcataggaaggacaggcaatccgtacatgatcggagccgcttccctggtgcttccaatttttaacctgtcaaactcgatctcaaatttcgtaggagttggttcaggaactctggtttcgaggctgctcggagtacacaaggacaaggacgcgtcaaaagtaagcgctttcgctttttatctggcgataatagtaagtgccattttttcactttgcatttttatttttatggatccgcttcttaaggcactcggctccagcagccagacccacgtatttgcgagacagtacgcgttctgcgtcgttgtgctcggcggaattccgacgatcacacagctgactcttgcacagcttcttcgtgctgttggatgctctaagcaggcagggtttggcatgtcaatgggcggaatcttgaatgttttcctcgacccgcttttcatgtttgtgatccttccagagggaaatgaggtgctcggcgccggaatcgctacgatgctttccaatactgctgcgctgatctattttataattactgtagcacactattcccataccacggtcctgaggctgtctccccacgggcttccaaacaaggaacagataaaaggaataataagcgtcggagctccagcgtgcctttcaaatttcctgtttgatctgtctcagatgatgatcaaccgtctgatgtcgggctatggtgatatcgcactcgccgccatcggaatcgagctcaaggctgagagacttccactgaacgcaggaatcggtattgcgcaggcaatgctcccaatcgctgcctacaaccactcctctggaaattataagcgtatgcgcggaatcatcaatttttcaagatttgtgggtattgttattggtatcggatctgtcgttctctacgaaatctgcgctaagcagatcattggcattttcataaatgaacctcaaactataagctacggaaccagctttatcagaatccgctgccttgcgaccacgttcatgttcatcagttttcactacgtgtacgtttttcaggcaatgggctgcggcggccgcgcactcttctgcgccgttatgagacagctgttcttcaacatcccattcatgctgatcttcaacccgatatttggaatgtacggactcgtctgggctgagtttgcagcagacgtactgaccgtatttttctcatggcttttgtaccgctcttacgaccgcaaggccttacagccgctggagaagaagcgcgctcagagcttgtaaaaaaaaagatgcaccacccgaaaaatccctgcaaaccttgtatatgcaaggcctgcagggattaatgtctgctatttcaatttcagcggactctgctaattaatttagagaacaagcgaaggtgctgtatatgctcttccaagaagttcctgattcagcgcataaagtccctttgcatccgaaccgtagagctcgtattttttaatcatatcgtcagcgttcttctcttcctcgccctgctctttgacgaaccagtcaaggaactgcatcgtgcgataatcctttgcggcgtctgcggctgcatagatcgtgttgataagcgatgtgacatactgctcatgattgtaggcagccttgagtacagtgattatatctttcttctcgatgtttggcttgtcaatcgcgtcaaaagtaactttttccgcgttattgataagatactggcgcatcagcattgcatgatcgcgctcttcctgtgcctggatctcgtaccagttggcaaagccatcaagtccttcatcatcaaagaaattggcgaaatcaaggtaaagataagccgaataaaattccttgttcacctgagtgttaataagttcactgatttttttctctaacatagaatccttcctttctaaaaaatagttctgatatggatattatagcactgtttgcgaatgataaattatttgttttttcatttgtaaaaccatctgctgtaaaaagctgggatgtcggttcgctgacctgtatttattatcataattttaaaagacaaaaagccccggcacaaagccgggaccacattattctttattagtcttctaccgagtagttcggagcttcctttgtgatatggatgtcatgcgggtggctctctcttaagccggctgaagagatccttatgaacttagccttctcctggagatctttaatcgtaggagcgccattgtaacccattccgcttctgatgccgccgatcatctggaagatagtatcctcaacactgcccttgtaagctacacggccttcgacgccctcaggaacaagcttcttagcgccctcctggaagtaacggtccttagagccgttctccatagcggagatcgaacccatgcctctgtagaccttgtatttacggccctggtagagctctgtatctccaggcgcttcgtcacagcctgcaaaaagtgaacccatcatgcagacattgccgcctgctgccagtgcctttacgatatctcctgagaactggatacctccgtcagcgataaccggaacatcgtacttcttcgcaacgctgtagcagtccatgatagccgagatctgcggaacaccgataccggcgataatacgggtcgtacagatagagccaggtccgataccacacttgacagcatcggcacctgcctcgatcaggtgctttgcgccctcggctgtagcgatatttccagcgatgacctgaagatctggataagcatcctttatctcttttactgcgtgaatgatattcttcgaatcgccgtgagctgaatctacaacgacgcagtctaccttagccttgacgagagcttctgtacgctccatcatgttcgcagtgattccgacgcctgcgccacagacgaggcggccctgcttgtcctttgctgaattcgggtacttgatctgcttctctatatccttaatagtgataaggcccttgagccttccctgctcatctaccagaggaagcttctcttttctggctctgccgaggatcttcttggcttcttctagtgtaatgccctccggagctgtgatcaggttctcgcaggtcatgacttccttgataggtctgtcgaaattctcctcgaacttcaggtcacggttcgtgatgattccaactagctttccgtcgctctctgtgataggtacacctgaaatgcggtacttgtgcatcaggtcctcggcatccttaagtgtattgtcaggtgagagataaaatggatccgtgatgacgccattctctgatctcttgaccttatcgacctcttccgcctgttcctcaatagacatgttcttgtgaatgataccaatgccgccctgtctggccatcgcgatagccatgcggtgctctgtaactgtatccatagctgccgacatcagcggtacattcagggtgatgctcttcgtaagcctggtggtgagatctatcatattcggggtaacctccgaatactgaggcactagcagtacgtcatcaaatgtgattccttctccaataattgaagccattttatcctcgctttcttctaaaatatataaaaaattattttttctatactagcaaaaacgagtgactaagtcaagaagcccagtcactcattcaaacaatttcatctgaaaatatacataaaaaatgctgcatagcctgctgcaagagcggcccctgctaacacatctctcgcaaagtgcactccgccctttactctgacgacgcataggaatgctgcgataacaagcatcacaatcccaaaatacggcagatagtaaagatacatcatcgctatcatcgtgacagagaacgcgtgcctgcttggaaagctgtgtccctttttatccttcgggatgatcggagggatgccagtgacctcgtacggacgcctgaagtttaacctgtcacgcaggattgtctctacgataaagccactcgccggtatcagaagcacctttaaaatatctgccccaaagccatgttttacaagcacatatataagcaggaccacatacgctgcgtatgtgatggctgtaaggattttgtcggaatagatcagaaattttttcataaaaatatataaaaaatatcaggacttgacctcaagattccagtctttggccgcaagcgcctttttgacatcggagagaaacttcttccaggccttcggatgctcgacgaagtacttcggacagttcttgcctgtcacatcgtaatgtcttatgatgtcggtctctttaagattaaatctgtggcagagataggcgcagagacggatcagagaggcataggtcttcggctcgaacctgccgtcctttgcggcgtgacagcactcgatagagagcgtgtcataatttctgttgttcgaagcgtaggctatctccttcgtcggtacgcactggattatctctccatcgagtcctatgacaaaatggctgctggcatgcgtccggtggctggttttcaagccctcgaaatagttcctgttgtccatagcggtagcgccagggttagcggtgtagtgaactacgatgccttttatcttttttaatttgatctgcggcctcgagtacttgttcggcgtcaatagatcgacctcgatacttgtcgcaggctttgtggccgcgagttctgctttgcgcgctgctttagctttcttcgctgcctctcttttctggcagcttataacaagaacacagactaagacgactactgccgccgcagctatgataagcaggatattcctgcgattaaaaaaatccttctttgtttttcttcgggaaactaatcgactcatagagctaatattagaacttcaaccattaaaagtaaatagttctgtcatctgtttgtcaaatttgtcgtcaggctcatatctcttgacaagatacttcagataatcctcatcagtcgtgtcatctcctgcaggagcctcaacagggacatcacttaatacgtcctgcatcttctggtagagatcagcaggcttaagatctgcaggaaagcctaaagaaagcctgcggtctaaaagcccgcaggcgtaataatactcgtagttgccaactatgactgatgcatggtcacagaccttcctgtcaacgctctggcgtgccaggagttctatcatttgtcttctccgtccagtctcgaaaagaacgcatgcttaacagtgtcgatgtctgtcttcatagcaaatgccatctcttcgaaaagtctctgtgctgctacatccatgactctctcatcagagctcatgactttctttccggctgccagtctcttcttctgatgaagatagatactcttcactacagaagccagctgcttcggatcgaacagcgctatcttctccttaaacttctcggtccgggcgcggttgccctcttcctttacgacatcgagctggtttacttcattgagaagtgtcttgaattcatcagagctcttcacatcgcggatcctggtcttggagtctaccggtgtgagtacagatgcacccttgtcaaaaacaggctcaagactgtagtacattctctctgagccctttccgtgtaatgccttctcagaaacatcctttacctgacatacacccgatgtctcatgcatgatataatcaccgactttgtacatgttacctcctgttcctatctccttacccgagtaattatatcacatttttttcaaatttgtaatagtaaatagtgtatgttaacacacctcaactataattgcaagcccttttttccgcaaaacaaggcacaaaaccgctgcagtttcgtgccttgttttttttaagatacatcctctttcaatggttctgcatcccgtctttccttgtagtgatgtgcatcctcgagcatcatatccttgactttcatgagtctgacctgtgacgatctctcgttttcgtcgagcttcatcgtgatgtagcggatattctcctcggtctgcggtatcagtacatgctccagggcgtttacacggcgcctggtcttctcaatctctgcggccatcagctgacatgacttctcgctttccgcgagctttaaaagctttggcaaaagcttcgagagccttccgactccctcgtctaagtctgctgatgtaaaagcatagccgtaaggataaaagtcgctcttgtcgcttccacggaagtgggtgtcgaatacaggtatctcgacactcatgacgtttctcgtcgaaacatctacggaagcctcctgcttaggtgccatgaaagccacggacacagcctctttggacatctggctgccagctaagacgaagctcttgtttgcctctttgatctcggcctcgacctcctcacggaggactttgtcctgtcttacaaggtcaaggaaacgtctcatcagctcgtctcttttatcctttaaaagcttgtgtcccttaagcgccgtctggagttttttcttctggcgggtgagctccattcgtgtaggatttacatttgaagctgccataacaaacctccttcagatgccttaagactttttctcgtagtactcgtcgaggaactcttccttgatacgtttaagctcagtacgagggaggatacgcagaaggtcccagccaaggtccaatgtctcttcgatcgaacggtctgtattgtagccctggttgacatatttctcctcgaactcatcggcaaatttcgcatagagtttatcgatatcagtaagagctgcttcaccaaggatgatcatcagctccttggcatttttgccacgggcataagctgcgaaaagctggttcatagtgttcgcatggtctgctctggtctttccctcgccgatacctttatccttaagtctggaaagtgacggaagaacatcgataggcggctggattcccttctgatagagctcacgtgaaaggatgatctgtccctctgtaatgtatccagtcagatccgggataggatgtgtcttatcatcctcaggcattgtgaggatagggatcatcgtgatagaacccttcctgcccttctgtcttccggctctctcatagattgaagcgaggtcggtgtacatgtagcccgggtatccacgacgcccaggaacctcttttcgtgctgctgagatctcacggagcgcatcggcgtagttcgtgatatctgtcatgataacgagcacgtgcatatttttctcaaatgccagatactcagctgctgtaagtgccattcgaggcgttgcgatacgctctactgccgggtcatttgcgaggtttacgaagaggactgtcctgtcgatagctcccgactcggtaaatgactgctggaagaagtgcgcttcctcgaatgtgatacccatagctgcgaatacaacggcgaacggctcatctgtgccgcgaaccttggcctgacgggcaatctgtgcggccagctgtgaatgcggaagacctgaagctgagaaaatagggagcttctgtccacgtacaagagtgttcagtccgtcgatagccgagatacctgtctcaatgaactcctccgggtaagctcgcgctgccgggttcatcgggaggccgttgatatcacgtctctcgtccggaagtatctccgggccgccatctataggtctgccgagtccgtcgaatacacggccgagcatatcggatgaaactccaagctccatcgggcgtccgagaaaacggacttttgatgtatcgaggtttatacctgtggacggctcgaagagctgtaccagggcatttccaccatcgatctcaaggaccttgcagcggcgggtctcaccgttttcaagctcaatttctccaagttcatcatatgtaacaccgctgacgcctcttacaagcatcagaggtccggagacttcctgtatcgttctatattctctaggcattagaagtcctcctttttagtttttgcttcactgatctctttgtcaagttcacccaggactgaatcgtatttttctttgatgtctttctcaggcgtgtacttgaaacgtccgatctcctcgcggacaggaagtcccagaagcgatttgagcatcgcaccttcgtccagtgcctccactgacttgtcatagtaggaaagaacgagctccatcatcaggaactgcttctttaatgacgaatatgtatcgatctcatggaacgcatcctggtgcaggaaatcctcacggatagagcgcgcagcttccatcttgagtctgtcaggagctgagagcgcatccataccgacgagctgtaccatctcgttcagcttgttctcgtccgaaaggatgctcatcatctgtccacggagcttcatccagtcctcatcgacattggcatcgaaccatttgccaaggctgtcgaggtatagtgaatatgatgtcagccagttgatggctgggaaatgtctctggtaagcgaggtttgaatcgagtgaccagaatacctttacaatacgaagcgttgcctgagtgacaggctctgaaatatcaccacctgcaggggaaacagctccgataactgaaagggctccctctctgtcatcgcttccgagacatttgacacgtccggctctctcgtagaactgtgcaagacggcttcccaggtatgccgggtaaccttcctcaccaggcatctcctcgagacgtcctgacatctcacgcaatgcctcagcccaacggcttgtagagtcggccatcagtgctactgagtatcccatgtctctgaagtactctgcgatcgtaatacctgtgtagatagaagcctcacgggctgcaacaggcatatccgatgtatttgcgataagaacggtcctctccatcagagagtgtcccgtcttcgggtccttcaatgtagggaactcatttaaaacatcggtcatctcatttccacgctcgccgcagccgatgtaaacaactatgtctgcatctgcccattttgcaagctggtgctgaacgaccgtctttcctgaaccgaaaggtcctggaactgcggctacaccgccttttgctatcgggaagagtgtatcaattactctctgtcctgtgataagaggtctgtctggtgagagcttctggttgtatggtctctcacgacgtaccggccatttctgaagcatcgaaactgtcacatcgcccttatcagtcgtaatagtggctactgtatctgtaaccttgtagtcgccctcttcgatcgattttatcgttccatttactccgtagggaaccatgatcctctgagtgactaccggagtctctgcaacagttccaatgatatcacctgcgctgactttatctccggcgtttgccgtcgggacaaaatgccataccttgtctctcggaagtgccggaacttcgacaccacgctgcaggttattgctgtgtgttacctccatgatctcctcgagaggtctctcgattccatcgtagatatttccgataaggccaggtccgagctcaacgctcattggctctccggtggattctaccggttctcccggcccaagtccggaagtctcctcatatacctgtatggatgcctgatcaccgtgcatctcgatgatctctccgatgaggcgctgctttgatacacgcaccacatcgaacatgttcgcttcgcgcatcccctctgctatgacaagaggcccggccactttttttatcgtacctaaactcatgtcttctccttaatcgttgccaaaaataatatccgatccaaccgcctgctctacgctcttctttacgagtgccagcccttttccggtatttccggaagctcccggaatcaatataattgccggaagcggcgaagcgctgtattctgagatagtcttctcaatcttttctgcaagagcctctgtgatatagattactgcggtcttatcgtctgccagtgcatgaagcgtcttctccgcttcttcgggatctgtgacaggatatgtatcgaggcccaaagctttgaagccatatatcgagtcccagtcacccattactgcgatcttatacatatgtcctgcttatcctttccctgatcatctgatccggaagatcattctcttttccggtcaggatcatcctgactgaatcgatctcgctctcccgggctaagatgtaagccgcaagaggccctattgtaaacggatgtgccttctcaggcctgatcgaatccatcagagcatctttgcaccacttttcaaatgcgaaaaatgacttcttcagcgaatccacggcatctttgtactcagtgttttcgaggtaatcgtagatatcgtcaacagtcagagaagctgcctctgcaaggcgcttgatatcgagtgtgtcacactctgcaagcgcttctgtgaaaaattcgaggtcttttttcgcatgagcgcctctgactgcagtcttaatgtccgccagtgctacggtcagttcaccgtaacggcgaatcagcgcatttttattcttcgtcgaagcttttttgatctcgtcgaggcaggctctgtcgatgataatgtcgcagagctgtccatctctgtagtgaagcagagtgtcaagtgccttcttacctgctttgctcatggattcaggaagtgaagtaaaatcaccctcctttactgcatccctgatcttctcaggctctatcgtgccaccattcacatagatatctgcaaaagcctttcctgcaaatgtctctttgaccgcagcctttaaattgtgaaaatccttcttcagaaggaacacatcaaaagcgtgcggatcatcgaccatctcgaggactgttctgtatgtcttctcctcttcataggataagacatcgagcggatcctgcttctcagagttctcacggcctttccagcccttctccgacagaagcgccatatcctcattcacagactttgctgatatcagctgctccaaaaaggcgtcatttaaaagtgtaagctctttggctctgatcctggcaaccgcataggtgtactgtttttcagacattagtacctcctttcgcggttaaaataaaatgtcctttacaatgtctgtgagctcatcgttctttgaagcaaaaagctcgtcaatagaaagattctcggctgatccctcgtaagcaagtatcacgccgtggtctatatcagctgttttgtcagaagcctttaaagtctttccgtcaggaagctttgcgctgactttctctgtaaaatcagccgggagcctgctcttatcatcttttccgatggacaggactccctcgccctgatcagcattttttatgataagcttctccaaaaatgctgcatattcagaggatggcatgtcatagagcttctgctttgcctcatcgagcgtctcctttataatctcctgcttggcttctaagactgcgcgcttttttatcatgtcggcaccatctgccgcgcgctgcctgatctgctttacagtaagatctgctctgtcatttatctccttctctgctgcagcagtctctttctcagctgcggcagaaaattcatctgccttatcgcgtccgtttttaagtatctctgcagtggtctgatcagactcctcttttatctcatttatgatcttgtcaagacctgtcatatctgtactcctttctttaagaggaagtcattctcgttaagttcacgcatcgcctatggctcgcgttcactaatctcgaatgacgacctcgcttgtgactcgaactacggcttcgccttgttctcgtctacaagctttcggtcatttcagtgcagatactccgaagattgaaagaattgaaacgaggagtgcgaggatagcataggtctcaaccattgccgggaagatcatagctttaccaaactgatcaggcttctttgctacaaggccgatagcagaaactgctgcgtttgcctggcagatagctgagataagaccaactacagccattggaaggcaggcacagaagtaaagcattcccttgtgtacgctcatgtctgccgaaccacccatgataccgatgtttgtaagagtgatgaatgcgatcagcagtccgtatataccctgtgtaccaggaagaagctgaaggataagcaccttagagaaaagtgacggatcctccgttacgactcctgctgctgcctgtccggctttacctacaccgattgctgaacctgcacctgcaagaagtgctgataatgctgcaccgagcagcgcccaaactgttcccatactcataagtcagatatcctccttgattcttatgtattttgttttctggtcaaacgcctcaaacggacgtccgccaccgttgtaaaatttaccaaagaactccacgtactggagtctgttggtatgtacgtatgcgccaagcgcattgatagccatgttcaggatatggccgatgataaatatcaccgcgtaaaggatcactcccaggactatcggaagagatccgcctaccattcctgccatcgtgttaaatacagatgagataaccgaggtcgcaagtccaagtgccagaagtctcgaataggagagcacatctgacaggtaacctgtgatgccgtatgcaccgtagagacctttcgcaagtctctttccccagttcctcgattctcgtcccgagaaaagtacgacgccgacaaagccgataagtgttatccagatgctgactttctttactgttgctccaagtgtaaatgaaagcccaagcattcctgtgatcattggaaggcagagcagaagaactacgcagcctcctacgaacatataccagaaaagtccatcgtagatggcatcgagcacgtgtccgttcttaatatcctgatacatcaggataccaagtcctgtaaacagatggataagacctactgcaaagcagaacgtaagcatctttatcgggtcacttaacgggttaaaccagataggtggaagaagcttatcagcggcagccttcggcatatgcccgaatgtctggctcactgaagagaccacatctccgaagaaacttccgaagataaaaccaactatcgtagtagcaactccacagaagaaaaacatctggaatgtctttctggtccctggctccatgttcttaaacttcttcaggataatcccgcaggccagtgcgataatgatgccgtatgcggcatcagagagcataagtccgaagaagaaatagtagaacactgccacagccatcgacggatcgatctcgccctttccaggaagtgagtagctagagataactccctcaacaggagctgcgaaagcgttgttcttaagctttacaggaacatcctcgtcctccgatggatcagagaagtcgcaggcgagttcaaatctttcgttcaaggccttctcaagtctcggaacgtcctctgcggctgcataaccagtgattatcacaacgtgatcagactggttgatacttccgatgacatcgtatttgtcttttctcatctggaaataatccctgatgagctcgatgtcatgtctgctcgaagcgaaatccgcgatctccgaaagaatctgcttccttctggccgactttctggcggtctcggaatctatcctctctatggcctccgccggtgtaagcgattttccgtccgaatccttcaccacctgtgaaggtgccttcgtgaagttcatcctgtggagaacttccttcagttcatccgcattgtcatttccagtcacaaacataactgccgtgtactggtctgacttcgaaataatctccacatcgaccttatcggatactttgcagagcataccgagagtcaggtaaatatcctcaggtgagaggtctcccggaagagtcccgataaaggccttcgtcttctctgtccctgagaaatcgagcgggagatcaaatccttcccacggaaccagtgcttccctgtccatctgatccttcgggatctgggaaataagttctagattttccttgtagagagaatttatcttggaaataactgcgaggatctgattcttcctgtcgagatctttttcaaaatcctgaagagatactacctcgcggcctgcaaatgcagaaaggagcgaacttttttcgggtgcagccttgtttaagatctcaagtgcatcatctgcctgcttgatctgttttaacaaaagctgcttctgcgacgatacgtcgattttcttgtaaatgccatcatctggcacatctgtatctatctctgtggtgccctgcctctgcaggaactgaagtaactgctttctgtcccgccgcatcgctataagcgtcatgcgtttcataggcattacagccatgtatacccctcctttcctatgtagtcagagctgctatcaccttcgcgacagcctcttcctttttcttcgcaccgtcctcaagcagatcatccttcacggtcttaccgtcgaggcgcgccctttcgagaacgcggtcagactcctctgtcgcagctttaactgcttcttcggccttcgcccttgcctcagaaagtcttctgcttctctgctccttagcctccgacttcgcctgattcaacagctcaccggcctgtttcttcgctgcttcagagctgtcaaccagatcagtttctgcttttctgatgcggtcgataacttccttcgccaaataacatcacctatccttcccttttacaacccctgttcatccggtttccgagtacaggcagtatgtattagaaacaaattacaacaaagatattgtacccgattgagaattcatatacaagtataaaatatagaaaatgcacaaatattacgtttaatttacgtaaaatttgtgcatttagttagtataaatatgaagactattgaactgggtccgtaaaaataacaactataacactgtttcataatccaacgctcattcaatggaaatcttcagcagcagattctacgattataatcctatacactttcgaataacaggaatctttgagatcacaaagcagataagagcagagattgagaatactgccactgcccctgcggttctccagcagatgctgcctgtgtctatatgcaaatgctcaggaatcatttcaaccagatagaagtgaaccaggtagatgccgaaggtgtatttcgatagagacatgcagattttatcgaatcgctccagtcttttccaccggtcacaggcatagcggaaaaacacaaagatacccacggcctgcatgacagcaggaaaatttacatatcctttaaaagtttctacaatctttccggcaggcagggacagcagattggtgccctcaaactgaataaaccagcccagaagaccgatgacatagaacagatatctcgtttttttcttaaggtcgaaattactgatcagatatccgatcaggacatagatcatatatcctcctgccacaggaatctgtaaacctttattgtattgaagtcctgtcagagtaaataccgttggcaaaagagatgtgaagataaacgtaaggcctgcaatcagtaaaaatacagtctgtctgtacttcttttcaactgccgacagcaaggggaaggacatatagactgcaaagagcggaataaagaaccagtatattccgacatacttcgtagttaaaacgccactgattgtatcacgaaggccgtcatgcggccaatgccagtagaaataacggtacaaaacagaaatgatactccagaccaggaaggggatcacagttcgctgtatacgcttcttaaagaaaataccggtagaatacctgtctctgtagttcatcagcgttgcgccggagatcataaagaaaaccggtaccggccagtagaaaaatgtttccagaaagtttgaagtgtaccagagcctgccgctcggaaaggtccagaacacaccgttacagtgcaggataataacccccaggcatgcacacacatttgcaactgcgatccaattctttttttctgacatgattccctcttaatcttctaaggtgttcccgtttttcatttacacatatcattcgcgcttattattctagattctcactaaataaaatcggagcggatggtattgtagatattttcagtcatcgacggattgtgcctggtgccccgctcgaagctgcacaaaatctctatctgcttctctttgtcgggcacttttttcccggtcgcatattctgtgacatcgaatatcatcagaagttctgtgtagaaaatagacagaagcgtctgtctctgccagaaatagctctcgtaagccagaggatagagctcaagcatcgtatagtaaaaatagctgcggtgtcttagggcaaatgacggctcttcggcatagagcttcagaagctcctcctcaagccatttgtcggcctcactctcgtagagcggcccaaacagttttttgtactttcggataaggttccagagcaggttatttctggagaagagaaagccgtagtctataaaatttacaatgcagcggtccattaaggagatcggaaaaaattcgtacccgctcccgtctaaagcggcgcagcttccccagtcatttttatcgaagcttaatgtgatttctgttacagaatcgcgggtcgcgttgctcaaatacctggcgtttgtcgcggctgcgtatgcatagacagccccaaagacaagaggcagttcatgtgacgtatctgctatggcatctaaaagtttttttctctcggcaagcagaaaatcaagaaatggctcgtctctgttctcgatgatgtaatatgattcgagatcgtctcctcccgggataagcctgatctcgtccggatgctcacagaacgccttcgccgccacatagcacgacaagagcagagtgacctcacgcctgtctccaaggtctaagacctggtgcgggaactgcctgcagacgagcggcatcaggtcctctctgccctgcttctgaaggccacagagcttgtctttagccagaaaaggacagctgccgaaatttttcctgatctggcggttgtcatcatttgtgcccttgatatgggatcttaccctttcgccagacttcccgggttctttttttataacagaccaggtatcctcgtccacaggtatagtccaaccgtggcagcagtgctgcggacagttccccatcaggcacgaatagtgtctggcaaattcaactatgcttgtcttcattcctgttctttggcgcagccggcagcgtagtccttgatgtgttcagccatgactctggccgacggcgagaggaaatccttcgaaagacacacaagaccgagtgtcctgtagtgtctcggatacagaggatagacctcaacatcgtccggagcgtttataagtccgagcttaggctcgagaaggattccagtcctgcactgtaccagggcgatagccgactggtcatccagaacgtgacaattggcacgaacttcgatattgtactcctctaagtacttgatgatatcgatatcgcagctgtcctgctggataacaaatgatttgtccttcaagtccgccggctttacagacttcgtattggccggcaggaagttcttcggagcaacagccatcagatcgtcctcgtacagcggaatgaacggaagtccgtccgaagccgactcagagatgatgcctatatcgatggttccgtttcttacccattcgacaacgtcgttgtacgagccctgatagagctcgattgaaatctgcggatgctccttctcgaatgtgctgataatgtccggaatccatgccaggcagacagaatttacagttccaaggtttacgtgtccggctccaagtcccttcatctgtgaaatagcctgctttaagttctgctctgctgctacgatcctctggatatatgggttaagctcctcacctgcgctcgagagcttaaccccgttctttccgcggataaagagggcaaagcctatctcctcttccattgaggaaatggagtggctgatagctgaaggtgtcagatgcagtacctgcgccgcctttgcgaacgacccctgctcgaggatcgtttgaaaaatttcgtaagataatagtgtcaagtttctttttcctttcccagctgtctacttttacaatgccatttggcacatatccaatgaaattaattcattcgataattgaaaaaatagaactttactttatacgattatcttagtacaataacaatgaacagtcaatgttaagtaatcttttttctttttccaactaagaagcaccgcagtttttcactgcggtgcttctttttttcaattcttttctgtgatttcctgctctgccctgttctttactatcgaattggacggtatcacgcctctgatcatgtttaatggatagatgttcgtgtgtggcccgactacactgcccggatttaagaccgtattgcagccgacctcgacataatctccgagaagagctccgatttttcttaagcctgtctcgatcttctcgccggtcgaaaaatccttgatgactacatttgtgcggtcgctcttgatattactggtgatagagcctgctcccatatgagcgtggaaaccaagtacggaatctccgacgtaattgtagtgagggacctctacgttgtcgaaaattatgtcgttcttgatctcggtcgaatttccaactacgcagtcggctccgattatcgcattgcctctgatgaaagcacctggacgcacttcagtgccaggtcctatgatgcacggtcctatgatcgtattcgtggcctcatttacaaacttcgctgtctttgcgatgtagataaagtcacctctgtcctcatagacttctctatcaagcttcggaccgatctctttgatgaaatcgccaatctttggcaggacctcccacggatactcgcagtcctttaaaacaggagctgcgatactgtgtgtcaggtcgtacatatcctttgtcttacagttcattgctttgtctccttcgtctgagttttctctgctgtcccctgtctgttcttccctgtgctcttctcgcgtgccattccgccatacgagccttttttataaaactgtgaagcgtagttgaagcatttcgacaggacttctccattgttctcgcctttgacacggtcggtgtacttggtgataaaagccgtaagcttcgtcatgtactcatcttccccgatcttcgcgtcggcgacttccgaaagtcctttctcccagcttgcggtaagaaccggatcgagcatcggcctgatcgaatagccgaccacatagtagatcatctcgccggtaagcgtcggagtgatgacctgagtcttcttattaagcgagaggtacttgttctttaccagcttttccagaatacctgcccgcgtcgcagaagtgccgatgccgttcgatttgatctgctctctgagctcgtcgtcctctataagtgagccggcattctccatcgcaaggatcatcgaaccggacgtgtatctcttcggaggtgaggtctcgccctcttttatcgaaagcgccctgatctttatcttatcgcccttcttaatctcagcaggcagtttgtttccggctgtcgcatcatttttatctttaaaaaatgagtagtgcattacggcgaggtagccctctttgtccagatatctctcgtttgaaaaaaaatgctcactgccattcacagcttcgacagatgtcttcttgtagacagcctgcggataaaaaatcgccagaaaccttctcgcgatcgtctcatagactctctgctctgtggcgttcaaaccttttaatgctccgagcccctggccggtcggaattatggcatagtggtcagttatctttttgtcgtcggtgtaacgggtactgccgatttttttgtaagagccgctcgcgaagatctgatccgtaaaaggcttaaaaatcggaagctgcgacaggccgcggatatttttgtcgatctccctggcgatcgcagatgacagcactctggcatcagttctagggtatgtcacgagttttttctcgtagagtgactggattatctgaagcgtctgatccggactgatcttaaaaaatttcgaggcgtcattctggatctcggctaagttgtagagaagcggcgggttcttcttctcgtccttcctgtggactgatgtcactgtaagctcgatatcacagccagccaggtctttatgaaaaagctcatctgacccgcttataagccttgcgagttctgccgcgtcatttctctgtttaaagccattgtccttgtagagaagaggcgagttgaaatatttcgagccctttaccgccttccactcaaacgaaatgccatttttctcatcggaatcagtctgagccagaagcctgtagaatggcgtctttacgaactgcctgatctcgatctcacgtcggactaccattccaagtacacaggtcatgacacggccgaccgctatgacctgccgcttcgaattcaggaaggacgccatctgattgccatattttaaggtcagaagccttgaaaaattgatgcccatcaggtagtcttccctggccctcaggtaggctgcgtcagagaggctgtcgtaatcgctctcaggctttgcctccctgatccctctctttatctcctcgtcggtctgcgagtcgatccagacgcggcgctcgtccttgtcgtgcactcccgcctgatttctgacgagacggtaaatgtactctccctctcttccactatcggtgcagacatagatgcggctgacatcgtctctggtgaggagccttgagacaatatcgtactgcttttttacaccgggtatcacttcgtataaaaaattatccgggataaaaggaagcgagctcatcgaccatttcttcagggccggatcgtacacctcaggatagctcatcgttacgagatggcctacgcaccaggtcacaacagtcttatcaccctcgagatagccgtcgtgctttgtcaggttgtcattaaaaacggccgcgaaagctctcgcgaccattggtttttctgctataaaaagactcttccccatattcatattctccttttgtgtttacatgccgccggggaaatctcccaggccggataaaagtcaaacttattacttggcttcgatatagccctgtgctttcaaaagttctgcgcagagaactgctccacctgcagcaccacgcatagtgttgtgtgaaaggcctacaaacttccagtcgaagatcgaatcctcgcgaagacgtccgacagagattcccataccgtgctcaaaatttacatcgagcttaacctgtggtctgtcatcctcttccatgtagcggatgaactgcttaggagccgatggcaggttgagcttctgcggaagacctgagtatgaagtcatcgcatcgataagatcctgctttgtaggattgtccttgaagttaacaaatacagtagctgtgtgtccatagaggataggtactctgatgcactgtgaagtgatcttcatgcagtcagacggaacgatctttccgtcctctaccctgccccagatcttaagaggctccttctctgacttctcttcctcaccactgatgaacggaataatgtttccctccatctccggccagtccttaaaagtcttgccagctcctgaaatagcctggtaagtggaaactatagcttcagtaggatggaacggcatccatgctgtaagcacaggtgcgtaggactgaatagagcagttcggctttacggcgataaagcctctcttcgtgccaagtctcttcttctgagcctcgataacttcaaaatgctcagggtttatctctggaactaccatagggacatcatctgtccagcggtgagcagagttatttgaaactacaggagtctcagtctttgcgtactcttcctcgatggctttgatctcatcctttttcatctgtacagctgagaaacagaagtcgacatcctttactacgtcctcgacatcagttacatccttaacgacaatatccttaacgttctcagggatcggtgtatccatcttccagcgatccttgacacactcgtaatatgtctttccggcgcttctcggagatgcagcgatctcctttacctcaaaccagggatgattttcaaggatagtgataaaacgctgtcccaccattcccgtaccaccgagaacagctacttttaacttctcactcatttttcgtaatcctttctttttccagtcgttttatttgttttgtgctgcaagcacaatatccttaaggtcaaggcacttgtccttgactcttggactcgtattaggatttccaaggagactcgagatcagcttggcagctgtgccgtactccttgaaatgtatggccatatttgcaagcagaaactccacagcgataggattgagtcccgactctgtgctgtatgctttggtgtagccctcgtatgcctgtctgtagaagccctcatactcctcttcgtactgctgctttctgccgacttcctctgccttggactcagacatctccttgatctggtcacgtctgatccaggcgatacgaaggcagataagtgacttctcggaaagtctcgcatgcttcgccatggctgagacaagagccagcttgtaacggtccactgcctcatccggagtgtaaatctcaggtacatcgtcagatacaggtttgaagttcttgcagaccgcttcctttatccacctcatctgagtagctgagagatgtgcaaaatatttgtttaaagctgcatatccgcagttcgggcagacgataacctcatactttaaaacatcgatattgtgataatgagggcgggtatcctgatcggcacctacgcgctttaccttcgcactctttatctgaaggaccttgaatttgtggtcacagatagggcactgcactgacttctgcagtaccatgtccttctcctcgagatccgtaatggacttctttacaggctgtgtaccatcctctttcttcctggtgccgtcatcagtgatatccagttttccatcagatttaatgccgaacttttccagtcctgacaacagattcatttgcatacctccttaattcgatttcggcagtttgaatgagctcttcagggaaacaatcctgttaaatacaggctctccttccttcgaatccttgcagtctgtggtgaagaatccgtttcttacgaactgaaaactctgatatggtctggcgtccttaacgcaggcctcaatgcaggcatttttcacaacaagtgaattaggatttaagttcaggctgccatcttcgttgtagacgcccttctcctcatcgataacattctcgtagagtctgacaggagccttaaagcagctgctctggtcaacccagtggatagttcccttgactttcctgccgtcaggagaatttccgcccctcgaagcagggtcataggtcgcatgtattcttattatatcaccattttcatctttgtcgagcccggtgcacttgacaaaataggcattcataagtcttacttcgttgcctgggaacatacggaaatacttcttcacaggcacttccatgaagtcgcttctctctatataaagatgcttcgaaaatgtaacttctctggtgccaagctcctcgttctcaacgttatttgtaacggtaagcttctctgtctggccatccggatagttgtcgatgacgagctcaagaggatctaagactgccatgactctcggaacttttttcttcaggtcctctctgatgcagtactcaagcatcgggtactcagctgtggaatttgccttgctgattccagagaggtcgataaatttctttatagattccggtgtatatcctctgcggcgaagtccggccagtgaaacgagcctcgggtcgtcccatccgtctacgattccgtcctctacgagttttttgatatagcgctttcctgttacgacattcttcagatagagcttcgcaaactcgatctgtcttggaggattcgggaattcacactcgcgtacaacccagtcgtagagaggtctgtggtcctcgaactcgagcgtgcagagtgaatgtgtgatgccctcgatcgcatcctcgatcgggtgtgcaaaatcgtacatcgggtagatgcaccacttgtctccctgtctctcatgtgccatatgtgctaccctgtaaataatcgggtcacgcatatttatgttaggagatgacatatcgatcttcgcgcggattaccatctcgccgtcagcatatttgccattcttcatatcttcgaagatctgcagggactcctctatcggcctgtcggaattcgggtctttcctgcccggctctgtaagcgtgcccctgtactcacggatctggtctgctgtcaggtctgaagcgtaggctttgcccttctttataagctttacagcgagctcatacatctggtcaaagtagtcagaagcatacattgtcttctcccacttgacgccgagccacctgatatcctcctggattgcttccgcgaactctgacttctccttcgtcgggttcgtatcatcgaatctcatatgaaattcaccgttgtactcctgagcgataccataatttaaaaggatactcttcgcatgtcctatatgtaaaaagccgtttggctcgggcgggaaacgtgtgactacatggtcgtatcgtccgcttgccaggtccttgtcaatttcttcttcgataaagtttttcaatgtgtgcctccaaaaatattctatcggggaggaggacacacaggtacagctcggggcacgctttcgctccgtatgagacgagtcagcttctaagttcacttcgttcactaagtgcgctgacatgcgtcgcacgtaggcgaccaaagaacggtcgccaagtgctcatcgcgaaacggtgcataagcggcaaaagtactgccgctaagcaccggcgtctcataagggcccctcgtctgtatctgtgtgtcctctcccctcctttacaacagttcgttcgtcacactatgaaatacatttctcaatgtgcgacgtctagctggtatttttttacaatccaattatcttatttcacgtgtgtatgtgtgaaaaggtggtcggagcagtactcatagtggccgttgcacttcgtgcagtagcggaaatcgagctccgggtttgtaagctccgtgcggccacagatgcagcatttgtgctttgcgacctgcctgccgtgtgcgttccgctcatttggctggttctggtttctgccatagccgccccatgccgaactgctgctccatggattgttgtaatcacgtctgaaattgcgctgtcgcctgtagttgccaaggcctctccagcccctggtctcgaggtagtaaatgacaaagttcgcaagagacgcggcgatagccacgataagagggatcccggctgtccctgcagagattgcgtttccgatatctatcagaaggaaaacagcatagagcactgccatccacttcatctttacagggatgaagaaatagaggagcaccttctcctccgggaacgtcagggcaaatgccaggaaaatactcatgttgatatagttcgttgaaaaatagctgccgagcccgataatattccacgtaccgccgatcaggcacgagatgatgtagagtaaaaatgcaccgatcagtgtaagtatcatgcctccgaaaatatagacgttgaatcgaaacgtaccccagactctctcgagcgctgtgccgagctgccagtaaaatatgatcatgatgatcgcaaacagtatgttctgctcaggcgggatcatgacccaggtgattatcctccagatctgcccgtggcagatatagtacggctcaagcgtcataaatgacagcagatccgcatgagtgaaactcgagatcgcataaaaaatatagcccagaatgtatccgccgatcagataattcatcagtctcggtatcgcatactttccgagcttacgttccattttatcaagcataaaaatcatcttccttttttaagtaaaaaaatcagtagaaatattttatcactatactgctgtattcgcaaataaaaaatgaggcgcttttcgcgccccatcttatttttttatgatgcctcagacatttctttttcttctgatttttcaggagcctgcggtactttttcttccttaaattccttggtctctgcctcttcttctctctttaagtttttaaaagcagatgaaagcatcagtttgatacggttcagctggtttacttctgaagcgcccggatcgtagtcgatggccgctatatttgctcccggatttaaagtacgtatcttcttgataacgccctttccaactatgtggttcggaaggcagccaaacggctggatgcagacgatattctttataccgtcatccataagctcgagcatctcacctgtgaggaaccagccttcaccggtctggtttccgagagaaacgaccttctctgcacgctttgccgtgtcgtcgatatatgcgggagccgtaaagtgctctgactcgtcaaaagcttttcttgcggcgcttctgagccactcgaagaatttgatcccgaggtttgcagtgattaccgacttcttaggagttccaaggtttttattcttgaacctctcattgataaagcagtaaagcaggaaatctgtaagatcaggtactactgcctctgctccctctgattcgaggagatcagccaggtggttgttcgcaactaccgagtactttaccatgatctcgcctacgattccgactctcggcttcttctcgtcagtgatcggaaggttgtcgaagtcgtgaatgatatcgcggcacatctgtttatatttactgtgagagagcatcttcggctgcgaaaggaagtcgatcactctcttcttccacttctcatagagggcatttgcagaacccttgaccttctcataaggtctcattctgtaaaggcacttcaggaaaatatcaccgaactcgaggccatagagaccgtgctgaatcaccttcggtccaagcttgaagccaggatttttctcgaggccgacaagattcaatgagattaccggaatctttccataacctgcattggcaagtgcccttctgatgaaactgatgtagttcgatgcacggcagccgcctccggtctgtgtgataagaagcgctgttctgtcgaggtcatatttcccggatttaagggctgctataaactgtcctacaacgaggattgacgggtagcaggcatcgttatttacaaatctggttccgctgtctacgcattcccttgcaggaacttcaggaacaactactgtaaatccggcactcgacatagcaggagctatgatgtcgaaatgaataggtgacatctgcggagcgaggatcgtgtagtttttcttcatgtccttcgtaaagatctttctcttgtacgaagacggaactatctttctctgtgcggcctcagcgtcctgctgcttctttctgtctcttacgcggatcgcagcgagcagtgaacgcacacggattcgggcagcaccaagattatttacctcatctatcttcaggcaggtgtagatctttccagaccttgagagaatatctctgacgcagtctgtagttacagcatcgaggccgcagccgaacgaattcagctggatgacatcgaggttttcagtcttttttacaaagttggcagccgcatacattctggtgtggtacatccactgatccattacgataagcgggcgctcaagctctccgaggtgagatacggaatcctctgtcaaaactgccatgccatacgaagtgatcatgtcaggaattccatggttgatctcaggatctatgtggtaaggtctgccgcagagaacaatgccgtggcggcctgtcttctttaagtactcaatgacttcttcgcccttgtgctcgatatcacttctggtattggaaagctcggtccatgccttgtgtgcggcagacttgacttcgctctcttcgatatcgaattcttccttaaatacctttacgagctgacctgtaagagtctcttcattcgtaaatgccatgaaaggatttaagaaacggacctcaccctttgtgatagcttcgacgttgtttttgatattttcagcgtatgaagtgacgatcgggcaattgtagtggttgttcgaatccggaaactcatttctctcgtacggaacgcacggatagaaaatagtcttgattccattatttataagccactggacatggccgtgagtcatttttgcaggatagcactctgtctccgacggaatgctttcgattccaagctcgtagatttttctcgatgatgccggtgagagcttgaccgaaaaaccgagttctttgaaaaatacagcccagaacggatagtcctcgtacatattgaggactcttggaattccgatcacgccgcgctttgcctcttccggagcaagcggctcgtatccgaaaattctcttgtatttgtagtcgtagaggttcggtatatggttcggattctttggctttccaagtcctctctcacagcggttgcctgtgatgaaacggcggccgtctgagaaatggtttattgtcagcatgcacttgttcgtgcagccctggcagtgagtcatcgaagtcttgtactgaagatcgaggatctcatcgatcgggagcatcgaagtagtcttctcgtcctggtatctctctctggcgataagtgcggaaccgaaagcacccatgatacctgcgatatcaggtcttgtaacatggagtccgccgattttttcgaaggcgcgaagaactgcgtcattgtagaaagtaccgccctgtacgaccacgttctggcccagctgcttaggatctgtaagctttataaccttaaacagtgcgttctttataaccgagtaagccagtccggcagagatgtcggcgacagttgcgccctccttctgggcctgcttgactctcgagttcataaacacagtgcagcgcgttccaaggtctacaggattcttcgcaaaaagtgcttcctttgaaaaatcgatgacattgtagttaagcgacttggcgaatgtctcaataaatgagccgcagccggacgaacatgcctcattcagctgtaccgaatcgatcgtatggtttctgatacggatgcacttcatatcctgtccgccgatatcgaggatacagtcgacctttgggtcgaagaatgctgccgcatagtagtgggcgacagtctcgacctcaccatcgtcgagcttgaatgccgacttcagaagagcctcgccataacctgtcgagcaggagtgaacaatatgtgcctcggaaggaagcaccttcttgatctcgcccattgcgcggatagctgtgttaataggtgaaccgtcgttattgctgtagaatgagtagagaaggcggccctcgtcatcgataagcgcaaccttcgtagtcgtagaaccagcgtcgatgccaaggtagacattgccctttgccttagaaatatccgctgtctcgacatggttgttgccatgcttctttaaaaattcgtcgtactctgcctgatccttgaaaagaggctccatacgggcgacctcaaactcagctttcagaggcttcgacagcttgtcgactatagtcgaaagctgcatctggacttcttccttgtaatttaaggcagaaccaagcgctgcgaaaagatgagagttcttcggaactatagcgtgctcgtcgtcaagctttaaggtctcgataaatctctgtctcagctgatccaggaagtgaagaggacctccgaggaaagccacatgtcctctgatcggtttgccgcaggcaagtcccgaaatagtctgatttacaacagcctggaaaatagacgctgccaggtcttcacgtctggctccctcatttataagaggctgaatatctgtctttgcaaagacaccacagcgggccgctatcggatagatagactgatagcccttcgcatactcattgaggcccgaagcgtccgtttgaataagagaggccatctggtcaataaaagaacctgtacctccggcacagacaccgttcatacgctcttcgacatttccattctcaaagtagatgatcttcgcgtcctcgcctccgagctcgatagcgacatcggtctgaggataatagtgctgcagtgatgtagctacagctacgacctcctggcagaaaggaatcccgagattctttgccaaagcgagaccaccagaacctgtgataacaggagctaccatatggtcgccggctgattttaaggcatccgaaacgagtccatagaaggtctctctgatatttgcgaaatgacgtctgtagtcagaatagagaagctcgtcatctgggcttaaaagtgctacctttaccgtagtcgagccgatatcaataccaagtgtgtatggtttttctgacatgtattaacctctctgaaaaaataataatccttacaatctgtattcaagtgattattatatgaaataaaattccaagtttcaatctacaaaaagccgattctgttgttttagattgcgtgcaatataatcacatattaactttttgtaaagtttatgtcccgatttcgataattctcgcatctcctatagcctctgacagtctgtgcgaaattgtgaggacagtccttcccctggcggatgacttcaaggcgcgtattactcccgcctccgtcttcgcatccagactcgccgtaacctcatcgagaagcaggatctgaggatcaagtactactgcccttgcgattgagagaagctgaagctgtccctttgaaaaaagtctctcactcattttcgtatcaaggccatcagggagctgttcaatgacgtccttaagtcccgcgagcttcaaagcagcatcgatttcttcattagaaatatcgctgtcgtaaagtgtgatctggtcctttaccgttccggggacagatgcaaaattctgctctacataaccgatcacgcgccttctctcctcctgtgaaagtgcacacggatctaaaccggcaagatttacagttcccctgtctggttcatagagccctgtcagaagtctgaagacagtcgtctttccagcacctgtccttcctgcgaaggtcacaagctctcctttttttatatcgaaggaaaggtctttaagcaccgggcggtctttctgatagccaaaatcaacatgctcaaagcggatttcatcagttttttttggctctgttatttcaggctgccactccggttcttcgaggaaggtatcgatgtgatcgatagcagcggccgccgactggatgttctggatttccataccgatattttcaagcggagaaaaaatcctgtttacataggccatcattgcaactgcagtaccaacagagattccaaaaagcgcccggtatgaatttcctccggcagcaaaaatcatcatagctgctgtgaccgctgcctgcgtcagaaggatgaccggtgagtaaatgctgtcgatcacatttgaacggtcgactgcatcgtaactctccttgatatatccgctatagacgttttccatgtgtctctgcgcatggaaaacgcggatcattcggatgcagcggagggtctcaggtacatggccatttacccttgcgatcgccctgcggttttcaaggtttgccctgttcgacctcctctggcaggtacgcgtaaaccagaaaagaagcggcgtcacagcggtaaccagaagtccgagaccgagtgacctggtgtaaatcacgataaggattccgaccacttttaaaaggtctgcagccatgctcacaacgccatcgctgtagagtacatcgatcgtgtcaccatcatttgtaaaaatcgaggcagtttttccactctcattgcggtggaaatactctgccggaagacgcgaaagcttctggcagagagcacttctgatcccgtgtgtgatcttctgtccaaacaccgttattccagcgttctgcagagattccagcagatcagagattacgataaaaaggaagtaccaaagcgcaagagtgagtgaaactccttttcccgcgccaaggcggtttacagcctgctcgagaacgagtggcgggatcagcgaagcgacaacagaagccacgatcagggcaatgagaccgattaagaggcccttgttttttttgatgacgccggcgaaggcctttttcaaatgagtatgttcatttttcttttcattatatgtcatcgtagtcgcctcctttcgcctgctcttcgtaaagtgcccgatagcccggctccttttcaagcatcttatcatgcggcagaaatgttccatgtccgttgtgcagatagaggacacagtcaaactcagggaaatgatagagcctgtgcgtcataatgattatcgtcctgtccggaaattctctgcggatctctttcaggatctttgtctcagtaactttatctactgaagcaaaaggatcatcgagaactaaaatacttcttgcatgtgcaagcgctctcgcgagtgaaagtctggcctgctgcccaccggagagcattgcgccgccctctcccacaggccaatcagcactcctgtgcatattttttaaatcttcgtcgagacaggtcatctggaggaatctgtccacgtcgatatcacttccaagggaaatattgtcaaaaaaactcgtcgacaaaagttccggatcatgacctgaatacgaaactgcctcaagtttttccctctctgtcatcgaccctaaatctttcccgccaatggtcaccgctccctcatatggaacttcgccaagaagaactcttccaagaagcgacttgccgcttgcgactccgccagtcacaccgatgatctggcccggcttcgcttcaaacgaaatatgcttaagcattttttcaccatcgtagccgcaggtaacatcagaaaactcaacgccctgtggcctcacaggcactttgtccggatcaaaggaatcctcgactgagtccttcatcaatggcttaatacgtttccacgagactgccgctttctgaactgaattgaaaagttttgctgcgtgggaaaccttggtggcaagttttgtaaagcatgataaaaatgtcgtaaaggctgcgatgttccacgccgtccagccagttccctgtacatttttcgctccaaaataaataacgagcacggtaccaagcattgcgatcgcatcgtataacggagccatcgaactctcgaagaggtttgcctttgcactctttttttcataatcagaaagcgaccgctcgtaggcctcgtcacgatttttctctctgccatagacacggtaagtcagcgcatttccaatacggtccatcgtgcgtccgctgagagctgcggcgctctttttgtactctgcatttgcccttgtgacgaccgtcttcaggcggtctgcagccaaatatgcgattggcgtaaacatacatgataaaattgcaagcctgaagtcgtagtgcaccagcatgcagacataagcgatcatcacaacgcctgtatcaaagatctcggtcgtgaattttctcataccctcagagcaggcatcgacatctgaaatggccttggtcagaagcgatccaagcccctctttttgaagtttctgctgatcagaatgcacaaggctgttgtacagatttctcctcatgctgctgctgacgttattggcaaaccttcttacgccaaagcgctttactgcccgtcccgcctggacgatcaaaatcgcaatgatgtaaaaaaaagcgatctgcaccatgtcagaaaatttcgagcggcccccgataatatcgtacagggtctgtgccagccggccctcgaagtaaggtccggcgagcattccgatattgtaaataagtccggaaatcgtaacgataataagaaccggaatatttgccaaaaaatatgacatgatccggtcgggatgaacgactttttgtttctgcataatccgcttcgaatgtgaggtcttctgatcactcatttgtacaaatctcctatttaaatggatgacgcatcatatgtagtgtcatcttttttattttatctatactgtcaagcggtaaacaagaatagaaatcagttttcagtaaagaaattcccaccgcagtggtggaaatatataaaaggatagtctgatataatttttgactagtaaatgatgttttggaaaggagactcaaatgaaaatttggaaactaatttcaggaatattatccatcattctgtttgctgtggtaatgttccagtcatgtgccgctggagtggtggacgctatcgatgctaaaggcggtacatccggaggcgttggaatcattgtaggcatcctgatgctggcaggcggaatcctctcaatctgtgtcagaaaccaggaaggcaagggtggagacattgctctgatcgtcatctttcttctggctgcgatgattggactcgctgcacatggcatttacacagacctcatcgcctggggaatctggtgcctgatcaacgcgatcctcgcgctggtagatatcataatcaaatcgagaaagcggaaggcataaaaaatattgaaaagggagctgctgcaatcattgaggatttgcagcagctcctttttttgtctttttattccacagctccgcacggcctcaaagcagccacaccgtgtgacttcagatattcattcacgtcgagcaccgatccgacgcggtcgttgaaaagtgacatcagaagagcatctctcggaatcctgacatacagttccggaagctcatagagcctgagagccttctgcgtctcgtccaaatcgaaacccgcagcgtagcagagccgcaggatcacatctctctgtcttgtccgtttttcccccgagatcagtttgtagccgtacctctcggaaatatctgcctcgataaaaacttcactaagcgtcttgtcgtgctctttgacaagacccttgaaataatcggagaagtccttagggcttcccttcatatcgcttccattttcatttaaaaatttgtccatctgagaagggtgagtgcttttcagcacattttcaagctcagtagtactcttttcactcatttttatctcctatatgatatactggttttatgaaaaatatagaaaactttgacatatcagatttcgacgtcgtagacgtgataaataagcctcacaatgtttaccttgttaagcacagtgtaacacagaaatactatgtaaaaaaggtcctagacgtctacaatataagcatctacaaattcctgaaagatcactccatcgcgggtgttccacaggtgtattatttttctgaaaataatgacaggctgaccgtgatcgaagaattcgtcaccggctcacagctctcagagcttatcgaagaaaaatccctgaaggcatccgatgtcgcagacataatgctaaaactctgcacgatcctggaggcacttcactatgtaaatcccccgataatccacagagatatcaagccttcaaatatcatggtagacggccacggccagatttacctgatagatttcaacgcctcgaaattttacaacgacgaggactccgatacagtgctcctcggcacgcagggctacgccgctcccgagcaatacggcttcgcggcctcttctcctcagaccgatatctatgcacttggaaaagttttagaccagctctcctctgctgtttccggaggcatcgattactcagccataataaaaaaatgcagcgcaatggaccctctcgagaggtaccagagcgccgccgatcttcgcgccgcaatatcagaggccgccggtatagctcctcatataaagcaccgccgcgcacgtaagagcatcttcaaaatccttctcaatgttcctggctttcgaagcagaacgccctggaagatgctcattgcctccatctgctatatgcttatgatcatttccggaatctcctatgactccggtcacaagtccgcgctctggtcagccatcgagaaaatctacgtcacgataatgatgtatgtaatggtaaacttcggcttcaactacaaagatttccgcttcagccggccattcaccagatccggcagcaaactattacaggcagtcgggatcttcataatggaatttttgattctttttgtggcagcgatgatatcagtaattctcgaagatatctttcatataaaataagatcttattccagtccagcctccgtcacagacgatactttgcctccggaaaatatgatagtgcacgacgacagaagtgactttccgctccatgaatatgtctcgcccttcacgcccagtatttcatcggcgctcatcagggcaccgtcacctccgagaactttcttgacctgatcgtatgtcatcccggttttcacctgttcatactgcttcagagagactttcaccttcgatgtaatgacgccggcctgcgattttaccgatgcttttccatcagtaaaggtcacagaaatagtactcagatcactgcctgaccaggcataaacagcggatttcgtcccggcaatgctggtttcagaagccttctttccctttgacccaagcagctttgcgacctggtcaagagtcattcccatatcaatcttcataaaattctcagccgtcaggcccgactttttctcgtcagttttctttgaggcagttgacgttgatttctttttcgaagcagatttcttattgctgtcagtcttctttttttctgaaccggccttctttgcttccgacttgtccttatcccctgttttactcacgctcgtgctctccgaagtcgaagcggttgacgaacttccgccgcacccagccagcggcagagcaagcgacatagcaagcagcatagtaattatagtctttttcatagcatcctccaatctttgccagacttataatcgttactgtctgcattgtataatatcttaggcgattttatttccaccatagcagtgggaaatgatttgtgatagaatcaggttgtatttcaaaagaaagaaggccaaccatgattcaggatatttttcccgataaactctacaaccagtacgatccttcgattaaaccagtgtccgattctaaaatatatgtgttccgcaaagacagtctcctggtaaaaaaaggtgattttcagctgccggattactcagacttcagcgaataccttgcaggacacgagggtgcacaggttatttttctgtttaaaataaatgacgacaggagatttctgctgctccctccggctggtcctggcggggatgaattttcagatgatgatgtggcagaacttgccggggaattttcatataagaagatgtttgatctcagatgggataaaagctgtggcaggactgagatttttgcaataacagtcgcttaccagttaaacgtctggtacaaaaacaacaggttctgcggcagagaccagactccgttgcagctttcggctgcggagcgcgcgctcgtctgcccgaagtgcggcttcacgagatatccgagaatcaatccggctgtcattgtcggcgttattgacccagcacatgacaggctgctcctgtcgaaatacagaggtcgtgccgaggtccctttctacgctcttctcgcaggattttgtgaaattggcgaagcctttgaagacaccgtcagaagggaagtcatggaagaaactggcctttctgtcaaaaatatccgctactacaaatcacagccctggggcagagccggcgacattctggctggatatttctgcgatgtcgatggaagcacagaaataaagatagaggaagacgaactggcactcgccgagtggttcgaaagaaaggaagtgtctggacaaccagataatttatctctcactaacgaaatgatgctgatttacagggatgggaaagagccaaaataatttccgctccgcagcgcactaaaacaaccccgggacagcctgtggctgtcccggggttttatctttgatattttgtcaacgatcccgcttttactttgcgataatctccatgatcttgttcgatctcttgacgaattcagacatctccttcggaggaagcggctggttcgaaatctctgcgaggtcgtagagctgatgagctataaggcctgcgttctcagaatccttgttggctgcgagatattttacaagcggatggttggcgtttaataccagcgtctctgggcctgtgaaatcatctttgcttccatcgttgaaattgtacatcttcatcatatcgctcatacggcgcatgttctcttcacggccgatgactgcggcgatatcgtcagccttcagcttctcgagctttacagtaacatcgtcgttattcagctctttcttgaaaatatcggcaagagtcttctggtcatcctcaagctccttaggatcagtgtcctcagagagtgccttggatacgtccgcatcgatacgcaggaacttgtaatgctgatttctctgctcaagctgagtgataaaagaggtatctatagtcctgtcaaggatcacagcgtccatgttgttggccttgaacatatcaatgtactggccctgcattttgacgtccgttacatagtatacaggagtcttgtcctcgtccttgatctcaccgttattggtatcggtctttgtctcatccttgttctcggacttgtcatctgatttttcatcatcagacttgtgagaagcagcatctttttcaagaagctcaggaagagtcacatatttatcattgatatccttgaacaggatgtaatcgttcatcttgtcgcagaacttcacatccttcaggcagccgtacttgatgaacggactgatgtcgtcccagtatttctcataagtctccttctcggtcttttccattccgataagcttgtctgcgactttctttgaaatatagtcacgaatcttagcaacaaaaccgtcgttctgaagtgccgatcttgaaacattgagcggaaggtccgggcagtcgataacgccctttaagagcatgaaatactcagggataacttcctttatgttatcggcaacgaaaacctgattgttgtaaagtttgatagttccctcgatagaatcgtactctgaattgatcttcgggaagtaaatgatgccctttaaattgaacgggtagtccatgttcagatgaatccagaagagcggctcgcggtaatcgttgaatacctttctgtaaaaatccttgtactcatcttccgtgcactgcgaaggcgtcttcgtccagagaggatggatatcatttatcggtacaggtctctttacgatcttcagtttgtccttggccggagtcttgagaaccttctccgtcgtgccgtcgtccttcttcttgtcctcgtactgagcttcctggtggatctcttcgataaccttatcggtgtccttcttgtccttcgggtcgatctcctcgtactcttccggcgcatttgccttcacaagatagatctctgtcggcatgaatgagcagtatttgtcgagaacttctcttgccctgtactcattggcaaattcaaggcagtcgtcatttaagaagagggtgatcgtcgtgccgacagaatccttgtcgccgtcgcgcatcgtgtaatccgtgccgccgtcgcactcccagtgaaccggctttgcgtccttctgatagctcaatgaatcaatgtaaacgaggtcagctaccataaatgcagagtaaaaaccgagtccgaaatgtccgataatctggtcatcgctgcccttgtccttgtatttttcaaggaaatcagtagcacctgaaaaagcaatctggttgatatatttgtcgacctcatcctcagtcattccgattccgttatcggtgatctttatagtcttcttatccggatcgacttcaactgtaaccttgcccttatagtcactcggcagctcacaatcgcccatcattccgagcttctcaagcttcgtgatagcatcacaggcgttacttataagctccctgtaaaaaatgtcgtgatccgaatacagccacttctttatcactggaaaaatattttcacttgtgatagaaagacttccgcttttttctgccatgtaaataccactcctttataaaaatatcaaaaaaatctattttctagtcgactgtcctgcaaattattagccaaccattccgtcgactgctaaaatatattgtagtattaccgctattgaatgtcaagagaaaaatagcactcgtcatagacgagtgccagaaattttatatgaaattgatcaggcggtccctgtaatcgttgaaaatatacgggaaatgtcatcctgcatagtgcagcgcttcgatcggatctttgcgggcggcttttctcgccgggtagaatccgaagataagtccaatgccaattgagaaaatcgatgcgacgacgcagactctcgcatcgagccagaacgtgtaatctgtaaacgcgtttatgccggcgattatcagtgcactgattccaagtccgattcccgcgccaatcaggcagaggacaagcgactctatgaggaactgaagcattatgctgccctctgtcgctccgatggcttttctgatgcctatctccttcgttctttcggtgacagaaacgagcattatgttcatgattccgatacctcctaccagaagcgagattgcagctattcctccaagcatcagagacattactcctgtgactttgctaagcgtatcggcaattaccttcatatttacaacggtgaaagcatccgaatcattcgagaacctggaaagcaggtaactgtttatctcctgctgcgccaggtctgaaaccgcatcacttttcggcgcgatcacaaagctggtgacatccctgaccgtcgtcgaaagcctctcaagcgaagtaaacgggatatacgcttcataagacgcctgcgacagtaccttgttgtccgactgcttcacgacgcctatgacagtgtaagggattccgtctatcgtaatgctctgtccaatggcctgcgaagtgttgtaacatccgaggatatcaatagccgtatccgcgtttattaccgcgacattcgtgtggttgtctacatcggcactccttataaatctgcccgaagccagctcgacaccgtttatcgactgatagtcagctgtagttccggtaagctttatagtctcagtgtcagaaccgtttctgatgtttccactggatacagctgaaggggcaacggcagccacattttttaaagatgcgatatcgtcaaggtccgaaagtgacagcggtttgtccttgtcatctgtgatcgtaactgtgatgttattcgtgctgatcgacgagatcgtatctgtaatcgtcgaagtcgcactgttcgtaatcgagagcaggacgactaaagccacaactccgatgatgataccaagcatcgtgagaaatgacctgagtttgttcgaggcaaccgatgcaaatgccattttaaaagaggattttatcatcagaccacctcctcaatctcagacatgtccttagcttccgaaacatggccgtcaagaatttttaccgagcgcgaagcctctttcgcgacattcggatcgtgcgtgataagaaggatcgtgttgccttcttcattcagcctgtgaaaaatatcgagaagcatcccgcctgtcttctggtcgagatttcctgtcggctcatccgccagaaacagtgacgggtgcgttgcgagagctcttgctatcgccaccctctgcttctgtccaccggagagctcgttcggcctgtgatctctcctgtcccatagtccgatcgcattcagcgcatcttcaacctgctcttttctcttcgaaggcgagaggccctgatatataagaggcagctccacattttcgtaggccgaaagcttctgcagcagattgaaatcctgaaaaataaatccgatctttctgtttctgatcctggcgagctcatttctcgagtaatctgcaacttcctgcccatctaagaaatattgcccggaagtcgcggtatcgagacacccgacgatattcataagtgtcgattttcccgatccagatggaccgatgacgcttacaaattcacctttgtctacatacatttttgcatgatctaaagcctttaccgtatcgtctccaatatggtaaattttcgaaacgtcggaaaggaggatcattttattatcgtccattagttgcctccgtttccgccggggccgccgtttcctcctgatggaggagtgccgcctccgccattcccgtccgatctgctttcactatttccgccacggccgccatttccgccgccctgctgcatattagtccccatatttgaaatactgttctgagagctcgtgagttcctgacccgagaggtctttgtagtagactgtatcgccttctgaaagtccatcggtgatctctactgtcgaatcgtctgaaacgccggtctttacagtcttcctgccaccgagctttccatccttgtttgtagtgtaaacatatgactttccgttctgttcctgaactgccgaaagaggaatcgtcagtacattttcagctgactttacatcaatgactgccgtagcactcattcctacaagcatcttgctggtcttgtcgatctggcaggtcgcagtgtactttgtcgaaccaccgctgttcgtcccgatcttcgatacctttgtgatctctcctgtaaagctcttatcatctaaggcgtcaagtgtcaccgtaacactctgtcccttctttacatttaaaatatcgagctcatctaccgaaagggctatatccatcttgtcccctgtagccaccgtaaatgcagatgtgtaggtagcatcagaagatgaggatgagtatgaggacgatgaactgtcagtagagcccgaaccagacgtaagtgaagaaactgctgaactgctgagtgcagaacccgagccgtttgaaagtgttgctctggaactgttcgacagtgccgagttacttgtggctgctgaactgctgctggaatttgcaccattcatgtactggcttgctgctgagttatttctgttagtgtactggctagttgatgaattatttccagctgtgttcttgcttgcggctgagctgtttccattagtatactggcttgcggctgagttgtttccgttagtgtactggcttgcggctgagttgtttccgttagtgtactggtttgcggatgagttgtttccagttgtactcttggttgaagatttgctgctgtcagcctttgagctctcttgtgtcgtattcttcgaagcgctgctgtctttattcgaattcgtgttgttctctttacctgacgatgtgctgtctttcgaagaggtcccgttatcagttgaggaagaagtgcttccatttgacgaatccgtgctgttttttgaagaagagctgctgttttccgaagtgctgcttttttctgaagaggtgctgtctgatgtagtcactggcacctttgcggaaagtgtgacggctgtgactgaagaagatccgctgcctgtcgattttttgctgacacctgaaccgctaagcgcagaagaaatggatgaagtagaagccgaagacgactgcgtagttgaagaggaggatgatgaagacgaagtagaggaagaatctgatccagaaacatttaccgactgaatagttcctgaaaccgtggatgtgatctttccagatttcctgatctttaagagagcattcagttccttcttcaaatcagccttctgtgctttaagcatctcgcgctgtgaaacatacttcgcagatgtcttggacttgatgctcttaagtgtcgaatcgatcgatgaaatagaatttctcacctgataaatctgttcctttacagaagtcatgtcgacagtagctaaagagtcgcctttctttacagtatcgccctgttctacgaggacttttttaatggtaagtccagaagggatcttaacatctgtcgaagtggattctgaaagcgtaccgctggcagtgatcgtattcttaatagtacctgtcgaaacctttacgctctttacagatgaagttgaatcggcggcttttttactcttagacctcgcagtcactaccccaataagggccactacaacggctattacaatgataatggccgccagctttctctttgagtgtttcttctttttcattcagatacctccatctgctgctcggaaaatacagacttaataattttatttacgttttttaataggatatttgaaagctgtgaaaaatatgtgacaaatatcagaaaatatttatactattaaatcactaaggggatatatttgaaaaataaaaactgcccctgtattaaaacatgggcagttaataatctgatttgctaaaataatacacagataacacagtcattttatgacttaatgtcaaaaaatacaaaaaaaggaccaggcctgcgcccggtccaacttcacgaaaaatcaaagatctacgctgccaaaattgtcatctgcaacatagtaagccttaccttcttcaggcttgatataaactctgaggtccttgaataccttcttcgacttcttggaataagctttcttggcattcttcagaatctcatcaaggtagtagtcatttccctggtactgtacgataactctaggctcctgagccttagcctcagctgactctttagctgctgcggctgcctttcttactgctgctcctgctttcttcgtagtagccttagctgcagctacagtcttcgtagctgctgtagaagtcttcttcgcttctgccttcttaggagcagtcttcttctcagcttctgcgttcttctcctctaccttagccttaacttcagtcttcttctcttctgcctttgccttagtctctgctgctgcctttgctgtagccatctttaccttctccgtctccttcttaactccttctgccactttcttcgtgtcctctactcccgtatttaaaatgtcacgaacggttgcagaaatatctgcatttgttgatttttttgattttgatgccatcaggaacctcttttctcgggtttatgtaaagtttatatttgatataattataataccgccctaactaaaatccaatacgtgatttaactaaaattttaaaaaaatcagacaatattttgtacattttgctaaacggagcgaataaatattcataataaagttcaaaaactgatgaattcagaaaaggtctcgaagaaactgtctgtcgtgactttctcgtcgatactatccgccactgaattccacgtgtcctgatctatgctcgaataatccttcttattctgagccgatattatgccgtcgagtacacgctgctttctggagctgatgatcttctcgcggttctgctccgacttcttcttatcaaactttgaagtacagtaaataatatagatattatttccactcttgacaggcttcgaatatttgccgttctcgagttcaaaggcagcatctacgacttccttcggccaggaatctttcgagataacaaccgaggtcttcttatcagtggagtacttcttcgccacaatctgtatatcatttccgtctttaagttccttctccgcctttttggctttgtcggaagagctgtaagcgaatgtgatgatcaccgcatccataactctggcttcctcatcagagacctcatcatctgtcttcgaaactatggatttgtacaccttcgaggctacagcctcgttctcatacatatcctttatatctttctcgctgattctaaggccggccttatctgcggcactgagcgaatccatgtatttggatgctgcttttgcgacgaggtccttctcctgctgtgacagtgttatcttatggtcagatgcataaacattcagcgcatagaccatagagagcctgtgaaggcaggccttcttgatgttgtcgcgaagccggttagtatttaacgaagcattccagagatcaatatctccagccgtaccatagatattatagtaattcgccagatagactgctgcagtcttctttgaacaggacagtgaccctatcctgaaaaccgaattcaccgacgggacagtctgaaaaaataccttctttccatttacactgcagcccgaaagcgatgttcctaaaaggcatgcggccatgactactgctaaaatcttctttctcatctcacccctccactaccagatatctgccgtcgcctatatcaaaaacttcagcgctatcaagtatctcactgtcactcataccgccgcagtcgagattgtccttcatgtacttgactaaagccttcttcgaatcacaaacctgagcacagcagtcatctaaaaactcgtcggcctcctccaatgaatcagccaccgactcgtcgaaaagctttccctgattcttgagaaatacctgaagcaccttcttgtcataaaccatagaaataaaaccctttcaaaaatatatccgatcgcgctccttaatcgactgccctctaagttcaatggtcactctctctttttatcagaggaaccgcgacagtctttccgagcacaaaagagtacaagtacatctcactgacaggaagttccagccctctctcgagcgccagctggtacagctgcagctgcttcgtgtatttgaccagaagctcttcctctgtcttcacaaaatctgtcttgtaatctataagtattattttatcattttctacaaaaaatgcatcaataattccctgaacaattacctgatcagaaaaaggtgcatccgacgctttagctgagaggtctccaaaaaacagctccggagagtcgccagtgacaaaagcctgctcacggaataaatctcctgtcttaaatgcctgctgcattcttctggccagagaggatttgagaaatgtcgataatttcctcttgtcgagcattccctcctgctctttagtaagaaatcccttttcgatctctctggctatctgttcatccaaagtatcacccagaggctccttagagaaatccagcttctctaaaaatctgtgcatcgcggtacctcgttccgcgcccgaagccttcttctgtactgctttagcgttctgtcccgctcctgcatcatgtccagctatcgtgctaaggaacgccggaatccttgactcctttgatgatggcatggatttgtaaacgtccatcgctccttccctgatctgttcgtcgagtgctgtcgctttaatctctgaaacggaatacttctgtttcggaatcacctctctccggtgtgagtatggatgcgtaaagttcatggcaagctcaagagcacgtcttcttacactctcgctgctctccccgagaagttcttctctcagcttcttctggtcagtttcaatctcttcttctgccagttcaaaatcactggcagcaggttcatctatgtgatatccgctttttgaaagtgccggaatgataaaatcaaaaaagcttcccgaactcttcagtgcagtataagacatggcagactctttcatgttttttcctgtctcgatgagagtattcagcttcttcgaattcatcgtacctacaaggtaaagcttctcctctgctctggtaagcgctacatataagactcgaagttcctcgccgagtccttcgtcatcgttaatcgagcggaccgtcttgaagtgtaccgtatcatttctcgtgtgtctctcgacatctatgtatggcatggtaatgtccctgtcttttatggtctcaatcttgtccttatccttattaaagctctttccaaggcccatggcaaagacgacaggaaactggagtcccttgctcttgtgaatcgtcatgatctgcacggcatcatttccatgagtgacatcggcctcgccttcatcagtcttatagtccttcaatctgtcaatataactgatgaatgcagagattcccgaaaaactcgtcttcgaaaatgcaacggccttgtcatacagcttgagaagattctgtcttctcctctcacctccaggcagacagctgactaaaagatcatatcccgtatccgaatatagctctgctataagttcgtaaaccggagtatcagcttttcttcccctgagtttagaaagctctgtgagaaaaacgtcgagtctgcgcctcttgtcagctgaaagatctgccctgcccgaattatcagcctgttccgatagcactgccatatggaatctctgatccttgtgcgctgtgccgatcagtgcgatgtcctcttccgaaagtccaacatacatcgaagtaagcactcctgccatcggcacatcctgccgtgggttatctataagccgaagaaaattcatcgtagcagcaacctctggagcagaaaaatatccggtagctgctgcattctcggcaggaataccgtaggcgttgaaaatctcgagtatcttcgctgcattcaccttggtgctccggaggataacagcgatatcctgatacctaaccggtctcatggaatctttgccatcatagaccttgaagccggagctaaagagcttcttaatctcctgagcagcccaggtggcttcaagctccatcttgtcatctgatatctgttctttcaactcgctgtcatcgcgaagaagtacaacggtatgagtagaattgtcctgtccatcaggcagagcgggatagtaagtggcaccagtctttaactcagcatccttatcgtaagctacacctccaagctccggaatcatgattcttctgaatatatcatttacagtatcgatgacatactcacggcttctgaagttctggtccagatctatgcgcctgaaaggagctttctcatccttctgatactctgatgatttccttaaaatgataccagggtctgcgttcctgaaaccgtaaatggactgcttcacatctccaaccataaagtagtttgaagagtctcggcttacagcggagaggattctctcattcagctcattagtatcctgatactcatcaaccatgacttcacgatacttcctgcggtagttcttcgcggcatctgtgatattgccatccggatcagtcagaatctcgagagcaaaatgctctatatcagagaactcatacgactttctgtccctcttctctgcgagaaacttatggtcaaactcctctgccaggtctatgatctcacgtacaaaaggtgctttctgattttcttcctccacaatatctgaaagaggcttcgaaaggaaaaataccttgatacgtttctcgaagtaattcctgtactgatctcttcttgtcttccaggcgtcagctttcgacttgtcatcgtctgtggctttcttcagaatctcccttttgccaacaccctcgaatttaaaagtagaagagagggaatatagatcgttatagcttgatgaatcagaaatattcctgaaaaagtttatatctttgtcaagattcgtaatcagcttgtcaaagaccttatcatggttttcagcactgatctccctcttcagctgctctgctaccggaatcgtgtcatctgcgaacttgtggataaggtctataagcttcttaaaccaagatgtctccacaatcgaatcctgatctgaatctgtgacagaagctcttagcgcatcgtaatacttcgatacccaggagtaggcctgtgccttggaatagagatttaaaataatccctgagagggcagagtcatcccctttattcgagagcatatccgaaagtccgaggaacttctcatcgcccttctcgtactcttccctgatcatggtctcgaggacttcctgctttaagagctctgtctcgcccgagtccataaacctgaaatccggatccagatcaatctgtgaaaaatactccgagacaacgttcttgcagaagctgtcgattgtcctgatatcggccgaaaataccctgtcacgcatgctcctgatgcgatggtctgaaggattctctgtcagcttcttgttcagcgcatcgtaaattctctccttcatctccttcgctgccgccttcgtaaacgtaacgacaaggagctcatcgatatcccacggatcattttcggctgtaatctttgaaataatcctctgtactaaaaccgcggtctttccactgcctgctgccgcggtgactaagagtgactggtcactcgaatcaataacattctcctgtgctttggtccaattcatgacttgctctcctctcccggcttatcgctgatttttgcaaaaagatgcttcatcttgaccctcgtgtccccgttctcttccttctcgtgatcaaggcagtggcttatatccctgtaataaaacccattcagtctcggatcaaaatgacagacatcattgtagatgcagtaggtgcaggcggtatcgtctcctttcttgtaaggaaggatcgaagcgtctcccttcactatgctgtctgcaagggagaatgccttatgccttgtaaaatgcaggagggtcttaaagtcctcaggacttaccagagaatccgtagcgctgagagctcccttcgtcgtagtctgtaatgatacagcgttcgatgtataactcttctctgttacaagcgactcatccaaatctgctatcgctgaatcatcgtctaaaatgatgccgacagggcggagtttccgctctatctgtgtgacaagctcctggtctgagagcttcttcacctcttctatatcaggtcttagcagcatataatagaatgctgctcccggctgaactgtactgttcatcttcttcgaaaggccttttaccgctgcatccatatagaaaagcagctgaagctgaatgccctcgtaaatcctgactggatctagtttattgtcgccggtcttatagtcgatgatcttcgttaagatacggttgccatcatcagctaaatctatcctgtcgatctttcccacaaatgaaacgctgtgatcgtaactgagagggaaagtgagatcagaaggagtacagagcttctctatcggcatctcaaaatacgatggctgaaaactccctgaccttaatgcctccgtcatgaccctggtatgtagaagcagattcgagaaagcctgcttcgtgaagtgatcctccctcgcatcctcaaagatctcgctcccggcaaagtctaaaagctcctggttaaagcccttctcaagcctgtcctttatctgatcatccttcagatctgtccacttcaggccttcagacttaagacctgctgcatatctctcaatggcaccatggtaaagattcccaaggtcgagagtcgcgaactcattcttcttcctcggtgtaagcttaagaccgtacctgaaaagatacgaggccgggcacttcgcaaaagtctcgagacggctgaccgacatcagaagctgtctgccatagagggcatcgactacagcctgcctcagaggcgtcttcctgttctccgaaaaagctgcagaaaggatggccgccctctgctcttctcttcctgaaagtctcttcgcttctaaaagagcctccgtacgattagtgacatctgaaggcacatcccctgcgagcatctgagacagtcctctcgtcatcacgatgtcggcactcttctcagtctctaaaaataccggatcactgagtcctgtattaacaatctctgtatctggaaaaagtctccctacctcctcaaaaaggtacgaaggtttaatgtcgtccccgtcatcactcttctcgtggtaagtgataaagagcttctctgtcggcttcgtaagacagagatacagatagaacttctgctgagcagatctctcccgcctggtcggagcaagggtaaatccgttctccttaagaattatcctctcgtcctctgaaaaaatacctgcatcctctcccgccttcggaatctggtcgtctcctgctccgatcaggaaaagcaccttgacatccgaaagcctcgtacgctcgagatctccgaaaataaccgtatcgttactcttcgggacagtagctggtttgatctggtccattccatcgcgcagcatatctttaaaatccgaaagtgaagtcttctcatcaccgagaagatcgaccatctgatcagcgagatcacagaggaaaccgtaaagcctcctgtaaaggtcctcggcaacagcatcttcttcgtccttcttctggtcggcccgttcattcaaatgagactctacatcaaaagtcataataagatcaaacagcgctgtaagtctgtcttttaccgaaacattcttcgacttctccgaatcgtagaatgccatgaccggctctgcgatcttctcgcggatagcattcagagcctcaaaatcctcttcagatccgaaatcctgagtatgcctcttaaatgggctggacaggaacttcgtgttcctgaatgaagcctcgtagaggtagttatctaatatgtcaagctcttcagtcgaaagcggaacaagcccgctgcgcagaaatctcatgacactctcgtacgagaggcggcgcttcaccatatcgagggctgcatcacagaattctgtcagaggattgaagaacgcctcatccctctcatctataaatacaggtatgcccgaggcatcgaaagtcctcttcacagagtacctgaaatcttcggtgtcaggacatactatcgcaaaatccctgtagcggaggccgtcgtcctctctgatcatctggtggatcttctgagctgcaaaaagtatctcagtcttctggtcagacaggcatcgaagctcaatatgacctccggaatcaggaagactcgccctcttctctctgaagagattctcctctagaaatgccagcgggccacccgatgcatatctgccattgcccctgtcaatgatcacaggatctaagacttcaactccctcgagatgattcaggaatgcgctctcctccctcgacatgtagaagaggtcgtcctcttcccccgctgtgtagaggtccaagtcacagtcgcaggtcacacatgcatagacagtatctactataggcactattctctgcagaaactccttctggacaggagtaaatccggtgtaaccgtcaagcaccatgactgaatcccggagaagctcggactgatcagcgacatcacacaagagagaaagcacttgctcctgcgtaaacgtgctctcgtcaataagcgataaaaactcactgtaaagcttctcaatatcacctgccttccttcgaaaagtatcaggaagagccgggcctgccgccatatcccccacatcctcaggagaatagccatactgcatcagctccgaaataagagacttcacctcgtcaatatagcctctgcggccaatattcttcttcaaaagtccgagatcgtctcctataagagacgcagcccgcctcaataacagaaccttcccggtctcatcgaggcagacattcttcttcgaaccaagctcgtcgaaaactctgtaggcgagcctctcaaatgaaagtacgtcgacatttataatgctcttctgcggagacaaaaagacgagaatacgctgagtctgcatcgagtactgaagcggtactaagatcagatagtgcttcttcggattctcgtgagcctgctctaatatcttcctgtaaatgtaagtggattttcctgtaccggatggaccggcgatgatctgaagcttcatatgaacctcccctggtgtcctgctcgacagtgctaaatcaatcacggcctgtcagactgtgatgtatcaatcgtgttctgttcggtcttttatcgaactactgtttgtattataccacccgttttcaagtgtgtaaagctgtttttcataaaaaaaagacggcagtccacatttctggactaccgcctgaaaatcgtaaagaacttttcatagaactgaacttttcttttatgttcttccagtttgaaaatagaaggatcatctgaagtcatagttaaattacctgcttcaagatatttatggaaattagatgtgctttcactatgacgtctcatcactttaaaatgctccaaaaagtacataatgagtttggcatgtgtcgattaaagtagctcgtaataatattgttttatcactacagcacttccgaggaacaaactgctccaaaggcattggagcagtcttcctctctgacaccctatattgataattctgcagccttgtcaatcaaattttggagcaaaccttagtgatagcggcgtatgttgataaaaacttctctcacttcaaaaatttttggagcagattacacttctcactgcgtatgttgataattcgaccatttcagacagaattcggccagcatttttgtcgcaaacctcaccgccttcatcgtatagtgataatccaccaacctccaccatcctgagagttccgctttaataaatttccacccgtcaaaggctctatattgaaaatatcccacactgaaaagacaaaagtgttccgaatctcaaacactgccgaccagagaatcccaacgcccgccatttcgggtatctgactcatttgtggacaattgatgaaaacagccagagcaggcaatagaacggcgaaccgacaatcactctatatgcaggagccgacagtcacgcgagattgtggcattcagccagagcggccacgacgggcgtcgtgcgacatttaggattttccgtcgcgacctcgcgcgcaagccagcgtccgcgagccacccgcctgaaccataaacgctgtaaaccatacattgacagaagcggacgcgaataagcgcgcgcgaggagcaggaaaatcctactgagcgcggcgcccgtcgtggccgctctggcaaagaagttatcctatccacgcttgcggcgactgcataaaaaaagagcagccggtgagacatactcacaggccgctctggcataccgtctctattgactatcagcttcgttctttgccttttcgttctcgtccccgaacatctcctggacagtgtgccatccaagcacagcgcactttacacgtgcaggcatatggcttacatcctggaggacgccggcctcttcgagctcatcgacctcttcgtcggtgacttttcctttgatcatgcggaggaagatatcagcgagatgaagcgcctcgtccttcttttttccgatgatcaggtccatcatcatgtcggcagaagcctgggagatggcgcagccatcgccctcgaaaccaccgtcaacgatagtatcgtcgtcgccgaccttcaggcttacgacaatgtcgtcgccgcaggaagggttaacgccctcgagcgtaagagttgcaccgtcgatgtgatgcttgtgggccggatgaagattgtggtcagtaacgagttctttgtaaaaagtactgttagtgttagtcctcatatcccatttcctttcttatgctgataagcgcatcgtaaaatctgtcgatatcttttttatcattgtaaaaagccatcgaagccctgactgtggacatcttcccgagatacttgagaagaggctgggcgcagtggtggccggctctaatagcaactttgtgttcgtcaaaaattgcggcacagtcgtgtggatgtacatcgtctactgtaaatgtgatgatgccatggtgatccttaggatcctttgaaccgatgatatgtacatgagggtattcggccattttttccatggcgtaggtggtcagctcttcctcacgcttctcgatagtctcccatccgaaacgcttcatgaatctgatggcctcgcggagtcctactgctccgccgacgtttacagtaccggcctcgaacttgtgcggaagctcagcccaggtagcgccctcggtcgtaacgtactcgatcatctcaccgccaaagaggaacggtggcattttttcaaggagctctttcttaccgtagagaactccgatacccatcggtgcgtacatcttgtggcctgagaacgagaggaagtcgcagtcgagatcctttacgtttacaggaacgtgtggaactgactgagctccatcggctactagaattgcgccgtgcctgtgggcaacctctgcgaaacccttgatatcattgaggcgcccgaagacgtttgaaacctgagtgaccgctacgatcttcgtcttgtcagagatgatcttctcgagcatatcaggagtcagggtgccatctttctcacagtagagataagtgagcttggcgcctgtggccttgcaggcctgctgccacgggatcatgttcgaatgatgctcggcgatagtcgttatgacctcgtcgccctccttcaggaatgtcctgccgtatgcgtaagccacgaggtttaatccctcagtagcatttcttgtaaaaatgatctcagacttgtcatctgcgcctatgaaatcggcaacctcctgcctcgagttctcgtactcgtctgtcgcatcgattgagagctggtaaaggcctcttaaggggttcgcgttgttctcattgtagtaattgcttgcggcctcgattacgcagggcggcttctgagtcgtagctgcattgtcgaggtagacaatatctctgttttccagtagaggaaactcttttttaatatccatcagaaaacctcaccttctgaattcgtccaaatattccccgactctctttttcgtatcttcatcagaaatattggaagcgatcgcatcgatcctggctctggccatcatctcatagacagcttcacggctcatgccgcggctctcgagatagaacagaaggtcctttgcgagctttccgatagtagcgccgtgatttccctcgacgtcctcttctgcacagaggatgacagggatcgtcttgttcctgacaggcttgtccatcagaaggacatcttccaactcattgcctttggcgcccttgcagccctttatcaggtcaatagtgccgcggaaggtcttctgcgctctgtctcttaaaacgccgttgacatagatgtctgaaagtgtcctcttcccggtgtggcttgcgacgtagtttacgtcgaggttgtcgtcgcctgtcatgtagtagccgagcttcatgtcgatcgcacttccggctccgctcatgtggttctttacaccgaggaagacgttctttccaccgagtacgatctgaacgaggttgaactttcctttgtcgtcaatctcggttcctatatcatttaaaaatgtggcttcatgtgaaaatctcatgatctgaactacagtaagctcagcgccctttgcgatgtttgcagctacctgcgagctgtactgaccggcacttttttcagcctcgaaattcatgatcacagtcgccttcttattctcagcgagatttatcacaaagcggttggcaagagtactgtcatcgtcgtatttgaacgcgatcttcagcggatcggtcgtatctgcatttatatcaaaaacctctgcagatttgttcgtctgatcgagtgccttcgaaaaatcgtgtcctactccaccatcaaagtccgccggaaaaataccgtcgttttcggaaactcccgatgcagtaactattgaagaagggctcgcataaccgtcagcgctcttcatctggtaatttgtatcattcatcctgagccagttccaggtaggagaaggcaggacgtttaattttaaatcactcatattattctcctgattattacaaggaagatttacaaggaggctttacaaggaagttcttctcgttaagctcacgcggcgccttcggcttgcgttcgctaatctcgaagaacgacctcgcttcggattcgagctgcgccttcggcttgctctcatctcgaagctttcggtcacccaatcgctcccttcatttcaagctggatcaggttgttcatctcgactgcgtactcgagaggaagctcttttccgacgttatcagcaaatcctgatacgataagggctctggcgtcctcttcgctcatgccgcggctcatcagatagaagacaacttcgtctgagatacggccgatctttgcctcgtgtcctacatctgcgtctgaagttctgatatccatagccggaatagtatctgaccttgaaatatcgtcgagcatcagtgactggcaggaaactgatgacttcgagccagcagccttttcgctgatgacaacggcgcttctgaatgtggagattccgccgtccttactgatacttcttgtatttacatatgatgaggtgtcaggtgccgcatggactaccttgcagcctgtatcgaggttctgtccctttcctgcgaaagtgacgcttgtaaattctgagcgtgagccctttcctgcgaggacgctctcaggatacaggtatgagacatgtgaaccgaatgaacccgagatccactcgactttgccgccctcttcaaccttcgcacgcttcgtgttcaggttgtacatgttcttcgaccagttctcgattgtcgaataacggagtgtcgcattctttcctacatagagctcaacgcagcctgcgtgaaggtttgccacattgtacttaggtgccgagcagccttctatgaagtggaggtatgcgtcgtcatccacaatgatcagagtatgctcaaactgacctgctcccttggcattcagtctgaaataagactgaagcgggaagtctaagtgtacgccctttggtacgtatacgaacgaaccgcctgaccagactgctccgtgaagagctgcaaatttgtgatcagtcggagggaccagcttcatgaagtgatcctttatcatgtcagcgtacgggccgtgcagagcgctctcgatgtctgtatagacaacgcccttctcagcaactgaatcctttacgttgtggtaaacgagctccgaatcgtactgggcgccgacacctgcgagagattttctctcagcctgagggataccgagtttctcgaaggtatccttgatatctgtcggaacgttgttccagtcgttctgcatcttattgtccttagggcggacataggtcacgatgttatccatgtcgagaccttcgatagacgggccccagttcggaaccggaatctgattgtagatctctagtgacttcaggcggaagtcgtgcatccactccgggtcatttttttcttttgagatctgctccacaatggccggtgtgagtccctcgtcgactttgtaagcgtcatcctcggaataccggaaatcatacatggagcggtcaatatctgctacctgtgttttttccttcattacttatcagcaccttccttgaggtatttttcaaatccgttctcattgatgtcgtcaaccatagaagcgtcgccctcagcaatgatcctgccgtcggctaagatgtgggttctgtcgaccttcaaggactcgaggatccttgtggcgtgtgtgatgataagaagagcgccgccgactgtcttcttgtactcctcgattccggcactaactgtgcggacagcgtctacgtcgaggcctgaatctgtctcatcgagaatggcaagctttggtttaagcatcaggagctgaaggatctcagccttctttttctcaccgcctgagaaaccaacgtttaagtcacgctctgcatatgaagggtccatgtcgagaaccttcattgtcttcttcagatccttcatgaagtcccaggccttgagatgctctccggtcttattctcaatagctgtacgaatgaaattggcaactgtaattccaggaacctcgattgggttctggaatgacatgaaaatacctgccctggcgatcttatccgtggactcgtgtgtgatgtcctggccatcaaaaataacctgtccatcggtaaccttgtatctagggtcgcccatcagggaagaaccgagagtagattttcctgctccgttaggtcccataaggacatgtacttcaccggcacctacgtttaaatttattccgtgaaggatctctgtatcctcttctgcaagcttgactttaagatcctttacttgaaggatatctgacattttatctgcctccattctctgtttctcttgatctgatgatatactatcactataattcgaaattttatattggatttacaaccaaaaacaattatacatatagggggtatccattacaatgaacaattcgttaaatatgatgtatttttatgcgaacaaaagggccggcaattagccggcccgataattacttcgcgtaatctataacacgtgattcacggatcacgttgacttttatctgtccaggatactgaaggtcattctcgatcttcttagtaatatctctggccagaagaaccatatccgcatcagatattttctcaggaactaccatgacacgaacctctctgcctgcctggatggcataagatttctcgacgccttcgaagctgttcgcgacgtcttctaactgctgaattctgttggtgtaattctctaaagtctcgcggcgcgcaccagggcgtgctgctgagatagtatcggctgcctggaccagaagcgcgataagagactccggctcacaatcgccgtgatgagcggctactgcattgatgatgaccggtgattccttgtacttcttgcagatatctacacctaatgccacatgtgactgtgactcggtctgatcctgctcgtggtctacagctttaccaatgtcgtgtaaaagaccggcgcgcttggcaatacgcgtatcaactcccacctctgcggcgaggagaccggtcagctgcgaaacttctacagaatgctttaaaacattctggccgaagctcgtacgatacttcaatcttcctaaaagcttaatttcctcagtgttgagtccatgtactccagcgtcaagtgcggcctgctcaccttcctcacggatggtgttgtcgacctccttcttcgctttatcaaccatttcctcaattctggccggatgaatacgtccgtcaacaataagcttctcaagagcaatacgggcgacctcacgacgaaccggatcaaatgctgaaaggactactgcctctggagtatcatctacgataagttcaacgcctgtcaaagtctcgagggtacgaatattccttccctctcggccaatgatacggcccttcatctcatcattcggcagctgtacaacggagatcgtagattctgcgacatggtctgccgcacatctctgaatggctgtaaccagtacttccttagcctgcttgtcggcttcgtccctggcctgggccatcgactccttaatatacttggctgcatctgcctttacatcgtcttttacagtattcagtaagaaatcttttgcctgttgggaggtaagacctgagattcgttcgagttcctgtaccctttgctcgttcagcttcgctaccttctgccgttccttctcgagattctcctctcggctgataagagactgttccttacgatcggcactttccagcttcttgtcgaggttttcctctttctgctgtactcgtgactcactcttcgaaacttcagctctgcgttccttgatctctttctcgagctcattcttcgaacgcatagactcctcttttgcttcgataaggatctcccgctttttcgtttccgcagtcttcacagcttcgtcaataatagatctggcctgctgttcagctcctcccaccttctgttccgtgactttcttatggtaggaatttgtaacgaaaatgctcaccggaaccgcaatcacgagcgtcaccactaccgcgattataattcctggcacaggagcacctccttaataggtatataatttttactaatctagtttacagtattagtgaaaaagtgtcaagaaaagaaatcattcattagtacttgaacttcttcatatcgtcatcaagctctgtagcaatatcctgcaggtctccggatgaatgctcgatctcgtctgctatggatgtgatcgaagatactgaagccgaagactcctctgtgcttgctgcgttctcctgggcgattgcagaaagagaagatacggtctctacgactttctttctggcctcgtccatctgcttcatctgagaagaaatggatgatacagcgtcgatagaagcatcgattcctgtagaaacttcatcgaatgcgctcttcgtgcgctctacgttgtcagactgctgctcgatgatctcgtttacagaatccatcgtcttaacggcctgatctgaatcctttataagcttatctactatctgctcaatctgctttgctgagttagatgactggtcagccagctgctgaatctgggatgctacgacagcgaaacctctgcctgcctctcctgctcttgcagcctcgatagaagcattgagtgagagaaggttggtctcatctgcgatatttgaaataatggcggtagcttcgcgaatctttccagcggactcgttcgtagtcttggtctgctcggctatctgctcgatagtctgctttgttcggtcattcgtatctccaagctcgccaatgattgaaatagctgtcttctgggactcctgcatcttcgagttggcttcatcaagtccgtctacctgcttgttcgtctcctcgatcatgtttccgatctcgatgacgttctcagaagctgtctgcgtatgtccggcctgagatgtagcaccctgagcgatctcgtttactgctacatcgacctggttcgtagtctcattcatctccctgatgctcttgtgcattccggtcgacgagtgatagagcttttcagactgtcctctgatattcgaaattacgtcgatcagcttgtgctgaagatttacgatggctctggccataacaccgaattcatcggttctgctggtaagcttttcactgttcgcatcggatctgaaatcgaggtctgacatcttgttgataaaatctgtcatctgcttcaacggacggagacttctgatcagaatatataccagaaggataagtccggcaacaccgatgatacttccaaagagcgaaccagctatcagtgtgcggtcaacgctgctcatgacttcagaataatctgcagaaataactatgataaactttccgtcagaagctatgtaatatgaagcgtacttcttcacaccgttgaacaaatactcagtagtgatatttctaggagaaggaatcgttccccctttgagctgcttaacgagacccaggactactgagttctcaaccggttttccgatcttagatgccgtagggtgatagagcatcgtgccatctttatttacaacataagcgtagctcgatgacaacccctgtacaccaacgccagcgaaaatactcttcagattgtttccgtccaggtttcctccacctttctcgagtgaaacgccgtaggcttttgccacatccttcatgtagttcttggttgtgttttcaactgaacttctgaattccgagatcatgatcgtattcaaaagtaccacgactactgcaattacagcgacggtagctacaatgacacgccccgtcatcgatctgagaaaagcgaccttgttttgatgtttttctttttccatttgcaatgtcccttcaaagaaaatttgtaaaaattacaaagaatttatattgatattatcgcactataaaagtataaaaacaagcttttttctaaaaagtcccgtcgattgggaaactattcagaaccttttgttaatatttttacaatttcaccgtagctctctgctttatgtggccagctgcagtccatacatgactttatcttcctcccgtccttcgatgtaacccaggtaaaattcccgggacagctgctaagaaagtacagcgggcagtagcagaaaaggcagttgatatgctccatgtcgtgacagggatagtacctgcactgatgattttcaaaatatttaaaactgttcctgtatctttcttccataatttacagcctcgtcgacaaaatgtgctggaaatgacagacaggacggatagtaaaaatgcataaacccgaggaaatgtttctcgtccgcaaatccctcgtcccatgccttctccgaagaagcttttctcacgcgggctccatttcccgtatccctgacatcatagtagtggaactcgtggcctcttatctttgaaccttcttttacaaaaaaatgtaccttgtcacacgcctcgagatacccgaatctcacgcttcttccagtgtagaagcagtccccgtgcaaaatccccgtaagctctcccctgcctccaatcgtatcgtgcagatacataaaaccgccgcactccgcaatgacaggcattcccagattccatgcctctctgatcgaatcaagcatcggtttattttctgaaagctcatcgatataattttccgggtatccgcctggcagtatcaggcccgaggtcccgtcaggaagtttttcgtcgataagaggtgagaaatactcaataccagcccccgcatcctctaaggcaaattcattttctctgtatagaaatccaaaagcactgtctcttgcaacggcgatctttgcgcggttttcgggacgttttctggtttcttccgcggcatctgaattccgatccgctctaatatctatatcgtccatttcggcgattttaacaagctttaaaatatcgcagcgctttgagatttcttccaggagaatcctgttctgtcccacactgtcactgtcctgaggaagaaacagcccgaggtgtcggctcttaacctgaagttttccatcgttcggcagatgtcctatgacaggaatttttgtgaactcctcaatcttttgagcgataacaggaaagaatgaatccgagaccttatttaaaaaaatgccgcgtatcaattttttcttatcgaagctgatgattcccgctatcacagaaagaagcgtctgagccgcaccgcgggcatcgaggcagaggatgatcggcattccgagagtctctgcgaggtcgtatgacgagccctccggcgaaaaaccgccgagcccatcgtaaagccccatgactccttccgctacagctatccttttatcctctggcgtgttacaaggcacgtcactgcagtctcttgcgaaaaggcgcctcgtcgtcttatcatctgtaaaaaatgtatcgaggttatgccctctgatctcggttatctgctcgtgatacatcggatcgataaaatccggtcctgacttgaacggaacaacagaaaatccctcttttttcagaagaagcatcagggcacgtgtcactgtcgtcttacctgaaccgctctttgcggcagctatcattattccacgcataaatttttcaccactgtaatatagagtgctctctccggcagatcttcaggcagctttccttcaaaaatcctctggccggcgctgcctaaatctttcccggtaaatatctgcactttcatatccttaaggaaatcagacacagcagaagcatcgctttttcccgagaagaggaaatacgaaagcctgttgttttcgactgtctcctttatctcatttaatttcagtgtttttccatggtaggatcttatcgcggcgccatcataaggcaggtgagtcgcggacgagagcatctgaaccgaagagattccaggaagtactcttatctttattccatttttttcttctaagctgagaagtccctttgctccactgtaaaaaccgctgtcacccgaaaaaagcacgacagcccgcgagcagccgcttttcgctatagcatccgcaatatcgtccggcataaatgccttcaccttcacacagggattgctctttaccagtggataattcagaaggcgctctgatgctatgataatatcagcattccttatcgcattggctgcctcgagcgtaagagttctttccccacagcctgcgccgattaccgtgatgcttttttcaggaacactgactgcctgatcctgccgcctctcgatcgtaatcacagatacgcctgctgcctgcgctgccctgatcttctggtcgtagcctccggccttaccggacgcctttgtgacgagaagacctatatcatatctcttcaaaagcgcgaggttttcttcgtaagtaaacggtccctgctccgcaatgatgtggcttttttcgatcccagcctgctcgcagagctctatagcccgaatcgaaggaagcactctgacatagagcctgtcgcgaaatccggcgaaatatttaagttcttttgaaccagttgtgagtaaaatcctgctctcagatgattcaagaagtttaacagcttcagcggtatctttcacataggagacgttgaaatccggctcatgcgaagttctctccctctcgatcctcctgtagtctatgccaagagaagatgccgccatctttatgttacggcttgcctcgactgcatatgggtgggtcgcatcgaaaaccagatcagtatttttctctttaaaaaagctctccatctcagtctcatcgagtcgcccgatatgaacctcgataagcggatcaggcttcatcacttcttcgccgtaatcggttgcaacgcagactgtagaagctatccccgcgcaggcaaacgactccgctaaaagcctgccctctgtcgtcccggaaaaaatcacgatgtttttcatctgctgccctttccgtaaatgcttatcgtaacgcgctctgtcttcatctttccgacgatcttctttgcgccgtgtccggcggaaagcgatgccgcccgctcgcagacgttgtctactccgactgtcgcctgtacgaacggcgaagacttgaagtacccctccgcctttttaagctcctcggccgaatatgtaataaaaggcacgccaagcgcgtgacttaagtttataagtcctgtctcacttctcttgatatcgatagaagaaacagaatcaatgcatgccatgcagagattcatattgcttaccacatcttttaaaaatgaaaaaatttcgtcgaacccggtgaatttccggcagcctatgccggcacagagatttttttcaaaaaggtatagacagctggcgtctatcccggcatttaagaggaattcttctctgacctgtctttccggcagaggcagaaacgggtcaagccccgccgattttaaaatagagataagcccgtcgtttccaactatgactatgtcaggccgctcttcttttccctgaaccggccgcagatattttctgtaatcgctctgatagagccgatggagagattcacttttcactgagatgatatctccgctcaggactcttgaggagatggtttttatcgccgaaggattcagaatgccgaggccgtttttctttgcaaaaatatccacggcgaaggtgtgatttacatctgtggcagtagtgatcactgctgtcgctgaaagctctgccgacagcttctctgccagctcgtttgctcctccgatgtgtcccgagagaatcgggattacaaaccttccggcctcgtccatgcatataacagccggatcagtcgtcttatcctttatatacggcgctatgagccggacagcaattcctgctgctccgataaaaaccagcggaatctgatttaaaaaagcttctgcgatatttttttcagtgactccggctgtgccatctataagctgcttttcatccgggatcttttcggccagctttctgccgtttgcggtaaaaaatatgacttttatcatttccggtactccgtcgtgaaatctgggtcgtagaggcagctcctgtcaaaatcagactgcgacagcgcgtccccgacgataactaaagctgttttaactatgccttcattttcctgacaactgtcaagttttccgactgtggtccttattatcttctggtcaggccagcttacgcgaaaagcgatcgccgccggcgtatcctcgctgtatccaccggctaaaagcttctgtttcagctctctgcacctgtttacactgagataaattgccatcgaagagtgagttctggccagattttcgacagattcttccggcgggaccggcgtcctgcctgcggtccgtgtgaggatcagagtctggcttattcccgggagagtgtactccattcccatctcagatgctgccgcaaatgccgcggtgacccccggtgtcacatcgtacggaatatttttttcttttaaaaaagcgatctgctcggcgatcgcgccgtagagcgacgggtctccggtgtgaaggcggacagttgtttttttctctgcctcggccattaaaatgacctcttcgacctcctcgagcgtcattttcgcgctgttataaaccagcgcatccttctttaaaaaatcagcgaactcagcactgacaagcgagcccgcatagatcaggacatctgcattttttaaaaaagaaagcccacgcaccgtaataaggtctacagctccgggccctgctcctacgaaatgtaccattatcttctccctataagcctttgatttaatgtataaaccatcagatggacgttcacatcgggaatccagtggcttatcgtattcgagatctcttttaagatcagattcattacttcatctagatatccaagcgatgccagatagtccgccgcttcctcagtcgtattggacgcaaggagctttcgtgcctcatctgcagtgcagcatggcactgctcgaagaagcgctgctgtaagaatctccatcctgcagtcgccgtacttcgaatgagtatttgaaaaaccgccggcaacttttactatctttcccagatgtccaactaaggtgatatcccgaaaaccttcgtcctcagcgatctccaatgcatcacggataaagttcgaacactttacagctgcgtcgagatctatacaatagtccttcaggagaaattcctgtccgtaatttccaaaggccagaagaaggctcctgtcacctaaaacttttcgctggtggatttcaaccctgatcgtatcgacaagtgccgcatcgctcatcggctctacgatcccggtagtccctaagattgagatacccccgacgattccaaggcgcggattgaaggtcttcttcgcggtctcttcgccaccgtcagcctcgatcgtaacggtgacttttcctgtaaagtctgctgcccggcagaccgagagcacattgtcccgaatcatctcacggggaacgtggtttatcgccgcctctccgacaggctgatcgagtccgggttttgtgaccgttccgacgcctcttccgccttttataatgatctcattcgtgccgccttctgacgcttctgctatcgctctgatcgtcatcttgtctgtcacgtccggatcgtcgcccgcatcttttaaaacttcacagactcctctgtctttaagcttataagacggactgtactttatctgcttcggtgtcattatagagatgtccttcgggacgaagccgagaagcaggtcacaggcagcggcttttgccgcaaaagccgctgccgaaccagtagtaaagccataccgcagctttttcatttcgactgtcctatatgctttaaggccgcatttacgaggcaggcggcaatattgcttccaccctttcggcccctgtttacgatgcatggaattttggtcttaagtatcagatccttcgaataggctgcatttacaaaaccgacaggcactccgatgataaagtccggattgaagccctgttcgcagtgcagcagatcgagcttcaaaagtgcggtcggagcatttccgatcgcaaatatttttttgccttcaaggtgggcggcagcttccatcgaagccgcagctcttgtgataccctctttctttgcgatctctctgatcctctggtcagacatgaagcagtgagcttcgcagccatattttttcagaccgctcttattgatcccggcgagcgccatctgggtatcgcagatcacggatgcgccgtcccttatcagatcttcgaggacagctgtcgcattctctgtaaatgtcagcgttttcgcataggaaaaatcggcactagtgtggatgcatctcttgatatagggctcctcttcaggtttcagcttaatgccttccctgtcaagttcctcaccaattatgcggaagctttctttttcaatttcttcaggttttacaaaaatatactcgtcatctgccattgactatctcctgtactgcagcgagtaactgcatatttttcggtctgtccttaatagctatgcggtagtaatttccattcaatccatcaaaatccttaaggtcgcggatcagaatctccctcttcaaaagctcatcgtagagcgggatgtccgtctttatcataagaaaatcggcctctcccgggaaaaccataaatcccatccctagaaaaccactctgcacaaaccctctctctgccctaaggaacgaacggctcctctcgagataatcactctcatcgagcgccgcgagtccgcatttttcagcgaagatagatacattccactcgctctggtgggtagcgatctgcgaagtcagcttctttggagccctcaggtatccgagtcttactccagccatcgcaaaggatttcgtaaaggctgaaactcttatgacattgtcaaaagtgctcttgaataaaaagtcctcgtagtcgtttaccttatcgcagaggtgcatgaagctctcatctatgactacaagtatatcttttctctggcagtgctttaaaatattgtcaagcagcggtatcggaaccgtccgccctgtcgggttgttgggcgtcgcaagaaagagcatgtcgatcccactgtcaagcatctccgcgatgtcgtcatcgacttcatagccaagcttctctttaagcggatattcttcaagctgcgccccgacggcctgcgccgcgtacttgtagcctccgaacgaaggtgtcacgacaccgatcttctttggcttaaatgtaaagactatatccagaaacagctctgaagctccgtttcctacaagcacttcctccggctcacagacaagggtatcagcgatctttctcttaagttcctcctgctgtggatcagggtactgtcccgcaagatccgctgccgctctcgccgcgtccagaactttcggcggcacaccgagcgggttcgtatttatcgaaaaatcgagcctgatgtccttatgcctgtaaacatctcctccatggaactgcatatctctataactccttaaaaaatataaaagccctgaggctttaaattatcaaaaacattaaatcaagtataacacaaaaacacagattatttccataacaacagatgccgatatgacaagccgctgtgtgatagagatatcagaaagtgtggcctctctcttattttctccaagctgcggcctgtcgataaggactccgccgtaaagggcgcttccaccgagttcaattcccaaagcgccggccactgccgattccgggcagcccgcattcgggctttctgtctttctgtgatctcttctaaaagccctgtacgcgcctgctgcactaagcctcttcgaaaaaatgcttaagaaaataataagagctgctgtgattcttgccgggataaaatttaaaatatcatcgagcttcgccgcggctcttccaaacgaaaaataccgtttatttttatatcctatcatcgagtccccggtgcttacagccttaaaggccatcccgccgcagggaccgaagagcgccagataaaatatcggtgaaataatcccgtcacttaaattctccgcgagagtctcgataaccgcattaattatttccttttctttcaatctgtcagtgtcccttccgacaacgtatgagagtttctctctcgctgcataaaggtcgttatttccaagagctttttttacaggtgaagtctccctgacaagggaagcagttgaaatgcaggtacagctcaaaaaagcctctgccgcgataaagagatacctgtttatctcaaagcagatatataagacagccgcatttgataaaatcgaaagaagaaccgcaagtgccactgtaaaaagccctcttgaatactcctttaagtttatgtttcctgcgccctctgctttgtgcccgctgttgacttcaggtccgagaaacgccttatcgagcgctgaatacaaagccccgatcatacgcacctgatgcagcttaaaccagtgagggtcaccaactattaaatccagaataaatccggccagaaagccagccagatgaagtctaataatttccatcagttcacttctactgtaaaaaagtacccctctcccggcgccgcagaaaatgagaagtaatcctctcccgtaaatgccgaaagaagtgccattatagtgcccccgtgtgcgactattgaagcgtcgaacatctcatttaactccagtcccgcggtgaatttttttacttcttttatacttaacctgtcctgagaaacgtgctgtttttcaatatcatctactacgatcccaaaacctttaagagtccgcctgataaactcttccctgctctctcctccaggaatctgtcccacacagccgctgtcgacccactcgcggtactcagggagatctttcatatcctgataattttttccctcaaaaataccgaagtccatctcgtttaactcatcaacgatctttctcttcggatagagcctcgggtagataaacttcgcggtgttctggcagcgaagtgccgggctcgtgaagaggtacatggcgtttggatattccctcgcatttttcttaaaagaatcgacagcctcaggcgtcagcggttcctggctccttcgtccggtgtacctctttaaaatatttccctgcgtctgcccgtggcggagcaggatgattcttaagcgttttttcatagaaggtctccaggtcatgcaccgaagaatttgatgatcttcgatatcgcatagtccatcaggttcggatccgtaaacgggtggtcagcattctcaacgacttcgtactcgatcacattgtcctcgcagaactttgtaatgtcctctacgctcgtgtactggtccttcccgccggctataatcatcatatcgtcggcgaagtccagataatccttgtcagagacattgttctcttccagctcatcgagaaaatcctgcgacagattgatctttctcttgaagccgacatttacatcttttttcttctttatctttgcccaatcgtcgtccgtgagccgtccggcaaagttctcgtacatatggatcgccggaactctgagtgcgatctttgtaaacggatttccaagtttgtttagatatagaagcgtcatgtatccgccgaggctcgtaccataggcatagattcgctctgctcctctttcttctttcgcatattctacgaccatctggtagtatttcaaaaattcagagagtatcatcctgtttctcgcatcggccccgtggcacggccagtcaaaagtgaccacctcaaaatttttgtgcttcgaagtcagcttctcgctgaatttttttatcgcgctgttctcttttaccccgccgaatccgtaggtcgcgatcacgatatccgtaacgtccttcggatccttgtcatagtagcagaggcatcttaccgaataaccatctttgtttatatcaaactttttctccatttcgtgctccttttaaaaatacatacaaaaacatcatagctcacaatgaaaaatttctcaataagtgatatacttcatgcatgttagaatttaaaaatcttgtgatcggatacaacaacactccacttgtgaatataccggatatgactgtagaaggcggtgagattttaagcgtcgccggcccgaatggctgcgggaaatcaacgctgcttaagactataacctgctcccttcctgctgtctcgggagatatttttctcgataccaaaaatggcagaagagaaagccttaaatccatcggccgtgagactgccgcaaaaaatatctctgcactttttaccgacaggatcaagggcaacggccttcgctgctcggacatagtcgctgccggaaggtatccttacaccggttttttcgggaagctctcagaacacgacaatgacatgatccgacagtctatggaacttacgaatacagcagaactcgctggacggcagttcgacgcgctaagcgacggccagaaacagcgtgtccttctcgcccgttcgatctgccaggatcccgaagtcctgattctcgacgagccgaccgcatttctcgatatcagataccagtatgagctgaaaaaaatcctgttaaagctcagggaatccggcatcgccatcataatgtcgattcacgaactttctctcgcaagggaatgttcagacaagattatcgcgataaacgaagagcaccaggcggcgattgacatgcccgaggcgctcgacgatgaaaaatatattcacaaattattcgggatcagagattagtttttttcatcccgatcagtctgttgagaaaatccatatccagattcttctccagaatatctgcgagtctgtcgagctccgcgttcgtagactcacgctgactgatctcacttaccttcttcggggcaagtccctttctcctgtagataaaatccagaagtctctgtaccggagctgtctcatcgaaaaatccgtgccagtaagttcccgctataagatttttctcatcaataaatccctctgcctttccgttctttacatctgggataagcggctgcacttccccagaaaatctgctcactccacagtgtatctcatagcctcttacagccccgccgtctgcaaagcttccctcatcctgacgggtcgtcttgtctttgtccataattgtggtcatcggtataagtccaaggccatcctcaaagccgccctcttctattccataaggatctgcgatattttttccaagcatctggtaaccgccgcagactccaagtacaggtatttttccaaagctctcctgcagcagtcctgcaatcccagagcgtttcagccaccttaaatctgcgatcgtatttttcgtgccaggaagtattataaggtcaggatttccgatcgatgcggcatctgatacatacctgactgacatatccgaaagtctctcaagcggaagaaagtccgtataatttgaaatcttcggaaacctgatcacgactatgtcgatatcctttgccctgtggtcttttaatctctcagagagcgaatcttcctccggaaggtcaagtctcgtaaaaggcagaacacctacgacaggtttcttcgttttctcttcgaggatttttactccgtcctcgaagagttctggatcgccgcggaatttatttacgataagtcccctgataagcttccgttcgttctccggaagcagggctacgctcccataaagctgcgcaaaaattccgcccctgtctatatctccgactaaaagcaccggagcatttacggcagtggccagtcccatatttacaatatcatcttttcttaaattcagctcgcagcacgagccggcaccctcaataactatcagatcattttcattcgagagcttctggtagtccgcgaggatggctggcatcagggactttttctttttaaaataatctcttgccgaaagattctccctcgcgcggccatccacaatgacctgactcgctgtgtcggtcgacggtttaagaagcaccggattcatctcgaccgccggctctttaagacaggcctgcgcctgcagagcggtggctgtcccgatctccccgccgtctgctgtaacaaacgaattcagggccatattctgcgatttgaatggagcgaccctaagccctctcctcgtataaatccggcagatacccgcagttatcaggcttttcccgacaccggacatcgtaccctgtatcatcagattttttgcactcatgctgatattacactatctcacttttattcccagacgctgtggtctctgccagagccgatctcaaagttgcattttacgattcccaggtcgaggctcgtaaaaagaccaaatccggactttgcgataactttatcgccgtctctcttgaatgtaaacttctgctggtcgatacaggtcggtgccagaagcgccgcctcaatcccagcccgataccaatccggatcgtcctccttatagtcacttacatcttcgatactcttggatttgtgcgctgtgccctctgtctttccataacctaaggctatcagcatatagcgcttttcgccagggccgacttttcccttcgttttgctcctgtcgtatgtcgcagcgacccagcaggaatttaccccaagcgactgggccagaagtacgatccactctccatagtatccgatcttctcatcgcttcccctcggcccgatcattgccagatagtttcggcacccttgaaaattgccatattcaggcttctgcgcctggaacgcttccggctcatttaacataagctgaatatgcagtacaccttctctgttcgcagcctctaccgcttctttcagttcctcaactgcatcgtcgacaagcggctgatctgtgaatcttcttacagcgtgccttgtctggatagcgtttcgtaatctctttatctcttcatgtgaaaattccatagctgtcactccttttttctattatactctaatttttcacatttcgatataaaataaaaaatctgccagaccaaaaaagacctccccacatcgctgtgggaaggccgctatacatatatggaaatttttcaggcccagatcgtatggtctttgccagaaccaatctcgaagtggcattttgcgattcctaaatccatcttcgtgtagaaacccagtccggccttggcttctatcttgtcgcctgcttttttaaatttgaatttctgctgattcatcgcagtcggcgcaagaagtgcggcctcaagtcctgctttataccaatccggatcaccatttgtgtaatcgcttacatctgcaatcgtcttgctcttatgcctgacgccctgattttttccatatcctaaagcgataacgacatagcgcttctctcctggtgcgatctcgcccttagcctcgcctttcttgtaagtcatagcaacccagcaggaatttatatccatagcctgattttaacttgcttgcctgcgttctatgcagtcagcctgcatggtatcttccagcagtcatcccgcatggtgtcttcccgcacacagccctataatcactatgatggctattacaactccgacagtttccaacaggtaagcagcgatcgcaatcacccctatcgccatgaagattccaagcaaaaacggaatcagatgaaaagccgccgacaacagccagccaaataccttaacgatgcctactagaaaggctattatcaaaagaatacaaaaaagtgttatcattttaactccttaatgcgaaaaagaaatagtagttccccaatcagttctggcttttcttcgctcggctcagaactgacataatcttcttataagtatattcttcgatactattaaaaaggaagcccgtctggtggcaagcttcctaatcaataaagacatctggtccaatggtaatgataccgattcaagacttgtttttctggttttgatgctttctagcttctacagctttcttgcatttttccctatcagatccttgcatacccaagaaatcagcagccgaatcgaatgttaaatcatgaagattcataatatttattaccatatttgttttttcttcttctcgaccttcttctcggtactcatccttcaacagcctcatcgttctctcttcgtcataatctgtaagtaccatatccatcacctctgatctgtttctccgtatgtaactcttcacccagccatcatcaagtgcatcaagcgcgtaatctacagactcctcgatactcttcccttctgtgttagctcttctggtgtaatatacaaaattcgaataatccctaagcggcttgcacttctctaacagctcaccgttgttaccacggttgatgttaagcatacgaaccttgaattcaatcataggttcagcacatgattcaaaagcactgctaagcttcaagatgccatcctactgttgccattgcgttcgatgtcttttgccctttcctgcctgtaactgctcaaaagacttatctaatctttctaaatacttggcgttttctatctctttttccatttcattatagcggtcaagactgagaatcacgacattcttgtcttgttttctggttacaacaattgtttctccctcgtcagtcgccttatcacaataacttttaaaattattacgcattgacgtattgaattaaaatattactcaacacatcgcaaaaagccctataatttccgtttcttccatctggtatagcaaaaactactttatcaaaataaacgccaaatccctcatttaccaaaacatccttaaatgcatcagcaacctcaaaaggatcatttccgaaggcgccgcatccccaggcgccaagagtgacggaatggtaaccattttcaactgcaacgcaaaggatatgtcgaattctttgtctataatactcacgaagtccggatatatccacgccacgagctcttccaaaaagatttggtgctgccacagaaattacagcagtagtatgcgggtgctccagtaaattcatatggcaatcccggaacacctctacacatggcgaaagcagcagataatcagtgtcgagatctttcacatgcatgttactattgtacatagttccggcattctcagaatctattgaggcataaagtgtagactgccggcaaagagcttcctcctgggctgatgctccgctcaaatatccgccgccaggatggcgtgaattggcaaaattcaaaacgcagtccgttggagtagcaaagctgtctccgtcaataacttgtattttttcagaagctattgactgcttaggattctgatatttctcaacaagttctttcagtttctcaggagaatagacctctactctttgatgatcctgtaaagaatgatcaaaatggacttttacaccatcagactcgttataagtatattcattatttttaactatctctctgttttcttgacaaatatcaacaaaaagcattcttctattcataatcgatcctaattctgctctgtgttcagggactttcatatagtctatgcccttttgaagattctccaaaacaaactgtcatgccacatctgcagcattattaatcactttctcggcttccttgttgcgttccatctgctttttatctttatcgagatttacaggtagaacagatttttgaaatctcgtccaactagtctgtaaaggatcaggtaagcgacccattctgcctgatcttcgtattcatcccactgctcctggcgttgattttgtttctgacgcgggtcttctctgaaccggtaagcaggtgtggctggaaatcatttgtattccatacgcctgagagcgagcatggtaagacttttgctgcttttttagaagtaagttttttgtttttgaaagtgaaggtttgctggaagatcatcgtatccttgtctcttggatttgagtttcctccgaaacagaagttgcccatactgtagactatgtatttgcccttgtacttctctattccctgaagtacatgcggatgtgagccgagtacaaggtcggcgccccagtttattgaattgtgtgccagctgcacctgggtgctgttcggtctggagcttccctcaattccccaatgaaagtagatgataataagatttggtttctgtttctttgctttatttataagagattttacgtaggcgttcttattgccctgggacgaaagagcatttacaccgatcatggctattttttcaccctttatcgtcttgtaggatatcgcatcgtaaccgaagcatctgatgccggcgcctcttacagcccttttcgtatcattaaatccctgtgttccaaaatccatcgaatggttgttggcgacagtcactgcctcaacgcttcccttcttaagaatctgcgtatattcattcttccctttaaaagtaaacttctttctcgccctgttcgtgctgtttgtaagtgttccttcaagatttacgatagtcagatcgtccttcgaaaatacactttttactttattaaggaaatatgagctgcccttggcattgtacttctcattaaaacgattattgaatctgctgtctacgccaagcgtgcagtcaccagcggcagaaatcgttatttttacagttttggcttttttcgccgcctgtgccctcaccatgctttgcggcagcgaaaaattcactaagccaataagcaaaccactcaaaaccaaaaccgaagctatttttttcttaatcattttcgcacctctttctcatatgttttatctgacttcatcactgaactgatataccatatttttctttcctttttggtaaagtgctgattcacaaactcattctactgcttttttctaaaataaacaatatgactattctggtatttctgcccccacaaccttataaaatttcaccacacttgatatatatgtcaaatattaatataatagatgaaatatgaggaaaactaattcaaaaattaaactttcagaccacttcactcccggcaggatgatacggttttctctgccttcgattggtatgatgatcttctcttcgatctacggaatggtagatggatatttcgtatcaaactacgccggcgcgactccatttgcgtcattaaatctggtaatgccgtttataatgatactttctgcagtcggtttcatgttcggaaccggaggcacagctctcgtatctatgactttgggaataggcaacaggaaaaaagccaacgagattttttcgctgctgacttatactcttatcgtctgcggcgtcgtgttttcaatttttggaatcactgtcgccccggcaatgtcaaaacttctcggcgcaacgccaaagatgcttccgtattctgtcctctacatcaggataaatatggtaagtctcccatttttcctgctgcaaaacatgttccagagttttacagttacagctgaaaaacccaagctcggtctggctgtgaccattatggcaggatgcacgaacatgttcctcgactggctgttcgtcggcgtatttgggtttggactcgccggtgcagcctgggccaccgtaacttgtgagatcattggaggcaccatcccactcatctattttttcagtccaaaaaacaagtcgcttctgcgccttggaagaactcacatgaacggtcacgcacttctcaaaacctgcaccaacggttcatcggaatttctgtcagactgcgcatcctctatcgtcggcatgctctacaatctgcagcttatgaaatatttcggtcagaacggagtcgcagcctacggcgttataatgtatgtaaacttcattttcgtcggcatttactttggatattcgatgggcatggccccggtcaccggatacaactacggcgcccagaaccataaggagttgagaaacgtcttccgaacttctatgaaaatgatcgctggcgctgccattgcccttacggtcatcgcggaacttctttcaaaattcctcgtgaacatcttcgtcgggtacgatccgcagctttcccagctgacagtccacgctttccggatctatgttatcgccttccttttcatgggctttaatatttacggctcgagcttttttacagccttaaacaacggcctgatctcagccatcctttcagttgccaggtcgcttgtcatgcagcttctctgcatttacctgctgcctctcctgatcggtccggacgggctctggggcgccatcatagcatcggacggcgtctgcctgatacttacgattttcatgctggtcaaataccagaagaagtacaaatactaaaaatatgagaaaaatactgattacaaatgatgatggaataaaatccggcggcataatccgccttgcacaggctgctctcgaatttggcgacgtctgggtcgttgcgcccgagggcgagcgaagctcaatgtcacacagagtgacactaaaccgggatttttacgtatggccagcagattttcctgttaaaactgatgacgagtcgcacaaaatccatgctttcgcctgcagcggaacgcccgcggactgtgccagaatcggcattctaaacatcgtaccagaaaaacctgatgtcgtattttcaggcatcaatttcggctacaatgcagccaccgatacccagtactcagcgacgatcggcgctgcgcttgaagccgcctttcagggtatcaccgcgatcgccttttcagaaggcgctgactttgcaaaccgcgcgaacagcatccacgaggtgaccgaccgctatcttcgcgacatcatcgcagagcttatagataaacgacttcctgcaaaccagatctggaatgtcaattttccaatgtgccacctgaacgagtgccgcgggattctccgcgaccgcactgtatcatctgacgtattattcgaagaccgctacacaatgaagcccgacaccaccggcagatatgtctgccacgtcaatggcaccagaagaaataccgcagccgaaggtacagacttaaaagcactctttgacaactatgtgtcaattggaacggtcacgaatatttcgtagcgatgcaatttttcccgcgcaaaaacagggcctgccgcaaaatctgcagcgggtcctgttgatgaatctaaaaattcacttagctttcaaagccgctctcttcattgcgcgaatctcttcgcgcgtctcagacgagatcgttctcgattcgatgatcttctggagagtcttctgctggacttccgtgtcgagattgttattttttaaaattggcatgatctgttctggaaaatgcagatagcattctgccatcgcccatgccactgccatcttcgcataatatgcctttgcatttatctgcataagtgcgttcacggtgagggaaagccaggtttcatcaataaaatagtcgagcaggatcactgcagcaaatcgctgttcgaattctttttctgattcaatatacggctttaaaaaattaaagacgagttcctgttccgatcttacaaattttagtccagtgcagaagctgtcgcagactgaccagttgtctatcttcggcacaaactctttgataatttgaagtctctcatctgccgggcatttcgcatatccgataaccatgccctgaagcattatttcttcgaatgtgtcatctgaaagctgctgtaaattttctcgccagccttcacctgcaagccgcttcgctatttttcgaagttcagggagccgcacaccaaggatcgagttcacgccgggaagcagtccggctgaaaatttcttgtatttttcatctgaatgtctaatgagttcctcccggatctgcgttctgtccattgtttctacctttcttcttccaaaaatggcggatttaatttttaaaaactactttcaacgtatacccggagtccaccgcatttaccagcggctcgtaaattttccagacctgctttaatgcgatgtcatcagccttctttaagttctcttcagtattgaatttattttcaagcttagcggtaagagccttctcgatagtgttgtattcctttgccgacatttttatatcgcttctgttaataaatgaggcatttacttcatcgatgataactttattgaagtcaatgctgatatcatcgagctttgcatgatcgatttgaatggtaagcgtcttcgtgtccggatcttcaataatgtcatttttcgtaagatcctggagatcgacgataaaatttccatgaagtcatcccctgagtcattccttgtcgacaatttttttctctttttcagctgattttttctctttacgaatcagctctttttctgccgccagatccttttcgagcttgtcttttacctttgtcccttctttttggagatcaatgttaaatacctgtttcaataaccatacgaaaaatatcgcaatgatcagaggaaccaagaaggttgagactaataaaatggctacagaattaataaatttcctgaccatattattgattttttccattacattggcaacaccatttgctgctgtctgtagtgctgacccgattttttcaagaacattcttatcgtcagatgaatcattgatattattttttattttgcttgtgttgtccttagagctcgaaattgttgtatcaacatacttaagatattctccacacgccagatctgaaaagccactacagacgacacgccgagcgtaacacccgtcatcgccatgaccgtgtttttacttttatccaggctcttgaaagaatttcgaacgataaaagattttggtattgtttgcgcgagaataaaaattgatacaactgcgatcaaaaccagtcccagaattttgataagacatgttttctttttttcactcatcttagttccctccatgtgttatattattagaattaaaactaaatacatcttattttaccatttttcgagaaatatatctctgtaaatgtaaaaatacctgtcgcagcgaattgtatatttgtatctttaggtctataattaatcggaaatttttcaatttgaaagctggagtattatatttcccatgcataaaatgatctccgaaatcctgaaaagtgagtatggccagaaaatttacaagctctctcttagttccggctgtacctgtccgaaccgcgacggtaatatttccaccggtggctgcacattctgctccgccggcgggagcggagattttgccgcgccttttgaagatatcgataagcagattcttcttgcccgaaaaagggtcgacgccaagattcctgcgcggataaagccagaggaccgccgctacatagcatattttcaatcttatacgaatacatacggcgatacgaaaaggctctcaaagctttacaccgagacgatcaatcgtccggagatcgtgattttatcgcttggcacgaggccggattgcctcaagccagataaaattgaaatgatccgcaatctcaacatgataaaacctgtctggattgagctggggcttcagactgtaaacaatgcaaccgctgcacatattaacagaggctatgatctggaagtttttaccgatgcctatagaagacttaaagaaatcggcgtgaccgtgatcgtgcatgtgatcttcggacttccaggcgaaaacagggacgacatgatgaatacgatttgttttttatcgtctcttttaaagccgggcgacggcatcaaaatccagctccttcatgtcctgaggggcacccctctttatcaggaatatttagatgcacattttcatatacttactctcgaagagtactgcagtctcgtgtacgaagctctcgaaattctgccagacgacataataatccaccgcctcacaggcgacggtccgaagtcgcttctggtcgaaccgaagtggagcgcaaacaaaaagagggtgctcaacaccctccgcaactgggacaccagggacggttagagcggttgttatgctgtcgcgagtccgcaggacgaagcgagagcattataaaccacctatgcgatagccgtccgcgattgacgagtccgaaggacgaagtcagaacggaaacggcgaaccgctctttttgtcccaaaatctgaattgtaaagatttgtagcggcattttcaaaagattttaccgacattttcactatggaacgtaacaaagcttatttgtagcaaatgtcttaaaagctcgtacattataaaaatagtacattatcactataggcattttgcaaatcaagttgcaacacagcattgtagcaaagctctgaattcatacagtatattgaaaatcagaagactgaatttgtaacaaaataagcaatatttaccaaatagaaaaaacctcaaaatttgtttgtcacaaaaagctttctcaatgggctatggtgataaccgaaggagacagatcaccttttcgatacgctatattaataatttcctgctccgcggagcttgatatcattgcggtttggagcgatcgggcatccaaaagccttatagtaataatttcctgctccgcggagcttcatgacatttctgacgaattcagtatcgttaccccattgccctcccatgcggagcttctttgtcctctgccatcttgtcagcgctggcatatatggctttgagtcaggaagcagcgccgcagatagaggcgggctcgcgaccttaggatttttcgtcgtgagcgggcgcgctagctgcggcccgggttgccacccgcctggaccataaacgtatgtaaaccatacattggcaagagggccgcaattaggcgcgcgcacgcgaacagaaaaatcctacggagcgagaccggccatctgcggcgctgcttcgggcaaaaaaatatcaactgtctaagtcttcaaaagtgggacaaaaagaaccgtccctactgtcccaaaaaattagagacggtcgagaaccgaccgcctctgaaaaaggaaagaaaagatatatatgttgtttactctacatcagcaagggctttgatatcttcctcaccagtgcggaccttaacaaccttagctacattgtagacgaagatctttccatcgccgatgtgtccggtgtagagagtctgcttcgctacttcgataaccgagtcaaccgggatctttccgatgatgacttcgacttttaccttagggataagggtggaatctaccacggcgccacggtactttgaagttgagccacgctcgattccggaacccattacctgagacattgtcatgcctgtaacgccgagtttgtttaatgccttctttaaggcatcgaactttgaaagacggcagatgatcgtgactttatgcataccagagtcgagatctgcaggaagcggagtctcctcgcgaaccttgacagcggcattaatctgagcctgggaggcctgctcgaaatcgtcctcaccgaggtcagtgttctcgttcgcatcgacctccatgtcggtaacatctgtgatagcaaatccagagtaagcgcttgttaagccatgctctgcataatcgaggccatcgatctcgacctcctccggaacacgaagaccgacagtcttgtcgatgatcttgaatgcgataaacatcacgacaagtgcatagagctggactgtgatgaaggcaagaacctgaattccaagctggtggaaaccaccgccatagaagaggccctttcctactccgtcgtatccggccgagaaaagaccaactgctatcgtgccccagacaccgtttaccatgtggacggaaacagcgccgactggatcatcgatctttgcaacattatcaaagaactcaactgagagaactacgatgatacctgatacaagacctatgaaaaatgctccgacaggtgtcacgcagtcacagccagctgtgatagcaacgagaccagcaagtgaagcgttaaatgtcatcgagacatccggcttgccatagcggatccatgtaaagatcattgtaacgacagtggcaactgctgcagcgaggttcgtgttcataaatgcaagtgaagcctcgaaagcattctttccagtggacatagcagctgtcgagccaccattgaaaccgaaccagcagaaccagaggataaatactccaagtgccatcgctgtcaggttgtggcccgggatagctctggccttgccgttcttgtcatattttccaatacggggtccaagcatccaggcaccgaggcaggcgatcgttccgccgaccatatgcaccatcgtagaaccagcgaaatcgtggaagccgagctgagcgagccagcctccgccccagccccagtggccagtgacaggataaacgaaaagtgaaacgcaggctgaatagatgcagtaagctttgaaattggtacgctctgccatcgaccctgaaacgatcgtagcggctgtcgcacagaaacaggtctcaaagattacgtagcaccacagcggcatagtctgtgggactacagaattcgcagcagtgtagctgcctttgatcagcggatcaaatcctccgataaattttccggtgccaaaaaacatcaatccgaaaccaacaaaccagtaacacggtgtaccaatgcagaaatccatcaggttcttcatcaggatatttcctgtgttcttggctctcgtgaggccggcttcacagagcgcgaaacctgcctgcatgaaatagacgagtgctgtacagacgagcacccagataactgtagtaacttcgattttcataacaattttcctttctttttccgactacaagcgcaaaaaaagacgcctggtgggaataatctcaccagacgcccttgtctgtgttgcctaaaaatataaactatttggcattttttgtcaagccaaaattttcaccgtctcctgttagtaacgatcataaagatgacgaccggcgctccgagtattgctgtgacagtactgatattaagttcagtcggcgcaaatacggtccttgccacgaggtcgcagaccaggcacaccagggctcccagcgcaaaacaggtcgggatcacatagagtggcttggtatttttcaagagcttggtcgataaaaacggcaccgccactccgacgaatgagatcggccctgcaaaggccgcagccgtggcactaagtatgccgcttattacgacgataaaaagcctgagcctctttacatttacacccattgtaaatgcgtacgactcggagagcattatcgcctcgatcggtttcgagaggcagagaaccaccaggaagcatacgaaaacaatgacgaagctgatacgcacgctgcttatatcggcaccggagaagcttcccttcgaccagttccttaagtttacgacatcattatccgaaaagaacgtcacgagcacatcgcagacggcattgcagatgtagcctgtcataacgcctgctacgagcagcgctcccatcccatctatgtgcttggctattatcacaaggaaaaatatgacaagcatcgacccgataaaggcagcgcctatcattccaagcgaagtgatcgaaaagtcatagaccaccgaggtaagaagcagtatcgcaacgagcatctttgcgccagacgagatgccgagaacaaaaggtcccgcgatcggatttttaaaatatgtctggagcaggaagccggacaccgacagcgctccgcctatgatcatagacaaaagcgctctcggaagccttatctcataaactatcgagttgcccggggaaaagacctcagacagcggtatctttaccgagccggtagttagagcaagaataaaaaacactaaaagcaggataaggattccggcaatcgtgcgtataaaaatttttaagtcttttttctgtgacatcacttgagtttagtaaaatattgcttaggattaccatcggtaaagatgcggtgcatatctgtggtgatctcagcactcttgtcgacgaactggaagaggccgtcggcagtcgtatatatatttccagacttgacagccttaaaatccttgaagagtttgttgcggctctcaagatcatttaatgacttgatgctgttgtctgtagctgtatcgatcataagcacgtcagcgtccttcgccttcttgtagaagtcctcgaaggtgacactcacgtttgccatgtggctctttttgctcggagcctcaatgtaagagaaaacatagctgccgccggctgtctttatcatccgggccatatagtctgagcctctctttacggtgatgctaccactggtatcaatagaaaaatatgcgcaggtctttccagtgctctttaagttggcgaccttttttatcgtggccatctccttgtcgaagaacccggaagcctccttctcgtggccggtgataaggccatagactctgacccactccattctggcttcagacgtcgtctcgtagctcgaatagtccacaagaatcggaattccaagctttgcaagcttctccttaacagccggtgcgtgagttatcatcgtagactcgattgcgagaggaaccttctttgaagtcagaagctcgtagtccggagcagagaactttcctgcgtatttaatagtgcccttcttcatcgcagactttatctccggaatgtaccactcgttctctgcaatcccagaaaatccaatggagtcaatagcgtttatcgcacggaaattggctgcggcggcgcttgctgccagatagatgttatctattccctgagtgatcaccgtgagcctgtcacccagagcattttttacactgtctgaagaaaaatccttcgggcagatgagatagttgttgttgccgtcgatcacgagtagataaacagtctttccgtcttttttgtactcgcttatctcaaactgctttgcagctgtatttttctcagtctttacgagtttaaagccctgggcattaaagtccttcataaacttcttctcatcgagctggctctctgaagagtgttctgagtgagaattgctgtaaacaaatttcttctttccggaggtcttcgtacctgacgatgcagtttccgaggccttccgcgttcctgacgatgcagtttccgaggccttccgcgttcctgacgatccctgtgctgctgcgcagcctgacagaagcagcgctgctgcagccataattgcagctaatctcttacgcatttttatcttttaccttcttccttcttcttgaagctttgatacctatgacaagacctatcacaaagcaggctatcataaccgggattgccacatattttgcagtcgagaggtccgagccgccggtcctctcagccttagaggtatcgaatgtgatagtgtagtctataagatgcggcgtgctcatagcgacagtatcggcctttacctttacgggctttgagatgtcgcctacctttatgtcaaatctggagttaccgctcttatttgccctcgtgtatttttttccgtccacgaccatgtagtcatagtgagaggatgaccagataatctcagctgtggtctcattatttttcacatgaacatctgccggggattcaatcccagcacggcccgttccgcctttcaggctcacaggtatcttataatctccatttttcaaagtatcagccatttttctgcctcacttcctgagtgatctttttaccaccatttttcatccagctgtctacgaagtcgtcaaaggccgacagcggttcatctcctgtaacgatagaaataagcgtcttctgttcgagctggttcagcctgtaccagttctttttcattgtatctgtctctgtaaaatatactgccggaacttctcttatcctcttgtcggaaatcttgtggctcgccgtgatacgcgacgtataggcggcccagtccttcgttttgatctctcccccgctgttctcctcttttaaataattctggcaggccgttagatacgagccctcgaggagattcagttcagacttgtctctgccaagtgaaagcacgctgcttaaatgtttgtagcaggaagacagcgcgctcttgaagtcgacgtttatcgagagaggccttgcggtagggtctacgtttccaatatagtaatcctcgagctccttagtgctgtcgtctccataaggcatgtagtcaaaaagtgccgagatgatcttcatgacgacctccgggtacttgaagcctttccggacaacaacgaatttgccgctcgaattctgcgaggcaaatgaagtgttgcccagatcatctgtagctataaggtacggtctccagtccgccttcgggttcttgttcatcgcctccataagcgggttgttaggcgcccaccacgggccgaaaaacgccccgcattttccatatacgataaggtccacgagattgtcagagtccctgaacataaaatccctgtcgagagagccatccagatacatatcatgcaggtaagagagggcttttttcatctcaggctgcaccgagccatatacgagctttccattttttgtaatccagtgacctggatatgcattaaacgccgcaaagataatatcggtctgatactcctgcgagtagccgctgtcaccatagagcttcggaagcgtcacaagacctgtggtctttccctttccattttcacccggatcatatttcctgaatgcttttacaatttttcttacatcgctgacggtcttcggtgtcgagagacctagttttttaagccagtcgtatctcagccagaggagcgaagggccgtcgtcgatatttgtctcggggagcgcgtaaagttttccattcacctttgccttgtcgaggatcgtgtcaccgtaggaagcgtagatatttttaatatggactgaaatgcagttgtcataggcgtcggtaaggtcctctataagccctgcatcggcgagtctcttcacctcgtcttcgctgtttaccagaaatacatccggcaggttccccgaggcgaccgcgatcgatacgtgctcattgtagctgttgtcaccgctcagttcaaacacatccttgttctggacgttgatctttttcttcagatacctggtataggcgttgttctcataggtatcgccttcaggcatatttgaatttgagttacctgagagcttgcctaaagtgtaggtaatggtcttcgggtaggggctaagcgcgttatgccttgctgagtaccactccctgttcgcatcgtacccttcatcctctgatctgtcattctgctggatagacgcctgcctgacgcacccggctgtcattgcgattattaaaaaaatagaaagtacttttttccacataacgcctcttattataacgaaaaaagagccgcaactcaataagctgcagcccttatattaataaaaggagggaggaaaatcaaccctttacaccaccggcagtgattccctgtacgtagaacttctgcatcagaacgaagagaatggagatcggaattgcgaccattacacctcccgcacagaatactgagaagtactttccaacgagggtcttctgaacgaggttatagagtcccattgccactgtccagtttttagggttttttgaacgaatcatcagctgtgccattacgaaatccatccatggattaaggaaggagctgataatagtgtaaacgatcataggctttgaaagcggaagtacgatctttaagaagatcgtaagctctgaagcgccatcgagttttgcggattcacgaagtgatacagagatcgtatcgaagaatcctttcaggatcaggaatccaagtccggatcctgccgaatagataacgataagtcctacgatcgagtttgtcagtccgatcatcttcattacgaagtagatggcgatcatcgagagaacaccagggaacattccgagtgttaccgagaaactcatcagctgttttctgcctttaaatctcatacatgagaaagcataggcagtcatcataacgaagagactcgagatcaagcaggtaaagataccaattatcattgagttcttaaaccatgccgggaagtttacaactgtatccggctggaaaagaagttttttgtagttcgcaagcgaccaggtctgcgggaagaagtggttagtgttgatgcccggataacctgaaagcgaagttacgaacagccagacaattggtatcagccatataaatgacagaaatgccagccagagatgtcttaaaacaggtcttactactctcttgctgaacggcgcctttacaacgaccggattttcagctgaggtaattttagataaatcattcttagccattactggaattcctcctctctgtcaccgcgtacaagtcttgagaagctcagcagagtaagtgcaacacagatgacgaatgtgatgataccgattacagatgccatcttgaagttcgagtagttattcgtcaggttgaacagccatgtgataagaagatctacttctttaccatgtgatgttgcgaatctcatgttggttgtagtgtagtctgtcgtcagcaggtaaataacgttgaagttattgatgtttgcgatgatagatgtaacaagtgaaggtcccatgacaaacattatgtaaggcattgtaatcttccagaagatctgtctctcactggcaccatcgatcttggctgcctcgagctgatctgtaggaatgttcatcagaagtcctgttgcggaaagcatctgataaggaacaccgacccagatatttatcaggataatcatcacgtgagcccatcctggtttcgacaggaacgggatgtacccgagaccttttgaaacgagaccgatgttttcgaggaagtccgtcaatccaatctgcgagcagataccgtttacgatgccgttgtttccgaacatcttaccaacgagaagaagggtaacgaactgtgggatggcaatcgtgataacgaagaatgtacgccacatagcaggaagcttcgttctcttgtcgttgatgaactttgcgaggaagattcctccgaagaatgtagagaatgtggcaactactgcccagatgatagtccagatcaggatacggataaaaacatatccgaatgaatccgaaacacttgaagtaaacagtgtctggaagttcttaagacctacccaggtaaaaaggtatgtaggcggctggtgatcgatgtcgtagttcgtaaatccgatacaggtcataaagactatagggattacatttataagaactacgcccattgtaggaagtccaagtaaggtgacatagaactttccgtttaccatctcacggcagtcttccctgaatgtgtttacatgtcctccggcttcctttgcctgctgaactttgtagatctgcttgaggttgtaaatatagtaaagtgcaaagaaaaagcagataactataccgacaatactgaaaagaaggatcagaagtgagttgtcgaaattattgaccttctttgtcattgtaacgggatcgaatgattccttacgctgtaccgtgccaagagtagaaagctttggccaatacgtgcctccgatcagtgcgatgacccaggcaaagagcacttcgaccgctgtaacgatgcagcccttgatatactggccgttagccagatggccaaggcccattatgataagggagaggcgggtccagatattcccgttctttacagccctgccaaaatctttgaaatatccggcaaggcttactttatcttcttccataatttctctctttcatgcttttttgtgtaactgttccgaaaaaaactgcggtcggcttttataccggccgcagctgatgattattaaaactgtgctttaagactattccctggtatcttattatttaaccgctgctgtgataccctttacagcatcatccagaagcttctgagcgtctgagtacttgccctctgcaagtgactgtccaagtgagttagctgagttccagaagttagcacctacacgctgtggagcagagaactttgactgagcgatgattgcgttaagagcctttgatgacttaacatcgcttgatgcctgaccttcctttgttgctggagcctcaccagtagccttgaagatcttcatctggttctcagggtttgtgatgtactcagcgaggagcattgcccaacctgtctgctttgaataagcatttacaccgatgagcttgcatcctgagaatgaacccatctgaacctgcttgccatcaactgtgtatgtaggaagtttagcagcgcccatcttgtcgccccaagccttctgtactgcatctgatgaccatgtaccgttaacgcaggctgccatctttccatcctttacagctgacatctggtcatcgtttccaaggttcttgaatgccttgctctttgctgcctttgtgatagcctctgctaccttggcacctgtaggattgcttgtctttgagttccagtcgcactctgtagtaccgtcatcctttaaagtagccttaagtccagcgcctttgaagaagctgtagaggtaccatgcgtttgaaagctccataccgaaagtcttgtttgccttctcgcagtctgcaaggatcttgtcaagtgaaccagcatctgcatctggaactacgtccttattgtagtaaaggaagtatccgtttgatgctgtcataggataagcatagagcttgttgtttaaagtagatgctgtaacagctgtgtctgtatcaacactcttcggatcgtatgtataagtcgttgaaacttcctgaagtacgcccttctttacgaggtcattgatctgatcgtctgcgaatgcgaatacatctgcaccagcctcaggatcctttaacaggtcatcctttgtgttagcctctgactcagaaccgatcgtgatgttgagcttgacattcttgtacttattcttgaagttgttaacgatctccttcataaccttctggtactgagatgtctctgatacccaaagagtaagatctacgcttccctttgtgttcttgatcaggttctgtaccggatcagcctttgaggcgtttgatgatgccttagcgcttgagcttgagctgctctttgaagcgtttgaactgtttccgcaggcaccaagcgttgcaaccattgatgctgcaagaagtaaactaacgattctcttcttcatgcttatatttcctccttcttgaccccgtatttatttcccaggggcctttaagcatttcctgtttacaattgttattatagtaagagaagaggaaatcgtaaatataactattttttgaaatatgttgattttttgtctttattttgtcaaaaaaatgaaaatgtgctatgacggcattttcttcggtattgtaactgtgcaaacggttcccttgcccggaatgctcttgattttcaagccgtaaggtctgccatagaagagctcaattctctggttgacattcgccactccatagcctttgctcttgaaattgagtatcgattcggcggtctcttcatccattccgacaccgttgtcctctacggtaagcgttatagtgccatccgtctgccgtccgattatctttataaatcctctgccatcctctttcatgtctatgccgtggtctatcgcgttctcgacaagaggctgcagcaggaggtttaaggtctcatacggcaggatatcctcgtccacatctatcactgtgtcaaaactgttgtcgtgcatataggactgtatcttgatgtagctctttacattttcgatctcctgctccaccgtcaggacatttttgccgcggttaagagatgtgcggtaaaatctcgacagtgcgagagtcacatccgagatatcgtccgcacccttttcaatcgccttccagttgataagggagagtgaattgtacaaaaaatgcgggtttatctgggcctgaagcgccttcatctcggctttcctgagtgccagcttgttctcatagttttctttgataagcctgtttatctcggcaagcatggaaccgaagtccctgataaggccaccgatttcatccttagagtcagaaactaccataagagtgcggttgcccttcgccacttcgtgcatattttcctcgagcttcgtgatgtcgcttacaacgtagcgctgaaagagctttgatgcgataaaaagcgtggccactactatggcgagatatatcgccagtacgaacaggagctgcagattaaacattatgctgaaattatttttcccgtacatgtaagcagtaagaggaagccctgctatcttatcgctctgcacatagtagccacctatcctgctcttccccgacataagttcacccggctttaagacattgtgcttcaggccgttgtttttctcgtatatcaggtctccgtttttatcgagaattgaaacaccctgtccctcctggcagatcttatcgaaactgtcgaaaagagagttgtagtttacctcgatgtagagtatgcccttttctccgttcatctccatcagcggcatctcgcggacagatctgatctttcgtgccttattatcaatgatccaggtcacggactgattcaaggatttttttacagacttgtaccatgcgctgtctgatatctctgataaatggccaatcgttacaccgtgagacggcatagcattgttactcaggtagatttttaatttttctatatcgggagaaaaatacgacggggactgaagaatcgggtcgatcgtcttctcatactgctcgaacagctcatacctgctgttgtaagagctggtcagggcatcacttactgtcctgttgtaagccacataatccgagagattgttgtagactcttacatccgatgtcacggcggccgacgcctgcatcagtgcacttctgaccgagtcggccctctggcgctgcatcatctgcctttgctgcacgacaagaaaagctccgagcagaaggattggaatcgctgagagcatgacatagatgatcattatcttattgatcaggcgggaattgcggaatgcgttgtcgaaccagcggcggagcctttttttcatgacttgcctttctcagttctgtactgctccgggctctcgccgaaataagctctgaaactgcggcagaaataggacacattcggatagcccacggcgtagctgatatttacgatcttgttgtgggtctcctcaagcatctgctttgccttttccatgcggagagcctttatgaatttggacagattctgccctgtctccttcttaaagacatgggacagataactcggtgccatatagactttctcagcgagaagctctgtcgaaagttcctcgttgtagtgctcgtagatatacttcttcacagtctcgatctcacggtgtgaagtctgcgggttcagatcaaaattcttctcgagaagcgagataccgcggtctaaaatattcatgacctcagtaaaatctgtcgtgcggtagagcttgtccacatcgtcagacagtgatccctggtcctccttcgggagattgtcgtagatctccttcatcaggttcgagaagacgaacttcacatatacctgtgaaaaaccggtgttatttttgtatttgtcgcagagcttctcatagtggtcacggagaccgaccatgtcctttacattgatatcctgcttgatctgcttcatcaggacatctgaatcgatgtcgttaatatcggcctgtccgctctcatctccctcgaggaagacatggtcactgttcagatagaatctgttctccatcagtgcctcgagcgcgtcgtaggtgcggccaagagccttcaagttcgagtgacctcccggaagcggcagcgaaaccgagacataagctgtctcgtcgtagagttcctttacagcatccacgagcttctcgcccagtgccttcctgtcttcgatctcttctgagaaaataaagatagagctcgatggatcgatatttacacaccagaagtcaaggccggttttcttttttacctcatcggaaaaattcacggctttgatgccaaagaaatcgtggtcaaaagaaagcagcgccatcaccgtgatgtcctctgcgtagccgtccgggacaagttttctgacagacgggtcgaggctctccagatctctgccgttaatgagctcgagcatcacatgctctaatataaagtcacttctcctgtcccggttctcattctcgatcgcggcctcgttcatatccttcatgaccttctcgatggtcctgtggaattcgaccggatccacaggctttaaaatatagttcgtgacgccgcttctcatggccttcctggcatactcgaactcgccgtatcccgagaagatcaccatcttcatatccggatacttcttcgagcagatatcagtaagctcgagtccgtccataaacggcatcttgatatccgtaagcataaggtctgccggcttctcctcaagcttctcgagtgcctgctttccgttctctgcctcccttatccttgcgtcgatcttttctctctttaaaagcattgtgaggccttttctctcaatggcctcgtcgtctacgataagaatttccataataaccaaaatctgtgtctttttgttttcgggtacaataaaaagcagtgccttttcgtgacactgcttttattgtaacacaaatgtttagatatagtaaagtttcaggcttctcttgtgtgccagatctccttgtcgtactgatcgatagtacggtctgatgagaaaaagcctgcgttcgcgatatttacaaggcacttctttgcccaggcgtcgcggtcttcaaaatcagtaaatacctgctggcgggtcttaaggtagtcctcgaaatccgggaaggtcataaaccagtctttattcagaagctcgttgtagagtctctcgaggttctctgaatttccaacttttctgactgtatcgcttacgataaagtcgactgcctctttgaggacaggatccttctcatagtaacttctcgagttgtagtcgcctctggcgtatctgtcgatgaccgtctgcgcgtcctcgccgaaggtgtatatattgtcctttcctacgaggtctgcgatctcgacattggctccatccatagtaccgagggtgacagctccgttaagcatgaacttcatattcgaagtaccgctggcctctttcgatgcgagcgagatctgctcggaaatatctgctgccggaattacgatcgatgctgctgtgacattgtagttttcgatcatgactaccttgaggtaaggtgcgacctcaggatcatttgcagtgatctcctgcatgcagaggataaggtgaatgatatcctttgcgatagtgtatgctggtgctgcctttgctccaaatactgcagtgatcgggcgaaccggtttctttcctctcttgatctccagatacatgtgaataaggaacaggaggttcaactgctgtctcttgtactcgtgaagtctctttacctgtacatcgaagatcgaatggcagtcgagatcgactccctggttcttcttcatgaaatctgcaaatctcttcttgttgtgaaccttgatcgatcggagtgcctcgagggtatctctgtcatctacatagtccataagttttttgagctcgttcgaatccttcttgaatccgtcgccgatctttgactcgatcagtgccgtaagctcagggttgcagtcgaggagccatcttctgaaggtgatgccgtttgtcttgttgttaaacttctgcggatagagctcgtagaagttgtgaagctctgtgttctttaagatctcggtgtgaaggtatgcaactccatttacactgtggctgtagtggatgtccatgaaagccatgtgaacgttatgattgtcgtcaatgatgtaagtcgaagcgtccttgtatttgttctttacctttgcgtcgaggatcgtgattataggcataagctgtggaactacctggttcatgaagtcatagttccaggtctcaagtgcctccgcgaggatcgtgtggttcgtgtaagcgcagatcttagagacgatatcgattgcctcgttgatgtcgattcctctggctgtcagaagtcttataagctccgggatcaccatcgaaggatgcgtatcgtttatctggattgccgcatagtccgcgaggtcgtgaaggttcgatcctcttgcgacgcactcgtctaagataagctgggctccggcacttaccatgaagtactcctgatagatacggagcattctgcccttgtcatccgagtcatccggatacaggaaaagtgtcaggttcttctcgatgtcatccttgttgaagtcaatcccatcgccctgcgtaatgtgctcatcaactgaatctatatcgaagagatgcagctcatttgtcctgttctcatatcctgtaacaggtatatcgtagaggtgtgcgtgtactgtgtggtatctgaactctacagtatattcctttttcctgtcaatcagccaggagttctctgttatccaagggttcggggtctccttctggagattgtccttaaatacctgtttgaaaagtccgaggtgatagcagattccaattccgtctccgtggattccaagagatgccatcgagtcgaggaagcaggctgcaagtcttcccaggccaccgtttccaagtgacggctcgttctcgatctcttcgatgcggtagatatcctttccgttatcagcgagttctttctttacatcttcgaagatgccgaggtttaacatattgttcgacaaaagttttccgataaggaactctgccgaaatatagtagaccttcttctttcctgcgtcggatcttctgtcctcagcgatatcgcgcacgaggtgaaggagtgccacatatatctcctcgtctgagcagtctttgatgttcttgttgtaaagtttctttactgtctctgcaaccatctgtcctttgttcacctttctgttctcgtttctcgaatatgtgtcggcaagtttgcgaagcgccttctgtttcttttcggagaattctcccttcttaagcctccatctccagttcgtgccaatagtggatggaagattcatacgggccgagttgtcttttccgagaatatcctgcatctgaaggatcactgtgttcgcgatgctcatataagccattctgaaaattctccagatcagcctgtcttcgtcctctccgtcatctgctccggtatagtctaaaagatactgatagcccataggagagaggctcttgaaatagccctttaacatctcattgtcatgagttccgctgtagacgacgcagttcctgtcatacatatgaggcaggtattcattttccctgttgccatcaaatgcgaactcgaggatcttcattccaggataacctgtcttcctgagaagttccttgactcctggaactactactccgaggtcctctgctatgatcttcgaatcaccgataacctctgcgatagcatctgtaagatcctgccccggaccttcctcgtaatggccgtccaccgggtccttgtcagccggaatgttgtaatattttacgacgccgaggaagtggtcgattcttatgacatcgtagagatttgctgccgaagcgattctctttttccaccagctgaaaccgtctgccttcatcttcttccagtcgtagagcggattgccccacttctggccataatctgaaaaagcatcaggagggcatcctgcaacaccgatcggcgccagattttcatcgaggtcgtactgagacggattgcaccatacgtccgccgaatcgagagcgacatatataggaatgtcaccgatgatctcgatgtcgtggctgtttgcatattttttcaggagtttccactctctgtagaactcaaactgtatgaagcagtagaaatcgatctgctccttcaaaaggtccttgtagtatgagacgatctcaggctctctgcgcttgatatcgtcgtcccactcctgccagctgcgtccgccgtttctgtcctttaaggccatgaagagcgcatagtcgttcagccatccggaattttcttcgcggaactgcctgaagctgcttcggcgttcaactactacgcggttattcgatgtcaaaaatgcgaggtaagccttgcgaaggattctgaaacggttgttgtagatcttcgcatagtccacatcgtcctcatccgttccccagtcgatcgactcaagttcctttttatccaaaagtccatcgcaagccagcgtatcgagatctataaaatacgggtttcctgcaaatgtggaaaatgactggtacgggctgtctccaaaactcgtcgggcctacagggagtacctgccagtatgactgcccggcgcgtacaagttcatcaacgaaatcataggctgcctttccgagtgttccgataccgtaaggtgacggcagagagcttatcggaagaaggatgcctgcgcctcttttaaattccggctgtaagtttgccattttgtcctcctgaaaataaaatttcatgatcttactcatactatgctatcattcagagagtattttttccatataaaatttttttgattaatgttcattaacggtttccgttcgtgtataatggggcataacaaatatgctatggtgtggaggtgaaaaatatgctcgacgattataataaagccttaaaacgcggtgaaaagacattcagaaaagacaccggccgcggcagatacccttatcttcctgttttggatgagatcgtaagccagtccgatgtctcggaggagcacgtcggactcgtcgaagttcctatagaaaatatccgcggtacgaagacgaaaggccgcactcaggcattttcgagcgacttcatgccgatactctctcctgacagtgagttcgcggcgaaatggtcaaagctctacgactcagccctcgaagagggaatccgcgagcctattaaggctttcgaatacatgagatccttctatgtgcaggaaggcaacaaacgtgtttccgtctcttcatttctgggcgttgatacggtgctcgccgatgtcacgagacttatcccgaagaagacaaatgatcccgagaacaggatctacttcgagtttctcgatttttacagggttgctccactctacgacatcgctttttcaaaggaaggcggatacgcaaagctcgcaggtatttacggacttgacttaaagacagcatggccgcgcgagaagatcgaagatctgagatccgattacaatattttcagaaaggcatttaaaaacggcggaggcgacaggctcgatctgacgaccggtgacgccttcctcgtgtacctgagattctacggcactaacctgatggcgacagacgagagcctgctgcgcgaccgtatcaaaaaactctgggacgagtttgtcgtaagtgccggcgacgattcagtcgagatagtcgagcatcccgaggaagtcgaaaagactgcaaatgtgctcacgagcctgctctcccgaaagccatcttattccgccaaaaatcctcttaaagtcgccttcatgtacgagcgccccgccgatacttccggatggatctacggccacgagctcggcagaaattacatcgctcagaagtacgccggccgtgtcatcaccagaaaatacgacgactgcgcaaacgacactattctcaggaagcacatagatgaagctgtaagtgacggcacagagcttatttttacggtgtctcctatacagatgaatgagactttaaaaagtgccgtacacttccctgatgtcaaatttttcaactgctcggtaaacctctcccagagcgccgtaaggacctattacggcagaatgtacgaggcgaaatttctgatgggatttctggccggcacaagaaatcggggacacaggatcggttacctggccagctaccctattttcgggaccgtctccgagataaatgcgttcgcgatcggcgcttcgatggcagatccggattctgaaatctaccttgcgtggtcttcagtcagggatctggactggagacagtattttaaagagatggatgtcgatctgatctcaggtgtcgactttataaaaccgaacgaggcttcgcgggagtacggcctctacaggattaaagacgacggctcgatagaaaatctcgcttttccactctgggactggggcaggtactacgagcttataatagaccagatcctagacggcacctgggacgacgaccctgtcgaaggcacgaaagcactcaattactggtggggaatttccgccggcgtcatagatgtgatactctcgccacaccttccgtaccagagctacaagctgatcgacgtgatcaagcagtcaatgcagagaaatgaactgaaccctttttacggtgagatatggaaacagggccacaagaggatcaagggttttggtacgccaaagctttcaaacgaggagattcttacgatgacctggcttaacgacaacatcttcggctgcctgcctatcgagtcggaacttaatcacgaggcagtggccgctgtaaaagtaagcgggaccctggaccagcaggaggatatcaaatgaagattttagccttagctgatgttgaagacaaggctctctgggatttttacgataaaaaaatgaccgaaggcgtcgacctggtcatctcctgcggtgacttaaactccaactacctgcagtacatcgtcacaatgaccaatgtgcctctgctatatgtcaggggaaatcacgacaggggctatgacagaaatccacctctcggctgcatcgatattgacgacaggatatacgactacaaggggcttcgcatcctaggcctcggcggctcaatgcgctaccacggcggaggtgatatgtactccgaaggtgagatgctctcaaggattcgaaggcttaaaggcaccatcgcactgcacaatggttttgatatccttgtgactcacgcgccagctgccgggtacggtgatttagacgacctgccgcatcgcgggtttgcctgctttaactatctgtgcatgcgctacaagcccaaatacctgctccacggccatatccacagggagtacagtcacgaattcatccgcgaacaaagccacgaaagcgggacgaagatcatcaactgttacgacaaatattacctcgaggtctccgacgaagagcaccctgcccgcggcaggaccggttccttcctctacgacctctacacaaatatttccgacaaaagaaaaaagtactgagatatcgcctgatatcccagtacttttattatctcaatattttactgatcagctcttcttcccagcggcccattcctttaccatcttccggtagtgagcgaaccatagatagagtgcgctcgctgcgaaaaggcttatgccaagcacctgcgaaacagcgatcgaagtcccggcgaactgcagctggtctgtacgcagtccctcgattatcgaccttcccaggccatagaaaccgatatagaggaagaaaagctctccgtcgaacttcttgtgcttcctgtagagaagcaggcataagaagagacaaagattaaaaagcgactcgtagagaaaagtcggatggacctgaatgcagtcgatcccgcttacggtcacgatatgtgccttcatctctgctgtgatatcctgcgttcggtttacggcatcgatcggaatcctcattgcaaagaggctgtcggtgtattttccaaatgcctccctgttgaaaaaattgccccagcggccgaagatctgtccgatcagcactccgaagatgatcacatctgcagccttccagaagttgagcttcttcagaacgcagatcacgataaccgtgatcgtgccaccgatgatcccgccgtagatagcgagaccgccacctctgatattaaaaatctgaagcggattatccttatagaggtcccacgagaagatcacgtagtatatcctggccccgatgactccgaagatgatgccgaaaataaacatatccatgaagtcgtcctgcttgtagccgagcctcttcgcctcaagcatgatgaagacaaaagccagcaccatgccgagagcaatgaccatcccgtaaaaagctatactgaaatttcctatcataagccttcgcccgacatgctttaaaagtatatgaagatgcgggaaggcaatgctgtcctcgtacatattaattcctcattttaatcaaaaggcggctcatctctgccgctacatatatgcgtaaagcccggtaaccctcgcgataacagcgatgaccagaagatgcgccggatagaacacatagaaaaaatatttcatcttccgcccctgcctgccgtgatagaagcacagcggtatcagatcaaacagagcgaaaaattcactcagatcgcaggtgaacccgagccaggtcacggctgcggcaaacccgagaagctttccagtctcaggtctcaagtaaaaattccggcggaaaagatagatgattataatagttacgacgcccgaagttccataatcgcttttcgcaattttttcaataagccctgcggctataacgactgcgacaagcgaaaaaatatcgcatgcttcctttacaccagcgctcagtgcaaatttttctgcggatctgtcgaagagcgtatcgagcacccagattgagacaagtccgaggaaaagcgttatcataacgctgttgtcacgcggagcaaaaaaggtgttatcaaaggcgaggtcaaacggcacttctgcgataactgcaaagacagcaagacgcagagcgtattttttcctgttcccggtatagtgaaatccctcgactatgaaaaaacagaaaagcgggaaggccagccgcccgatatcacgaaaaacttcgtaagtatcggcaagcgtatctgtgccgtatttatttacaaggtcccagagaaaaaccgcgccgatgtgatctatcgccatcgtaacgatcgctatgagctttaacgcaaaacctgtgacgtcgtatcttttttttatcattgtaaaaatatcagtcgtccggatttacgaacatggcgtcaccaaacgagtagaatctgtagcgctccttaacagcctctttgtatgcgttgagcacgtgctcacggcctgcaagcgaagagacaagcatgataagcgtcgactcaggcagatggaaattcgtgatgaggccgtctactatcttccacttgaatccaggatagatgaagatcgatgtatctccctcctgagccttcatgtggccgttctcatctgctgcagtctcaagtgtcctgacagaagtcgtaccgacggcgataattctgccgccattttccttcgtcttattgataaggtcggcggtctcctgagtcacacggtaccactcggtgtgcatctgatgctctcttacgtcgtccaccttgaccgggcgaaaagtacctaagcccacatggagagtgacctgggcgatatttacgcccttggcttttacctcttcaagcagctccttcgtgaaatggagtcctgctgtcggagcagctgccgagccattgtacttcgcatagaccgtgttgtacctgtcgcggtttttgagcttgtgcttgatgtaaggcggaagcggcatctcaccgagcctgtcgaggatctcctcgaagattccgtcatagtggaactgcacgagtctgtctccgccatcgataacgtcaagtatcgtagctgtgagcgatccgtcgccaaatgtgacctcagctcccggacgcagcttctttccaggacggacgatcgtatcccagatgtcgttttcttttcttctgagaaggaggatctcgacgtgagctcccgtatccttctttgtgccaataagtctcgcagggatgactttcgtgttatttatgacgaggcagtcgccaggtctcagataatcgagaatatccctgaaatgcttatgtgtaacgctgccggactttttgccaaggaccagaagtctcgaggaactgcggtcctcgagcgggtcctgtgcgataagctctttcggcaggtcgtaataatagtcttttgtactgtatcctgtttccataatatcagcttctaagtgtaatatccatactctcgaggcgctttaagatagcgtccatggcatcgtttacatcagtgtctgaaagtgagcggtcttttgctctgaatgtcaggcggtaagagatcgacttgtatccgtctgccacctgtgcgccttcgtagacatcgaaaagcttgacgctctcaagatgttctccgccctccgcgtagaagatcttctcaacgtcaccggccggggtattcttcggcataacgagtgacaggtcacggaccgatgccgggaagtttgcaatgcctgtgtacttcttctcgaagttcgcaaacttcacaacatatggcatatcgatatctgcaatatatacgcgggtctttatcgcataattggctgcgactgtcggatgaagctctcctaagtatccgatcagcactccatcatagataatgtctgcgcagcggcccggatgaaggtaaggacggttctttgacggaacgtaagtcaccttgtctgtcattccgactttgtctaagaattcctctaccacgcccttcatactgtaaaaatcttcgccatcgccatagcttgcgagcgtccactgcatcctctcatcaggaagttctgtcgtaagcggcagtgactttgcgatgtaaatatttccgagctcgtagagacttacgttctcatttctcctgttaaaattcgtagacagtgaagtcagaaggccgttcagcggaagagtcctcatgatcgagaagtcctcgccgagaggattctggatctctatagcctttctctcaggagcgtctgcaggaaggagcagcttgtcaaagactttcctgctctcgaatgaatagcagtatgcctgtgaaaatccgcagtactctgcgacatccttcgcgatgtcctcaagctccatctttagtgacttgccacctgctgtggccgaagtcttaggaagtgtcgtagctacattggcatagccaaagtatctggcaatctcctcggaaatatctgcaaatgacaggaggtcctgtctgaatgtcggaataataagctcttctgtcttctcatcgtacccaagctcgagcttctttagataaccgagctgctgctcgcgagggatatcagttccaaggaatgcattggtatggtctggctcaaactttattctccagggcttgaccggctcaggatagaagtcgataactccgccgactacttcaccggcaccgagctcttcgatcagatcgcaggcacggttcatagcttcgatcgcattgttcggatcaaggcctttctcgaacatacctgatgcctcagtcctggtaccaagtctcttggctgaaagacggatatttgttccattaaatgtggctgactcgaataccatcgtctttacatcgtcggtgatcatcgaatcctgtccacccatgatacctgcaaagccgatcggcttctcggcatcatttatcatcagcatatccttatcgagaacatgttccctgccgtcgagtgtgacgaatttgctgccctctgtggcattttttacaatgatcttgtgacctgcgatcgtatcgagatcgtaggcgtgcatcggctgtccgtactcttccatgacgtagtttgtgatgtctacgatgttgttgataggacggattccctgacttctaagcctctcctgcatccatctcggtgaaggggcaagttggatattctttacgactctggctgtgtatctcctgcagaggtcgcggttctcaacctctactgaaatatagtcatttacattctcgctgttcccaacctctttgatctctggtgggttgaacgggaggttgaacgtagctgcagcctcgcgcgcaagtccgatcagagagaagcagtcgatacggttatttgtgatctcgtactctactactacgtcgtcgagtcctaagtactttactgcgtccccgccgactggtgcgtcgtccggcatgatatagagtccgtttacaggagcgtccgggaagacttcacgtgatgagccgagctcttctatcgagcacatcataccatcggattcaactccacggagcttgcccttcttaatcttgattccgccctcggtcctcttaccgtcgtggcttccggcaactcttcctccgtctaaaactacaggaaccttggcaccttctgatacgttctgggcacctgttacgatctgaatcgtcttgtccccaacgtctacctggcagataacgaggtgatccgcatcagggtgtttctcaatctttttgacctgtccgatcacaatcttgtcgaggtcctgatctaaagctgtataatactctaccttcgatcccgaaagcgtcatagcatcgcagaattccttcgggtcattagtaagtcccggcaccatagcctggagccatttaagagatgttcgcatttatttttatcctttcggttaactgtcttagaactgctgtaaaaatctgatatcgttctcgtagagaagtctcatatcatcgatctcatatttgagaagtgcgatacgctcgagaccaactccgaatgcaaatccggagtatacgttcggatctatgccgctcatctcgagtaccttcgggtgaaccatgccgcagcctaagatctcgatccagccctcgcccttgcagaaacggcagcccttgccgccacacttgaagcagcttacatccatctcagccgatggctctgtgaatgggaaatggtgcgggcggaacttgaccttgacatcatctccgaaaagcttgtgaacgaacatctcgagagtgccctttaagtctgcaaatgtgattcccttgtcgattaccattccctcgatctggtggaatgaaggtgaatgtgtcgcatcgacttcatctgaacggaaaacacgtccgggtgctatcattctgataggaggcttcttggcttccatctggcggacctgtactggtgatgtctgcgttctcagaagaatattgtcatttatatagaaagtatcctgttcatctcttgtcggatggcccttcgggatattcagggctgtaaagttgtagtaatccttctcgatctccgggccctctactacatcaaagcccatgccgataaagatcttctctacttcctcgagtgtgatcgtattcggatgtctgtggccgatcttgttcttctttgcaggaagagtgacatcgatcgtctctctcttgagtctctcgtcaagagctctctgctgcatcttctccctggcctcattcatcctctcttcgatggcagcccgggcctcgtttatcatagcgccgacctttggcctgtcctccggagcgacgtctttcatgcccttctggaccttagtaaattcgcccttttttccgaacactttgaccctgacatcattcagggactcctggtccttggcctcttcgatcgaagccatggccttctgtcttatctcttcgagcttttcttttaccatcacaaggtactcctttatcttttttggtatttgaccaacctatagaataatcgaaaacgctcctattgtcaaattttgccgcacaaatcgaggttgatttttccgcctctaaagactaaaatagaatcaagctcagggtgctcgttttttcccgtagtttttgaacctacaattactttaaatcgggatccctattattacaggccggatgtcgggcttcggtgtatgcacttgtgcagagaagtcgggctttgcctacttccagtagatggctgaaggtctgctgcggcaacccacctggctgcgtgctaggagtcaagaatgcgggcctgcaccctgggtgttttttagaaaattatgaggccgctgcataaagcagcggcctctttcgtacaaaaggagaaaatcaatgcagacaataccatcgaggaagctcagcaacggtgtagagatcccggccattggctttgggtgctacaaattggcagatgccaggatcacagaattgatgaaaaacgctgttcaggcgggctaccgccattttgacaccgcgtctttctatgaaacagaagaaggcatcggagaagcaatccgtaaaatcggcatagaccgaaaggagctttttctcaccagcaaaatatggaaaacagagatggcagacaccgaagcctccttttacgcttcgctgaaacggctgcagacagattacctcgacctgtatctgattcactggccacgtccggacctgtccgacccagactggcaggaaaaggatctcgagacctggcatgtcatggaaaagctgtataaaaaaggtgatgtgcgtgccatcggcgtaagcaattttctgccgcagcacctgattccactgatgaaaaactgcgagattgcgccgatgaccgaccagctggaaatccaccctggttacggacaggaatgtgcagtcgcctttgcaaaggaacacggcatccagatggaagcgtggagtccattaagccgcggccgcgcgaccagccatcctcttctgcaggaactcgccgacaagtacaatcggtcagtctaccagatttgtcttcgctattccgtccagcagggcattatcccgctgcctaaatcttcctcgcctgatcgcatgcgcctaaacctcgatgttttcgatttcgaaatctccgaagaagacatgtaccgtctccgcacgatgccgcaggccggctggagcggtgagcatcctgacttcgagacggtaactgtctgaagatggactatactgcgcaccgggaataaatatccggatttctacaaatgatagaaacccggatattgtcaacttatatttttgccagcggtaccttttttgtgggtgccgggaaggctgcgtttattttttcaaggaatggagttatgtctttgcctatgcctgcgaggttcgtttttatgtgatcataggacgagctgccgaacagcgcgcagaggtcgtggtttctggtgttgaaggcgagcattatcgctgccggagtaagtccggtctcggcgctgatttcctgtatcgtccggcaggactcacaggtccttctcgtttttgtcatgtcagagccaagtgatgagtacgacatcggatggactccatgctccaatagccacggaaataggtcatattccggaccgcgctcgcagaggttataaaggacctggtctgtgacacagtcactcccgtgctctactgcaaagaggtcctccatatcgctaacatcaaaatttgaaacgccccacttaagaatcagtccctcttctaccgcctcagtcatggcttccgccacaaaagcaaggtcagccttttctttccaatgcagaagataaagatctatatggtcagttccgagtcgccttaatgatttctcaagactctttctgaaaccagcaggtgtggcattgtcagggagaattttgtccacgagaaagaccttatcgcgtcccacttccttaagcactctgccgactgcctcctcgcttctgccacttccgtacatctctgcagtatcgataaggcttatcaagccgtcatctacagccctcgccatagccttttcagcttccctgttgccgtaccagaagacagtgcttccaagccctacttcggggagtttaattgtagtggatgcggtttgaatcatgttattacctttcgttttgcgccgatttcatgcagttgttttttcccaaagagtgttatgacaatactttttcaaaaaaatcacatgtatggcatttttacatctaatgtcatgatgatatagacctatcgcggcaaagcgtttatttttcctgaaaaaataaacgttaaagttctacctcgatatagtcgtggtgtactgccttgagatatggtccgaatacgtcgctcgtgagaattttaagagatgaggtgttcacgcacgggtggcagccgacgtacttctccgcgagcacgtccttgtccactaacagctggacgttattgtcgtggtcgttcatcagccccatgatgctgactgagcccggctttatatcgaggaactcttccattttttcctcaggggcaaatgagagtctcgctgagttgatctgctttgagaggtccttagtcttgaactgcttgtgtcccggcatcataagcaggtagaatttcgtctgctgcctgttgcaaagaaataagttcttgcagatcagacagtcgagcaccgcgtctatcacgtcgcagacctccatcgtggtggccggcgcgtgatctgtcctcttgtatttgattccgagagaatccaagaggtcataaaccatgatctccttttcctccctgccactcagatcatcaggtctgccgtcatacagttcaatagtgctctgatcgaattcttctgaactcatctattcatcctcttcttcctgattgtcttctttttgcatcaaagtgttgtccgattaatcattattgtcatctgtttccacaggaagatcggattctttatccttatctgacttccacgagatattatccgactcttcatccatatctgacttccacgagatattatccgactcttcatcaacttcttcgtcgtcatcatcttcttttccgtagaaatcatcgaagaggctgttgatgctgtcgcgaagctctggcggcaacccgctgctgttgtcgagatttctttttacttttctggtaagacccattgttttccctttctatcacttgctttgattttttacttccaaagcaaagttactatctctgatatcatatttattttttctaaaaaaatcaacattaagtattttacggactaatccctgattttttcttccagtacgtaattccatcagcttctttacggattcgttttgaaaatcttttatgagtccgtattccaggcctacactttacggactcaacactgattttctcttccagtacgtaattccatctgcatttttacagattcgttttgaaaatccattctgagtccgtaattcaggcctacactttacggactcaacccaggttttctcttacagtccgtaattcaggcctactctttacggactcatccttgattatctacttcagtccgtaaactactttacaaatcttggatttgaacttagaatagtaaagtttgattggaggattattttgaaacagcaaaagattttcagattcagtatttacatccttggcttcgttgttttagccttgggaatcatcagcaacacaaaatcaggtctcggcgtcacaccgataatttctatcccatatgcgatttcactgattataaatttcaatttcggaaacgcaagcatgatcatgtacacggtgctcgcgatcgtcgaatacatagtaaaaggcaggaaattcaagctttacgacctgcttcagatcccgctttcatttttcctgacgagacttttcaatctcttcggaagcttcctgcccgatgcgcaaactgttcctatgcgtattttctgtttagttgtcggtattgtctgcaccggaatcggcgccgctatgtctatgaatgcccgcctcgtgccgaaccctggcgacggaattatacaggccatctctgaccgctcgaagaaaaatcctggcctcgtgaaaaatatcttcgatatcggctgtgtcaccctaactgtactgattggtttattaagcaccggtcacatcgtcggtgtaaatataggaactctctgcgctatgatcggtgtcggaagagttatagctatctacgaccacttccttctcacaaagacagacaagctctccggaattactgatgatgacgaggattacatgtcagacgagattggagagatggctgagtaagccttaaataaacttctttgcgaatgctctcgcgtcactaagctggcttgcggtcggtttattttttgcataaaaatatgaaaccctcgtgtttccagatcttgaataataacgaactaaagtgctcatatgaagcctccttattctctattatagtcaactagatgggattttcaaataacagaaatcctttctcaatgccttataaaaacggtaccatatatactggtatataattgatgccattctcccatttataatccttggtgtgaaccacatacttagccttgattcgttggctgaatttgtcacagaatacatcaagtgacctgtggttcctgtaattgcccgatttgacctcaatcgggcatattttatctcctgacgggatcagaaaatcaatctcatacagatgattcgaggtctcacttctcatcgtataataaaacaactgatttccatttgccgtaagcatctgggcgacaatattttcgtagatatagccaagatttgcttcgattttatcagaaagaagcttattatagatgacgttttcggtgtatttcttgtctttaaacacaagcgtgacaaacaaccctgtatcagaggtaaaaagcttatatctgtcgagatttttcgaaagagacatacctgcacccggatcacttgaatgataagcgatattcacagtgtatgagctgagcagttcaggcagtattttttgaatctgagtacctctgatgtcatttttcgcattcgaatacatatatcgtgaagcattgcttgtaagactggctggaatcgaatcatagatctcactggacagaccagactcatctatcttaaagaaatcatcttcatatagctcaattatccttctctttgtctcatctacaagctgaagattattcttctgtatgtaggtatcaactgcctgtggcatccctccgaccagcatatacagcctgaacaggcgcatgaggcttctgtgcagtgaattacctgccggcctctttgccttaagaagctctctgatggtgtctgctgtcacatcgtctcctatcgcccaaagaaattcctcgaaatccatcggatacatcgaaatcttcaattcctcgctgggaatcagtatatccttaatgttcttccttatagtaagcagtgaacctgtttcgatatacttgtatctgccgtctgccacgagatatttgatggcctgtctggcctttggaagaagctgaacctcatcaaatataattactgattcatgttcatacagcctggtatgcgtcatctgctgaagctgcagaaagaaaaaatccagatgatatgtatcgtcaaaaagcgcttttatctcttcactggtatgtgcaaagtctataagtatataagacctgaattcatttctggcaaactcctccactatagttgatttaccaactcgcctggctcccttcaccagcactgcatatctgtcactctgattttgtttccatgacagcagttcatcataaatctttctcttaaacacaggattggccataaatcaacacctccagcctcattatagcgcaaatccccgttcaggtaaagccaaattatacgctaatccccgttcgttatatgccaatttctgcgctaatccccattcagctgatgtcaaaatatacgctaatccccattcgtttggtattttagaacaagtgtttcgaaaaattcaaaataaaatagtcgaaaaaactaaaacaaaactgccgaaaaatataaaatgaaatagccgaaaaaatcaaaacaaaactgttgaaaaacataaaacagagcatggcaaatgcctgaaaatcagctgtttagaaaagacaggacctggtactgccaggtcctgtcttgtaatgaaatataactctctttattcgcagttttatctgatatcgttcactcctacaggcttgatattgttactcacatcgtaatgctttccgccccagtagagacggttgttcacctcgcacttctcgttcggagtgacatccttcatgatccacttgtagaactcatcaaagccggtacggtctacgatgtagcccacatgctcctttgattcataggcgttgggatcgatgtattcttcaacaaaggcataggcattttttacaatcttcatcacggtctcttcgtctgcccatttcatgaagtcctctgcgagccttggattcttcttacctgtgcggcctaagagtgtgactctgaaatagtgctcctttgatctggtccaagcccttgtaggacagtaggtcacgcagacgccgcagccgatacacttgtcagtatctctaattaccttgcctccgaccatttttaaagcgccaacggatctgatcttacagtaatccacgcactgtccgcagccgatgcacctgtcagggtcgtactgcggctcagtcatacccatgatgccgaaatcgtccatcctgaccttggcacagtcatttgagcagcctgtaaaagcgaccttgaaatgcctgttgttcgggaaaatctgatcctccatcttctgcgcgaaggctgtagtatcgtagcaaccgaacgggcagagccttgcgcctggacaggccaccacatttctcgtaccggaagctgggaagcccttgtccctctcctcctgattgatatgggcctcgtcgatgcaaagctgcagctccttatttacagcatcgatgtcctcgagcgagattcccggaatctctacaccctgacggtttgtgataaaaatagaaccgttcccgtatttttccgcgatctcggtgatccttaccatagacttcgcgtttatcagaccacccggaatacgcacacgggaggctgtctcaccgcgatgcttggacacgcggaacgcatttttctttaagctcttaacatttatatctgcactcatcctaaagcctcctgtcaatccagcatatccttgctcacactatagttaaataccggtccatcgagacagacgtatttgtctccgatgcggcagtgaccgcatttgcctagtccacagcacatcctgcgctcctgtgatacccagatattttcttccttgaatcccttctcgagaagtcccttcacagaaaatctcatcataggaggaggtcctacaacgacagccttcgcactgccggcatccttgagcggcagatcaggtatgtacttcgtcacaaggcctaccttgccggaatagccctccggcgcgccatcgactgtcaggataaggtccagcttcgcgtcccagtcctttaagtctgctctaaaaagcatatcgtcagggctcttgaagccgacgatcacatgcttatcctctggagtatccgaatctgctaatgccgagatcacacctctgacaggtgagacgccggtaccgcctgctactacgacagtctcgccatcagtgaaaagccccgtatcaaagccattgccgtaaggccctctcatcaagagatactgtcccttgtaatgctcgaaaacctcattcgtcactgtacccacacggcggatagtaagatccacgaaatcatcaccgataccactgatagaaataggtgcctcaccgaatttcggaacagagacctcgaaaaattgtccaggtctgcactctccctcgaacttcatgcgaaaagtgtactcttttgccgtatgctttatgacatcgagaatctcagatttgaacggcacataaatattttcctgactcatcatctgccctcctcttctactgcattatctaccttgttaatgatattcgagaacttgatgtattcaggacagacatcgtcacatctgccgcagccaacgcacatgttatgaccgaatctcttcttatggtcagaaatcttgtgcaggaccttaaacctcatccgctcgccctggctctttctgtactggccgccgccagctacgtttgtgtagccgtttatcatacatgaggctgctaccctgcggcgctctccgaccttgccgttctcagaatagaaggtatcctgcatcgtaaagcaggtacaggtaggacagacgatattgcatctgccgcagcctatgcagcgggagctgtactcatcccagatatctgacttaaatatgctgtttggaatctgatccggaatctctacatggacaggattttcagtcacgtgagcgggcgtcacatcctccttcttcgcagaaatgctctcaaaaatctctgccacttcatccgagcagaccgcactcttcacctgatctccagctgcatctattgaaaaaatatagtcgtccggcgctacattcgtgcccatgtccacacagaagcagttttcaaatgaagacgcacatcctataagagcgaactttatgtgctcacggatttttttataaaatggatcctcgaatctgtttctcagatagatatcatcgaggctcttcaccgcgtgaagatcgcaggcacgaaggaacactatcgcgtcgctaatatccatgtccgcttccttcgtttcaccctcagtaaagaaaaacagagtctgtgacagcggagtcaggatttccttaaacgcgtagtcggatttcgcgtcaagctccatatcctcaagccggtttacgaaatcgtatctgaccacatcggtatctgtgaaacgcccttctcctacttttctcaccggcgcatacagccggtatttttctcccagtttctgaagcacctgatcaaatgcctctttactcactacatatcccatagatcctcctttttaaaagccatggaattttacttttcaattaagaatatattatcacgccgggattacatttgccgtgatgtacatcacgttttaaaggtaaatatgatataattaagctctataaaaaaaacaaatgactgggtggtaatatgaattcgttaactgatctggatatctacaaaaaatcgtcaaggcagacgaaagccgcactggctgaccgcggaaatattttaaatataaaaaagggcgaatttctttttaatatcagggataaagtgaatgtagtctatctgatcatttccggatatgccgttctaagccgcaatagtgaaaaatatggtgtccgcaatatttttctattgggagcgggaagtctacttaacgaagtgatcctggacggggtttcagcatccatttcttgtcttgcactttcagatctcaccgtgataggctacccacggtctgacatacttggcatgatgaaagctgatttttcctttaacagatatgtgataaattctatggctctaaaaatccgcaaactctaccacatgcttgaaatctctaccaagagcactcacttagaccatcagacggcctcccgcatctggaaatttgcgagagacttcgggattaaaaaggatgggtatgtgttgattccattcgagcttcgtataactctcttagccggtttcataggttccagcagagagaccatctcgcggatagtaaagcagatgtccgaagctggaatcgtctctattgaaaaaggcgaatgccggatctacgatctggataaactaaagaattacgggcgttaaaaaactgcccgggatactgtgatagtttcccgaacagcctgaaatgaagtatctgtttttacagattaagctcatcgtagaaggacgaaagcagctttgctgactggcgaagagcagcctcctccttcggatcaagatttatctccacgatttccttcgagcctgtcttatcgattatcgtagggactgagagccatgcgttttctatgccgtattcgccggaaagcccgacagttacagggtagatatggttctcattgaaaaggattgatttacagatggcagctgccgatgcagcaattccgtagcaggtattgccctttctgttaaaaatatcccatcccgccttgattgtctgcttctgcaaatcctcaggtgtcacattctgagtcctgtccggattgtccttcatgacattttctacgggcttgccaccgatgactgccgaatgccaggaaacgatctcactgtcaccatgctcaccgcagacgtaggcagaaacgctcttagaatcgaggtcgtacatttttgcaagctcacagcagagacgcgcagagtccagatttgtaccggatcctattacctgattcttcggaagtcctgaaagcttatagaccatatatgtcataatgtcgacaggatttgagattacaagaaaaataccgtcaaatccgctttccataaccgaacctacaatgctttttatgatcttcatactaggagcaagcatatccagacggcttgacgaatccttcggcattggagccgaagctgtgatgatgacgatatcagcatcgtggcagtcactgtaatctcccggatgaattttgatattgcggttcataaaataaatcgaatgcgccatgtcaagagcctcggcgtaggccttatccttgttcacatcgataaggacaacctcctcggcaagcccctgattgatgatagtataagccgttgtgcttccgacatttccgcagccgacaattacaaccttcgaatctttaaaacccattttaattacctcccagatttaaaaatcttccactgcattatacaccaattgcatggcttgtgggaacaggaaatgtcctgggcagcttttattttttcaaagaaaggtattgacatacttcatctgtcgtagtatattgttgtcaaaagatactacgacagtcgtaatacgacagtcgatataaaattgaaaggaggtatagtgtggaaatcagcagtgatgtcattcgaggctacaatgacacgataatcctaagcctgctgctcgattctccctcatatggatacgagatctcgaagagaatcagagatctgactgacgatgcctacatcatcaaagaaactacattatattccgcctttacccgaatggaaaagaacggttacgtcgagtcgtttgcgggattcgcagacaacgggaaacggcggacatactaccggatcaccgataagggacggcagtattaccaggagaaatgcagcgagtgggaattaacgaagaaagtgatagagcactttatcaggaaggagtcatgatggaaactattaagaattatctggaatcgatgtttgcgagtctgccgaatacgcctgaggtcataaaggcaaagtgcgagctcggacagatgatggaagacaaatacacagagcttataaatgagggaaagaacaaaaacgaggctgtgggacaggtcatctcagagtttggaaatctcgatgaattgggcgatgccttaggcatcagtcatatcctgcacgaccagggcgaggccataaatacccgtcaggtaacagaggatgaagcaagagcttttgttcaggaatccgcaatctgcggacttatccgtggaatcggtgtatttttatctataatttctgcctcgggagtcatacttgcaagcgctgcgtctgactcagatgacatatacatggtgattggacttgttttcttattctgctcggtagccgcctgcgtcgcgctctgcacatacagcaatctcaggatggacaagtggcgctttcttaaatatgagccgtgcagcatagattattctacagccggaatggtaaatgacgcaagaaacagactccatggcacaataatccttcagcgcacgatagctgtgcttctgctctgcgtctgctatgtaccgcttatagttttaagcatgataggcgacggagccatctattcgctggttggcgttgtaattctgcttcttctggttggattcggagtgctgattctgatatcagccggtgccagagacgagggctatgtccgtctcttaagactcaacagccgccagagaatggagggccattactccaaaggccaggacgaggtctattacgagaatcctactcttaaaaaggtcatgtcagtttactggccgattgtgacctgcatttacctggtcataagcttcctcacattcagctgggctataagctggatcatctggccaatcgccgccatagtcagcactattataaataatatctttggaacaaaaagggaggactgagctgtcatgaaaaaaagaagcatttatctgattcttctaggcataatcacaatcgccggcatctgctatggcacctatctgcacataggaaagccgttacttaatgcctccggaaactacttttcatataaccttggctccaagggcaatcataagactctgaaaaaaataaacgtcttttccactgcgcagatttctcttcacaatgccgatgtggcatttatatctggcgacgactattctcttacttatgtgggaaaagaatctatacttcctacgtataaggtcgagaatggtgttcttactgtcaaggatcccgccactggtaaaaaaccgtccggtgttcttaaagtaaccattccagacagccttacggaattaaatgagattaatgtggcagcatacactggagatacttgttttggtacaaagcaaaaacttgctgtaaatacaataagcatcaatagccaggatggggatatagtctttggtgctgataaggatttgaacgttgatactttgactctgaatagtaagaatggagacattgtttttaaatcatctgattcaatgaccgcagatactgccactctatacactgaaaacggcgatatgacggtgtcaggagcagactttaatgactcaaaaatgacaagtaaaagcggtgatataatcgcgtcaaatgtcagctttaagaaatccgaggtgaccagcacgaatggcgatataaggatttctacatccgatgatttgtcttcttacacctttaacctgaatggaggaaatggagacatttccatcggagacggcctatataagggtaccctctcctatggctcagatatcactgtaggaaaaggatcgaacgtcatgatactgagtacaaagaacggggatgttacagtaaagaaataatttccggctccgcaatgtattttttctggaaacaaatcaaattttgacccggatttctttaagaaaagacaaaaaacagggtgttttactttagtttaccgacggaaaacaccctgtaattttgaatttcttcaaaaatcctggtcaaatcttattttttcaggaaaaaaacacccggaaattctaaaaatgcatgtatacaccaaaagccaagtcgatagcttaaccataaacaaaaaatcaagtcaagagcttaaccataagcaaaaaatcaagtcaagagcttaaccataagcaaaacaaaagatcaatccaatagttatccgatcaaactcagggcgcaaaaaaagagccggcagatttctctgccggctcccggtatttttataataagtgactatcagtcaaggtgaggacctgctggaacaagtgccttaccagcgtcgttaccctcatacttcttgaagttcttgatgaatctctgagcgagatccttagccttctcatcccactctgaagcactagcataagtgtcacgtggatcaaggatagctggatcaacgccaggaagctctgtaggaacctcgaaatcgaagtaaggaatcttctttgtaggagccttgtctacggcgcctgtctgaatagctgtgatgatgcctcttgtatccttgatagagattctctttccagttccgttccaaccagtgttaacgagataagccttagctccgctcttgttcatcctcttaacaagctcttcagcgtactttgtaggatgaagctcgaggaatgcctgtccgaagcaggctgagaatgtaggagtaggctctgtgatgcctctctctgtaccagcgagctttgcagtgaatcctgaaaggaagtagtactttgtctgctctggtgtaaggatagatacaggaggaagtactccgaatgcatctgctgaaaggaagataacgttatcagcagccgggccgtgtgagataggcttaacgatcttctcgatgtggtagataggataagatacacgagtattctctgtaactgacttatctgcgaaatcaatcttgccgttagcgtctacagtaacgttctcaagaagagcgtctctcttgatagcgccatagatatccggctcagcgtccttatcaaggttgataaccttagcgtagcagcctccctcgaggttgaatacaccgttgtcatcccagccgtgctcatcgtcgccgataagaagtctcttaggatcagtagaaagtgtagtctttcctgttcctgaaagtccgaagaaaatagatgtgtgctcgccgttaaggtcggtgttagctgagcagtgcattgatgcaatgcccttgagtggaaggtagtagttcatcatagagaacatacccttcttcatctcaccgccgtaccaggtattgatgataacctgctcatggcttgtgatattgaaaagaactgctgtctctgaacgaagaccgagctccttgtagttctcaacctttgcctttgaagcgttatatacgataaaatcaggcttgaaattcttctgctcctcttcagtaggacggatgaacatattctttacgaaatgtgcctgccaagctacttccatgatgaaacggacagccattctggtatccttattggcaccgcagaaaccatctacaacatagagcttcttgtttgaaagctcattctttgcaatgtccttgcaggctttccatgtatcctctgatgcaggatggttatcgttcggatactcctctgaattccaccatacagtgtccttagagttctcgtccataacgatgtacttatccttaggagaacgtccagtgaaaatacccgtcataacgttaacagcgccaagctcagtctcctgacccttctcataacctgtgagacccggtgccatctcttccttgtacagatcctcatatgaaggattgtaaacgatttcagtcgtaccggtgatcccatactgtgtcagatcgatattagccattttttgataacctctttctgattctttaattgtatttttacaagtaccgaatttcattataccttattgccgggaaaaatcaactcatttttgggcactctgcattaaaatcagctcatttaataaatattatccggtggtcaaccttttgaccaccagatcatgaatattaattaacaaattcttaactaagcttcttgtaaaaaatcccgcaaactgctaaaataaggtctacactaattataaactttttgaaaaaatatagaaagtgagggatattttgccatcgagttacagtaagataacgccagagattgagaaactggctggccttacagagcaggccgcctatgttaaccctgagctctataccgagtacggtgttaagcgcggactccgtgatctgaacggcaaaggtgtcctggtaggcatcacgaacatctctgaagtaaattcacagcgtgtcatagacggaaagaacgtcccgatacctggtgagctttactatagaggctataagattcaggacatcgtaaataacatcaggcctgacagtcatttcggttttgaggagatcacctatctgctcctgtttggagaacttccgacgaagaagcagctccgcaattttatcaagcttctgtcttcctacagatctctcccgaagaatttcgtaagagactctattttaaagaagccttcaaatgacatgatgaactcgctcgcgagatctgttctggccctctattcatacgatgacaatccggacgatatttcacagccaaatgtgttaaggcagtgtcttcagctgatagccatgttcccactgctttcagtgtacggttaccaggcttatcgctactacgccaagggcgattcgcttatcattcaccgtccgaagaaggagtactctaccgctgaaaatatcctgcactgcttaagagacgacagcagcttcactccgctcgaggcgaagcttctcgatgtggctcttattctccatgcagagcacggcggcggcaacaactctacatttaccacgcatctggtttcatcatctggtacagatacttattcggccatcgcagcggctttaggctcacttaaaggacctcgccacggcggtgcgaatatcaaggtcgtgaagatgtttgcagaccttaagaagaatgtaaaagactggaccgacgaggaggaagtcggcgcataccttcgtgccctgcttcacaaggaggccttcgatcatgcaggccttatctacggaatcggacacgccgtctactcgatctcagacccccgtgccgttctcttccagggatacgtagagcagctggccgaggcgaagggatacgacaaggagtacgcactctattcactggtagagcgcctcgcgcctcagattatttccgaagagagaaagatctacaaaggtgtcagccctaatgtcgattttttcagcggctttgtatatcagatgctcggtcttccgatggagctcttcacacctatttttgcgatagcccgtatcgccggatggtcggcacacaggcttgaagagttaagtcaccacgacaagatcatgcgtcctgcttacatgacagtcgccaagcacagaaaatacatcccaattgatgaaaggtaacacatgaaagattttaatataatgctggttttcgacctggccatcgctggactgggtgcatacctgctctacactgcatttcatatgagacaggaaaagaaagtacctccgatcctccttgcgaaggaagaagtcgaccgctgtgaggatcctgagggcttcacatcctatatgtttccgaagacacttgtttttgcagttgtcagcacgatttgtggaattttatgtttcctttctgaccttaaagtattgcctttatcccaaaaaagcggtaatatttttggtatagtaatgctattgatatttctcgccgtatggctctatttcatatttttcctgaagaaagccaaggagaaatattttaaatctgacatctatctttgatgtttatgaggatgatagatcatgaaggaaaaagcgaagattttaattggtgatgattctatcctggcaaggcagcagctcaaggatacaatctcccgctacgtgacagacccgatttttattgaagctgcaaacggaaaagaagccgttaccaaatacgaagaagagaagccggacctgacgtttctcgatattgtcatgccggtccgcgacggcatcattgccacactcgagatcacgaagaaagacaaggatgcgaagatcatcattgtctcctctataggtactcagaaacagcttaccgctgctgtccaggccggtgccatcgattttgtccagaagccggtgaaggacgaaattattcagcagatcttaagcaaatacttagggggagaataaatgtacgctcagttttttggaagttaccttttaagtaaaaatatcgtaaccccgaagcagctgacagaagctatttcccacctgtccgaagcgcacatcaagcttggaactctggctatgcacaaggggtatatgacagctgaagaagtgaatgaagtttgtttccttcagactcgtgaagacaagcatttcggtcagatcgcccttgagaggaactacctctttgaggatcagctgaacgagcttctgaacacccagtcaccagactaccttcttttgggccagaaccttgtagatatgggcgccattacgaataaccagctcgaggaacttctgctcggttatcgtgatgaaaatcagctgaacagcgacatggaagcgaatgagctcccggaagagtctatgcagctcgttgataaatttttcgagcagacaggccgccctctccctaagaacattctgatctatatgaatctgctcttcaacaatcttgtcagattcataggttctgatttcacaccactgacacctgtttttacaaattcgtacgatacgaatttctgcatcacgcagcagatcaaaggttttcttccactgcttactgctttagacatggagccggagacagctatcaccttcgccagcagatatgcgaagatggagttcgatgagttcaacgaatacgtaaaggcttcgctcgaagatttcatcaaccttcacaacggcctcttttctgtaaacatgtctaatacctactcgaaggaagctgagctcgatcctcctggtcctaccgatgaagacacgcttgagctctcagacgatgcctttgttgtaccgatcatctatccgtttggcacgatctattttgcgatcagcggaacaggtgatgctagcatcgacgaggattccgaggaatcacaggaataaaaatcgccaccgggttttaaaacccggtggctttttttgcttaaataaagttcagttcattcagaatccgaggaacttcttgacctctgtcggcatctcagatacctcgcaggtggtcttgtggcggatcggagcagtctttatctcttcgatagctggcgggatcttagtcgaggatactttcgaaaggtcatctgtcagctcaagatcggtcttgttcctgtcatcctgtccaatggctgtcattacagtccttgtaaatttgtacgggcttgcagtcgatgcgatcactaccggcttgtcatcgcctgtctcctttaaatatttctgatatacagcactcgcaactgccgtgtgcggatcgatgacatacccagtgtcgtcgtagagcctcttgatctctgcgcttgtctccttctggtctgcaaaatttccatagaagtcggagaggttctctctcatctcaggtgtgatcgtatatctgccgtcttctctgagctccttcatgaactcggaatccctgatgtcgtcacacccggcgatcctgtaaataagtctctcaagattcgatgagatcagaatatccatcgaaggcgagcttgtgacatgaaactccctgttcctgtcgtatgtaccagtgctgaagaaatcgtagaggaccttgttctcattcgaggcacagatcagcttatcgacaggaagccccatctgcttgccatagtagcacgccaggatgttgccaaaatttccggtcgggacagtaacgttgatcttatctcccgaagagatcctgccctctttaataaggcgggtatatgcgtaaacgtagtagacgatctgtggaaccaggcgtccgatatttatagagttggcagatgagaacttgaaaccgtgatctgcgagctctttttcaagagcctcatctccgaacatcttcttcacgcctgtctgggcctcgtcaaagtttccattgatcccgactacgaaggtgttgtcgcccttctgtgtcaccatctgcttcttctggatatcagagacaccgtccttcgggaagaatacgatgatcttcgttcccggaacatctgcaaatccagcgagcgcagcctttcctgtatcgcctgaagtagcggtaagtataacgatctcgttcttgatatcgttcttcttcgctgctgttgtcatcagatgcggcaggatagaaagtgccatatccttaaaagcaatggtcttaccgtggaagagctccaggtaataagccccgtccgcaaaagtcaacggagcgatctcagcggtatcgaacttcgagtcataggctgcatcgatgcagtgctttaactcctcttcggtgtaatccgagagcatcagcttcatgacctcgtaagccacctgcttgtaatccatctcggaaagctcttcaaatgacttgtcgagcttcggtatctcagtcgggacgtagagaccgccgtccggcgccaggccctgcagtacggcctgggatgcagtgaccctgtcactcttatctctcgtgctaacgtattctacgctcatctttttccttctcctttgtgcaaaaacaactgtccgcaacacacgaacggttttattataaataaaatgccctttttcgtcaatatatgataaaattaaaccatgtcctatggtatatacaaaactgcattaaaagacggcaccacaagttttagggccagtttctaccacgacagcagacacatagctgtcggcagctactccgatgaaaaatcggcagagacggccgtctccgaggccgaacgcctctacagcgacaggaagatcactatctggaatttccggaatttcataacacaggtcgcatttaacaaagccgtctctatcttaaaccacagggacaaccatgtatatatcaagactcctatctaccttatgcagggctattttatctattttttagatcagaaaaatatcctgaaattcgacaacgacgatctcttctactattctacgcaccgcatcctgacacacggcggccatctctatgtaaacgactacggctcgcagtattccgtgctctcgagatacgggatcagaagcttcggcgtcaaaggcattgactacgactttgcgaacggcgacccatgcgatctcaggtacgaaaatgtcatagtcataaatccctacaacggcgtcaggcagctcgacaacagcggaatgatccgctacgaagcgaagatccacattaacggctatatcagaatcgggctctaccgctcggtaaatgaagcggccgtggcatacaacaaagccgtggactactgtctgtcacacggcttagagaagaattttgtcaaaaattatgtggttgatttaagtgtaaaccagtaccagaaactgtataaagctaccacgcttcctgacagtctgaaaacagctgtaaatgccgtcaatcaatagtactcgtcaggtgtccgaccggaagaaattccggcaggccgtcgttgtaagacatgtcaacctcgccttttatcagtggtttcagataatctatcatcttttcagtcacatcgttaccgcgttcattgataaagtccctcggaacctttttcacaccattggcgacttcatatacagggacagaaccgtaggtaacatgataattttcactgtcatccctttggatagtcgtcataagaccggtcttaccctcttctgcaaggcagactgcggcgctcccgagtccaaaggcttcatcgagatccgtctttgaggcgaggtgtgtggcacatctctgcggaatgttgagctcaacacttctgatcttaaagccaagagcctgtcctaagatgtgctctaatgctttcccggctcccgagagctgggcgtggccaaatttgtcatccttctcaagagcggacgcagagatgtagtctccgtcagtatccctgatgccctctgatacagcgatcagtactgaatttctattctttaaaagcattttggtatcttcaatgcattcctttacagagaaaaggacttcaggcagatagataagctgaggtgcatttaagtccttagtcctcgcaagtgcggatgcagccgtaagccagccgctgtcgcgccccatgatctcggcgatcgttatactcttgaccggatagatcatcgtatcgtatgccatctcacgaatagtcgttgccacatactttgcagccgagccaaagcccggagtgtggtcggtgtagagaagatcgttgtcgatggtcttcggaacaccgataacctttatagaagagccctttttcttgaaatagctggccagcttcatgaccgtgtccatcgagtcatttccgccgatgccaaaaaacgtatcaatgtcaagtctcttaaaatgactgtagagcgcgtcgtagatagccggctcaacattcgggtccgggagtctgagccggcacgaacccaggtacatcgcaggtgtcctgtagagcttctctataaaatcagggtcttcggccattttttcagtcaggtccatgactttctgtgaaagtacaccgacaattccgttgatgcctccgtagatgtgatcataaccggcttccgatgcccttttgatgacacctgccagtgacgcattgatggccgcagttgggcctcccgactgaattacgatacagttcttcactgtaagctccttccatgtaaaaatagtccgtagtgtgtgtacaagaagatctcagctccggcgcggtatttttcaggcagtgagtcgacagtctcgtatgagatatcctggtcagatggtgaaacatctctgatgataccctctctggctttcccgcacactccgtggactgcgtcgtctaaagccgccattacagccgcgcacctctctggcctcccgctttcgtagtcgccgcaggcctcgagatagacgtctgtcagaatttttatcgctacctctgaaaaaatatcgtcaggcgtagtctgaagaaaatatctgatcgtatttctccaggcgtaataagtcccgaaggtattttttacttctgccctctgcccgagtccgtgcagtgccattgcagctcctacatttgcaactttatatcccgctttcctgacgcggtaacaccaggtcgtatcgtcccagtagatgtagttctcctccggcagaagcccaatcttttctgcaagagaagtccttatcataagggcacaggccggcgccgcatcggaatagactacttcaggtgacgtaccatcctccggctttccaaagtaccgagagaccgttccacagagtttgtagctgatgtcaagcccatagcactggatcagatccggattatcgagaaagtagatcttggatgctgccattccactcgaaggatttttatcgagatggtccgccagctctccaacacagttttcatcgagcaggcagtcgttatcgacgcacatcagatactcgtattcttcatcagcatccagcgccgcacgaagcgccgtatcaaagcctccggctccaccgaggttttcgtccgtgacaagaagcctcgtattcatctcaggatgctttttgataaactgctctatcactgtgacagagtcgtcagttgaatggttatcacagacataaacatcgaaatctgaaaacttctgctcggaaactgcctgaaggcaggctccgatcatgtcccgcttgttgtagttgcaaatgcagatggcagcttttttcattgtgagacctccgaggtatattgtggcatttataggtattttttgcaatattaaattttttcaaaacatataaaaaaacggcaccgtctctaataaatagaaacggtaccgtaaatttcagattatagaaatcacttctggatcgtgaaacggttcagatcgccgttgatggaatcggcggcatccgatacagatgacgaagctccgaatacatccttactggactcggcaacgcccttcgcattctcagcgactgtctcgacagtagcggcaatctcctgagtcgtagctgactgctcctcagaagcagaagccatagtagatgcaacatcgtttaccttgcccatcatatcggtcatagaagagagggtattcgttgccttgtgaacttcctctgtgatcgatttgaatgtctcagcggcagtgcttacagaagatgcactgtcgttaataagctgtgtattggcctgagccttggctgaaaggtccttaacacgctttgacatctttgcgacgatatctgaaatcttcttcgtatcctctgctgaattcgtagcgagaccaccgatctcggaagcaacgactgcgaatcccttgccggcctctccggctctggctgcttcgattgaagcattcagtgagaggagctctgtctgatcagaaatctcatcgataaggtctacgatcttcgtgatctcgtcggcagcctgatcaactgacttaacagcgtcgtccatctcgttcatcgatacgacgatgttatccatgttgtcagcgacagcgctcatatctgtctggccatcattagccttatcaacgagggccttcatgacttcctctacctgattctcactggtaacgagatcagatacagtctgtgcaagtgtcgtggcattctgtgcgacatctgtaacagcgtctgccatgttcttggtgttctcacggatctgatccatcgagatcgactgctcatcagcagccttctcaaggctctctgcagcatcctgagtcgtcttcgaatctctgataagcttctcggccacatcctttaggttacttatcgaacctctcataccgcctataaagtcgtccatagagcggttcatataggcaatctcgtcgttgcccttcgtctcgatatctacagtgaaatcgccctgggcaatatgtccgatgttatcagtaaggctctcgacaggctttctgatatacttcttcagaagatacatcataacaataatatatactacaacagcgataattcctaaaacaagaacaatgattatcatatagataatatcgcttaagacgctggcccggtcagcatagataacgacatcccagtctgtaccgctgatattttcagatacagtataatatgtgccccggctggtagagatggtagtcacctgaccattcttatgattagatgacttggaaagtgctttaaaaagcggatcattcgacttggttaaagtctttccgttcaggctgtctgtaggatttgccagaatcatgcccttcttcgtcaccatcatgacatgcccggtattgtagaatgttatcttcttaagagacttctggatagactcaatcatcagatcgcaggcgaaaacgccctctctgccatcctttagatggacatgtctgataactgtagtgcagagctttttggtgtcatcatcaaagtaaggctctccagaataatagaagtacttgttattataggacatgccctgcttgtaccacgacatagtcgtaacatcgtagtctttgcccggattccatcctgaaggatccagatacttcttatcggaaagtcccagataagctccagtcggaatcagcgggtatctcttcatcgtagtaccgagataagtcgtgatctccttatcgtccttccattccacattctcaatggtatctgctataccattcagatagtagaaagtggcattcagctctctgtttacagtacctgcgtcgtcggaagcctcgctctcaagtgatgtgtagagcatgtttctgattactcttccgccaaaaaagaaaataactgtgacgatgactgcgatatcaagtatgaagatcggcagcatcctcgaaagcactttcttacttactgcagtaactttctctgattgtttttttcctttcatgcaattcctcctgaaggtttatgtgaaaatatttcattacaaaattaaccagtcagagatataatatcacacatgtagaaaaatacaatgaattttctaataaatttatctctttcagtagtctacgctgataagcgtaagtcccttagccggagcagtcggtccggcagatttcctgtccctggcctcaagaatatcctctacatctgagactttaagcttaccctcaccgacaagaagcagggtcccgacaattatgcggaccatattctgaaggaatcccgttccgtgcagtgtaaagtaaatatagcccttcgaccttctgacatctatcctgtcaaccattcggacagtggattttttcatatgggaattgccgcaaaagctcttgaaatcgtgctctcctttcagcacatcggcagcctgctgcatggcagaaacatctacgtcatgctctaaaaccgtataatattttctattgaagacagggtgcaccgggccataaaaagctgtgtactggtaagtctttccgaccgcattgtacctcgcgtgaaaacgatctgatgcgactgagacttcccgtatcgcaatatcgtcaggcagatatctgttacagtaatcgcggatcgcgtcgcagtcgagcggcgtatcgagccttaccgatgcgaccatccctctcgcgtgcactccagcgtccgtgcgtcctgcgccgatcacttcagggatctgagcaggctcgtcactcccctctctctcgatatcctctcttttcatcagcataaatccgagtacacgctcgatctttccctggatagtcggcctgtcaggctggtgctcccagccatagtagcgggttccatcgtattctattttcagtttgtaatttttctcactcataatcacattttaacagaaaacagaaaacattgctaatatattagtagctgattttctttggaaagacataaaacggcccgtaattacccgtttcatccgtcagtttgccaggcgatacgtacatatcgtgcgccttcaggaattttacagtatttgtaaatgacttatacacagggagcacataataataattcctttcttttgagtcatcagagcggatgatacttatctcaccaatctccatcttatatgcagctgtatcaaaatcataatctgcaatgtccctgatataagcagctttcagatcattatagatatcggagctgtttgcaaagcgctcttttgccccgtcttcaaagttcctgtagcttatcgagaccctgcttaagtttttctcaatatccgcatcattgtagactttaaaatatcccttcttgaagtcatcggatgagacgattcgcttcatcaggttctttgcagactttggaatatatactttccgcctttctttcctgccgtttttcatctgataggaaatcgtcagttcaaacatgctctcggtttcatctttattctcttcaccagctttcagcagggcatttactgtgtcaatgtctgaaagttttacttttacattatctgttgtgaggatcgaagcagaagcgacgtcctcctttgccggaatccagcggctgtagccaaacaaatccaggcggcatgacatgatgattgcgatagcgagaaatccccccaggactgtgcagccaaatcctttaaatgcctttcttacatcagaattgtagatggcctccaaaacagctcctacgactacggctgaaataattacagctatgacttcggagcgaaggctgtcgctgtcatcggagataaacataagtcccgtaagcatcgatgcgataagaacgatggcaatcttcacgatgatccttactgtcttatatggaacagcttttccagcgtcctcattttttctgatcctgtagaggaaaaatgccagggtaaggcacactgctgcgcagattatattgtaaatatctccggtatgatttatcaccgtaagcactggagaaaatataccgttatatgggattccaggtccgacgtatgcaggaatataagtaaagcatgtattcaatgcgaacttgaaaaccggctcatataaaagaaggactatcgccgcgaatactgatacggtcagatttccggtaagcatcactgccagagtcgatactgaaaatatcgccagaaaaatagttatatccattgcaaagcagaagaatgcatcttttacaactgcagcactgcttgccttaaatgccgctgctgagatgagtcccagaccggttcctgccagatgtgacagaaaaagtatcaccgcgctgtttacaaaaacaccgaaaaagtgtgcattctttgagaatggctgactctcgtaaaaatcgatcatctgcctgtttgaaagccagcggaagccttcaatagcgaggagaacagatcctacagcagtgatcagaggattaaatccgttttttccaagaagacttatggccagttttgttctaataccgagctggttgaagctcagcagaaaaacgcagacatcatatagaatatatgtcacaaacgccagcacaaccagccagacgcggcgcttcgtaatatttttctgtaaagtcatgaagttactgaatgatgagttttctgacatcatatcctgctccttccgtttcagcaatgaatagttcctctaaagtcagcggcagaatttcgaaaaataccgtgtcgatatgtgaaaaaatctccgtgacctgctctctcgttcccttgactgtcatcacatggagtctgccctgcgtctcatccgagaggattttaagctgttcaggcagttttttaactgattcctcatccgaaaaaacacactgcagttttaaaagtcctgtcttcatatcgtcgagcgactccgacaaaagcaggccgcccttgtgcagaaggccgacgtggtcacagatgtcctcaagctccctcagactgtgcgacgagataagcgacgtaaaatctctattcgacatctcctctgcaaaaagtgatttgacggccgccctcatcacggggtcaagtccatcaaatgtctcgtctaagatcacatactttgtgttcgcgcagaccgccagcacaatggcgagctgctttttcatcccctttgaaaaggtctgtattttctgggccgggttaagaccgaatgcccaaagcagtttttcaaagtgtacgtcgtcaaacttaggatagatgctcctgtaatacgctgacatatcatgcggagtagagttactgaaaaaatatggatcatccgatacgaatacgaactgtgatttcgccctcggattgtcccaggtcatctctccatcgactgtaacttctccgctgtccggcttcagtacacctgcgataagtcttagaagcgtactctttccagcgccgttcgtcccgaccagacccgttatctcgttatccgctatcgttatgctgacatcgttaagtgccatcgatctgtcaaacgatttgcagactttattcgtttctatcatctttcgtcatcctttccgtcttctgcgtcttttccgtctggctccagcagttcgctcctgctgatcccgatctcttcggcctctttaaatatctcttcaagcctctctttcagctcgctctttttctttgagatcagtgtcgggtcaattttcacaaaatttccccggcccttgaccgaatagataaagcccttatgttccagctccgtataggccttctggaccgtgttcggattcgtcgatagctctatcgcgagcttcctgacggacggcagcggctcatcggcctgcagcgcaccttttaatatcagcttctgatacatgtctgcgatctgctcgtagatcgggcgcgggtcctgataatccaggaaattcataggcgtctcctttctgttctaactgtactagttatactattacagttaacatttgtcaagtatgaaatttgtgggtaattgaaaaatttgtcaaaagcagggggcagagggccgacctgctccttagaatttttctgctcgctcgcgcgcgcctattcgcggccctctgcccaatgtatggttttgatgcgtttatggttctggcgggtgggcatccgggccgctgctagcgcgctcgctcactacgaaaaattctaaaggtcgcatggtcgtctcctctgcccctgcttttcgaaaaaatgtacccgcattatttcaaaaaattctataggcagcatagccatctcctctgcccctgcttttcgaaaaaatgtacccgcattgccctgatctgaatttctgttctacatgccaagttttgaacccttatatcataatattccaatgtttttaaaaaaaaatccatcacttcaccgaaatgtgaagtgatggatttttttgtcaatcatgctctggatgggctttcatgacctctttatgaatttcgtcccgcatttcgggcaggtgatctcgatctttccgtgtcccctcgggactctgatcttctgcccgcagttcgggcagttatagattttatagccgttctttcggccataacggatttttctgtatagttcgacaaaaaatgctctgatccgccacataaataactcctggtaattgacttaatatcacatgtatctgatcatctcagagacgtccttcgatgcaaagtgtctcggtgaaggctcggtgccttccggtgcgtagccgatcggcatgatgaggacgatcttttcattggacgggatgccaaggctgtcgtgcagctgagtgtatgggaatcgattgcaccagcaggtggcaagaccctgctctactgcctcaaacatcgcataggtggcggcgatgcttgcgtcctctactcccgaatgtatgtcctcttcatccggattcttccaatcctcattttcgtcataggtaaaaacaagtacggtgtttgcaccgtatctgactggagtcagagcgtcgaccttgtcaagagtctcctggctctttaagacatagattttctccggctgctggttctttgctgtcggagccttcattgcggcctcgagcaccttgtcgagcttctcctgctctatcggcttatctgaaaatttcctgactgagtatcttttatccattaattcttcaaagttcatattagtgcctccttaaccagaacattataacacatttcgtcataaaaaaatcagagttttttctacctttgtttatgtaaatatggtaaaatgaaagcagtttaaaacagctggaaagcggctgtaaacttaagacatcaaacaggagacagcaaatggcaagtacgaggagaggcggcaggcgaaagcacgagccgatctacaagagttttgggtacgccttccagggtatctgggagtgcatccgcgacgagagaaatatccgcatacatcttttcatgacggcactcgttgttgccggcgggatcattcttcatatttcgctcgcagagtggatcacagtactgatactcttcggtctggtcataagccttgagcttgtaaatacggcggtagaaagcactgtggatctggtcacagacgagaagcgtcccctcgcgaagaaagcgaaggacacggctgccggcgcagtccttgtcagtgccatttttgctgcgatcatcggacttattatcttcatcccgaagatcatagattttttcagataggaggacattactatggctaatgatgatgagatttttacaggagcattaaagaaggtatttctcgcgggagtcggcgcagttgccgctactgcagacaagagcgaagaaatcttcaatgacctcgttgaaaagggcgagagcactgtttcacagggcaaatccctgaacaaagagttgaagcacacagtaaaggatcgtgtcaaggctgacagggatcaggcaaagaagtcggataacccgatccgcgatctgaacgccatcctcgcaggtatgactgccgagcagcttgacgctttaaaggacaggatcgacgatgtgaagtcgaacatcaagggcgacaagaaggacgacggcaagaaggaaagcgatagcgaagacaagaattcatgagcgaccaaaagtcaagacttcgcgagattacttcggtccttcaccgctacaaggtcatgacccggggcatcactccagagaagcttcgtcttgttctggaagacctcgggccgacgtatgtaaagctcggacagatcatgtccctgcactccgatatccttccgaaggcttactgcgacgagctgatgaagctcacctcggaagcgagaccgatgcctttttcagaagtcgagtctgtcatcagtgaatcgtatgagaggcgcggctataattatcgtgacatttttgaaaaaatagacgagacccctatagggtctgcttctattgcccaggtgcaccgtgccgtattaaatgacggaagcgatgtgatcgtaaaggtacgccgccgcggtatctacaccacgatgaggcgcgatatagatcttctgcacaaggcggttcgtgtccttccgaaagttcctcctctgaaaaatatcgtagacctcgatatggtcctcgacgagctttgggaagtcgcccaggaagagatggacttcacgaaggaagcggcaaacatgaaggagtttgccgaaaagaaccgctctattatgtatgtcacgacgccggatctctacgaagagtacacgactcaccacgtcctggtcatggagtacgtcgatggctgggcgataaatgatgccgaggctttaaaagagaacggctatgacctccaggagatcggacagaaatttgcgaacagttttataaagcaggtaatggatgatggatttttccacgccgacccacatcctggaaatgtcgagatccgcgatggcaggatcgtctggctcgatatgggtatgatgggccgcctgactgagcacgaccgcaagatcatggtccgcggcgtcaagagcatcgcgctgcacgatatttcgaaagtgaccgatgctgtgctcgacctcggagatttctgggcaaagcccgacagagatgcactgtacaatgatctgagggattttcttcaggaataccagtcgaaaggcatgggagatatcgatctcgcggacgccatgcaggcgctgatggatatcatgaagcagaaccacatgagcatgccgcacggaatgacaatgctcgcccgcgggctcacacaggtcgagggtgttctcgctgcgataagtcccgatataaatatgttcgaaatcgcctacagaaggctggttgaagaatcactccacgaccttgacctgcatgaggaggccagccactatacgagaaagttcctcagaatggtttcgaatggttctgagatcccttcactaacgtcggagatcatgaaagaatacctgcgtggcaagggccggatgacactcgacttaaatccggacgataagctgaccgcagttatcgatcgggccgtaagaaatttagtcataggtctctgtatcaccggacttctggttggttcaagtatcatctgttctactgatctgaatccgaagattctggggatcccatttctgggatttattggatttttcatagctgttgcagctatattctattttacgtgcagatttttcatccgtaaatggatacggtaccgccgggaaaatcctccgaagcgaaagagaaagaaacatgaaggagcaatattcaaataatacaaataaaataatcacaggaatcgtgttcctgatcttcctgattccgggactctactatatgcaggacggctacttcgacactatcgcagctaagacgaacgcattcttcttcagctgcgcagccgccgctgttttcggaatctatcttctttatgttttcatcagagatcacggtgtcaaaagcctgcttcggcttccagcaccctcttacataattgctttcttcgtcttgagctatcttttggtttctatcggagatgtccacgctctcgacggttctgcaggatggtctgtcggcgcgtactcgtatctgctggggctgatgatattttttattttcctgatcggagatactgatcttaatgctctagtaatccttctgaccgttgcctctctgccgttctatttttttacagtactgcagggagcaggtcttgatgtttttaacctgcaccagaagcttgttaagaaggagatgtatgactacatttcaacgattggaaacaccacggtctattccgggattacctctctgtttctcccggtagtctgtgctgccttggatcacgttgacgaatggaattttaaaggctctgccataaaggcccttaagatcattttcatagtaaatattgctgtcggcggcgcgggcatctatctggtcggaagcgacagtgcctacatcggaatgttcggttctctggcggttctctacattgtagagtgcaaaaagagaactcctctctggaagctcggaaggctcgctgccattatctcaggctcctttgcgatagcagctcttctgcagacagttaattctgcagaggcattccctccccgcaaatatttctcatattatatctgtaaattccatctggcgtatatcctgttcccgctgctccttgtcgcgacactcgcgctatacaaatgggccgggcatttcacttttccgtggattcctatctctgccatgatcgtagcagctgtagcggtcacagaagttcttactccaaagagcaggcatttcggaagcggccgtggagagatctggccattcgcggtaaacgctttcaaaaaagccggactgcgccagaagctttttggcgtcggcgcggactgtttcggttatctgaccggatcatatacgaacgacctctcgaaatcagacaagtggtatgagatatcgaaatccagcctcggcagtataaagacgaagcagaaagtcctctcagtcggtggccgcgaagtcgtaaactgccacaatgagttcctgcagcatctgctctgcggcggcatagtgaccgtagggctctggtctgcttcagtcatttcagtcataataaaaggtctaagaaataaacatgtatccccattcctgtttggctttatcggatggcttatccagtcgatgctcaataatccgcacaacactctgctttcacttgcgttcatgtttgcggcgctttcgataaaagaccagccggcagatgagtaaaaaaatccccgtgcatcagacgatgcacgggttttttcttatgatctttgaagtttatttatccgagatacactgctccggtctgccttatattcatcggatatacattttctcttccgaaatactcagccataaagtcgacatatccggctgtctcctcctttggaagcacgcacattataacacccgcgaaaccacctccgtggacacggcagattccctttctggtctttgcgagatactcttctgtcagagcaagagcaagagaaattttctgctccttccagtccgaaatcgtgtagcagttctgattcagcttgtaggaagaatcgccggaagccttgagcagagagagaatctttccgaagtccttctcctttactgcagtggctgtatcagcaactctctgcgtctcattgaaaaagtggaaggcacggagaatggccctgtcgtttccaacagtctcctctactttattcagatcagcgagcaggtctgccttagtcacatcgcagagcctttcgcctccaagtgcctttgctacggcaaacatttcctgcgggatcgacgagtagtcggcggagaggtctgcgtggccttttccagtgttcgtgatgaccatctcgtatccaaagtcaccgaagctgaacgggatcttttctacagagatatcgcccttgaaatcgagaaggatcgggccgccgtaggcacaggccatctggtccataagcccagacgatttgttccagaaattgttctcgctgtactgcccgatcttcgcgtaatctgtgacaggaattttatcgtcgttgaagaagtggtttatcatcgcgcagaaaagcatctcaaatgaagccgatgagctgacgcctgctgccggaattacagtagtcgtaacatacgccttgaaaccgtgaacctcgtaacccttcttctttgctgcctcgatcattccagcgacaagacttaaagttccctcttccttaggaacggattcgatgtcattgatatcgataacgactttcctgtaaccctcgcttaaaatctcaactgtctcgtctccacttacgcaggcagcaccaatggtgtctagatttattgaagcggcaatgacttttccgccattgtggtcggtgtggtttccgatgatctcggtcctgccaggcgctgtaaaatacgacagtccctcattgcttccgaactcgcctttaaatccctcttcgaggtgctcaaatctcttcttcgccccggccgcattctcgccgtaaaccctctcaaaaacttcgtccttaaccatattgatctccttttataaaaaatggtctggtctctttttcttaactatataatatcaccggcaggttttgattccttgaaaacggtgtgtgattatagtaaaatattgtggaaaattcaggaggtacctcggatgccaaagcagataatcaccgatatgaccagaaaagagaagaaggagcacggcgactacggttttccgtttctgataagccgcgagcacttaaatggctacgacggcggcacttttctctggcactggcacccggaagccgagatcactctgatcacagacggtgaaatggagtaccatatcaatgacgcactcttttctgtaaaaaaaggcgatgtgatcttctgcaactgcggtgccctccactccggaaacaggattccgggaagcgaggccgactgccattacaccgctgtgactttcgacccaaagctcatctacggcttcgatgcgagccgcatccatgaaaaatatgtcacggatctctccgacaatttctcatgctttggctttcgcatcgaccatcagaaaatgtccgactgggaggctgaattttcaaagctcacgagatctctgatctcaactggtgataaaaaggcacccggatacgagctttcgattgtctctatcctctcatctctctggaggcttttttgccttcacggcgctgttgtccagaatcctgacaaacaactgaatgccaaaaattacagccggatccgaagcatcatctcatttatagaaacaaattatcaggaagatatttcactcgaggatattgcctcgtctgtaggtctctccagaagtgagtgctcccggaccttcaaggccggaatgaacgtcacgcttttctcatttctacaggagtatcgtataaaaaaatcgctgccgtatcttaccgataccgacagctcgatttcagagatcgccgacctcgtagggatcggcgactccaactatttttcaaaagtcttctcccgagtcatgggtatgtccccgcgggactaccgcaaaaaaacagccggcctctgacatcagaagccggctttttatatcagtcctcaacgtgcagaaaatatgcacaatgcggctccatcacgagtccgccgccgaagtcgtgccactcaccagtgatcaggtccctggcgcgtccggcctgcgcatcgaaatgggcatggtactcgttgtcttcgagattgatcgcaaccataactctgtcaccgtcgcagttcctctcaaagatgcagtgcatattttcaagaagtctcatagagaaatctccgaagcagagagccttcgactccctgtgggccttcgccatggcagagacagtatcgcagagtccgttccactcaggcttatcgagagctgggcggagtgccgggtcaccactgttcttgtcgccctcaatcccccactcagagccatagtagactaccggtattcccggctgggcgaagacgaacgcgtatgcaatcggcagatttctcctgtcgtttaatatcgtcgcgatccttgtcacatcgtgattgtcgacaaatgacagcagatgctttccagtgtagaggcaccactgctcttttccaaactgtcttaaaagcgaatggcagatctcaaataaattaccggagttgattgcagaatagatgcccttgcggcactcgtagtttgtagccgagtggcacatctcaggattcatgatgtcgttgtaattcccgccgatcatctcaccggcgaggaagaagtccttcttccatgccgcggtctctctgcgaagcctctttaaaaattcccggtcgaccatgtaggcgacgtctaagcgcaggccatcgatcccgaattcatctatccaatattttacagattccatcaggtagtcggtcacagcagggttcttaaggttcagctttacaaggtcataggcgccttcccagccctcataccagaaaccgtcgttgtaattcgaattgccgtcgaagctgatattaaaccagtccttgtaaggtgagtcccattttttctcctgaacatccttaaaaccgaagaagccgcgcccgacgtggttgaagacaccgtcgaggatgactctgatgccggcatcgtgaagagccgagataacttccttcagatcgtcattcgtgccgaggcgggtgtcgactttgcggtaatcacgggtgttgtagccgtgggtgtcgctctcgaaaagcggtgaaaaatacacggcatttacattcagtttctgaaggtgcgggatccagtcgagcactttgagaatcctgtgctctaagatgccgtcattttcaaacggcgcaccgcacataccaagcggatagatctggtaaaaaaccgctgattcccaccatgggtgttcattaaaaatattttccatagctgttctcctttctcctgcttgtatttaaggtactatagctttgcgagcagaccggtgctctgcaaaaagagcatgatcatgatcacagggcagacaaactttaccattatgatatagagctgctttctgtggaagcggactccgctcgactccacctctccaatgatccactgcggacggactatccagcctataaggatagtagacaaaaacgagatgaacggcatcatgaatgagttcgacacatagtccatcaggtcaagaagctgtcccacagttccgttcggaagaggtatcttacagtagaagacgctgtagccgagtgagatgatgacagatgcgatcgtgtaaatgataccgagcacgagagtcgtcttgtgcctgtcggtatggaagacttccatgcagttcgcagtgatggcctcgagcaccgagatgcaggaggtaagcgtcgcgaagacagccataatgaaaaatgcagctccgactacatttccaaagactcccatagaagcgaagaccttaggcagcgagataaacatcagtccaggtccggcgttcatacctgaaagtcctgagaatacatagatagccgggatgatagccatacccgcaagcagagcgaccccggtatcgaagatctctatctggcttatcgatttgttcaggtcgacgtccttctttacgtatgagccataggtgatcatgattcccatcgagaccgacagcgagaagaaaagctggctcatcgcatcgagaaggaccgccatgaatttctttacagtaagtccttttacatccggagtgatgtagaccataaatccctgaagaccatttctgtcgccatgatgtataaagagtgaatatacagcgacgaaaatgataagcactagcagaatcggcatcataaatctcgagcagctctcgattcccttttccactccacggtaaatgatgaccgctgtgaccaccataaaaataaccgcatatacagaagactgtacagggtcagaaataaatgaggtaaagtatccgtccttcgccgctgcgcctccctctccggtaagatacgccaccatatacttagcgatccatccgcctatgacagcgtagtatgtcatgattatgaccggtacgaaaaatgtcagcactccgagaaacttccacttcggattcatctcggtgtaggctccgatcgcactctttccggtctttcttcctatggtgatatctgaggtaagaagcgtaaaaccaaaggtcacgacgaggatcaggtagattatgataaaaagtcctccgccgtcctttgctgccagatacgggaacctccagagatttcctactccgaccgcagatccagctgccgcaagcacaaatccgagctgaccggtaaacgagcctcttttaggtttattttccatagtttccgttttcctttctttgtttgggtcgtattatagcatacttctcctatttttccaaaaaaacaagagccggggcatatagccccggcccgaagttagtcatatattattcgatcagtcttctgaaggaacttcttcgatcagatcgagtgaatgctcttcgttcatcttattgcacatagcaacgaaggtatcgagaggtacattgttgagctgcttgttgcttccgcggagattgatggaaactgtacggttctccttctccttgtctccaagaacgaggatgtaaggatccttgaagttcttgaaattcttgatcttgttcttcatgttggcctcagagtagtcggtctcaacacgaacatggttctttcttaaaagcttctcaacttctctggcgtagtcgttgtgctcttctctgatcggaacgatgcctacctgatacggagagagccagaacgggaagcttcccttgaagttctcgatcaggattccgatgaaacgctccatagaaccgaagatagctctgtggatcatgacaggtctcttctgagaagaatcagcagctgtgtacttcatatcgaagttcagagggagctggaagtcgagctggatagtacccatctgccactcacggccaagagcatccttcattttaaggtcgatcttcgggccatagaaagctccgtcgccttcgttgatctcgtagtttccagggccgtaagtcttgtcgaggatatcctttaagtcagcctcggcctggttccaaacctcgatatctcccatgtagtcatcaggtcttgtggagagctcagccttgtaagtgagtccgaatgtaccatagatctcggtagcgatctccatgatatccttgatctcctctccgatctggtcctcagtaacgaggatatgagcatcatcctgtctgaacatctgaacacggaaaagaccgttcagctcgcctgacttctcttttctgtggatgacatcgacctggttgatacgcagaggaagatctctgtatgaacgtgatttgttcatgtagaccttgatcgcattcgggcagttcataggctttaatgcgtatgtatcggcatctgtctcaccctcgaggacaaacattccgtcctgataatgagcccagtgtcctgaagtaacccagagttccttctttgaaaggacaggtcctgagatctcatgatatccgtgctcctcgtggattcctctccagaaatcgagcagtgcgttgaagaccttccagcctctcggaagccagtaaggcataccaggagcagtctcatcgaacatgaacagctcgagctgaggtccgatcttcttgtggtccctctctttggcttcttttataagagccttgtgctctttgagctgcttcttgtcagggaatgcatatgcataaatacgggtaagtgaatcgttgtgctcatcacctctccagtaagcacctgaaacgcttctgatctcaaatgcggcgctcataagctcctgagaattgtcaacgtgaggtccgcggcagaggtcaacatagtcatcacctgtccagtatatcgtgatcttctcaccctctggaaggtccttgataagctctgtcttatacttctgatctttgaaaaggtcaagtgcctcctgctttgagacttccttaacagtccagtcctcacggcgcttgatgatctcacgcatcttatcttcgatcttcttgaaatcagactcctgaacgctcactccgtcaggaagcttgaagtcatagtagaagccatcggcgatctgaggtccgatagcgtactgtacgtcttttccgtacagctcgatgactgcctttgcgagaatgtgtgccagtgaatgacgatacacttccagatacttttccttgtccataatgttcctttctttggcacaagactaccggtcctgcgcctgcacaaaccgtgtgatggcataaaaaaagcgccactcacacaacaacaaaagcctgtgcgagggacgtaaatgaatacgcggttccaccctgcttgccggtataaaaaccagccacttaattagactgtaacggagtcgccgtacccgattaagggtcactcggagatggtcttcacgacagatctgacaggacacttccatccacgtgtgcccctctctgtgacagcggtttatcgctactcttctcgtcaacgttttaatattttttacgttgctaatcttagacctattttttgcgaatgtaaagtccttttctgatgttttgaaaaaaatccattttaaagttttttgacgtaagctgaattattttgactattttttcatcatattctgtgatatactaaaaatatctcgtgaatatttgattgccggtgtctcattccagacttttggccgttggccacagatctccagtcaccggtgtatccaagtttttttctattttacgggtgtttttttattaaaaaattatactctgacccggattcttgaaaaaattcattattttcgggtgttcgcacggaaatattcctttaaaaacacccggaaaatgatgtttttttagaaaaacagggtcatcagccatccagatataacaaagtgataaggaaggggcagctcatgaaaggttttaatctacagacccctgagattcaggagcagattaggattatcgaaaaagaatacaatgcgaacagagctgacgtgaagagacggctggcgcagctgatggataacgcaggcaaaagcggtaattcactgcttttggggtttactcatgcctattttgccaggatatactatgtcgaaggcgacatgaagaaatttttaagtcatgtccgtgcaggtataaggcttaccgaaataaatgaggacaaggattccgcttcgatctgctataatcttcttggtgtcgacgcaatgaaccatggggaatatcctattgcgctggagtactacgaggaagccttaaatgctgccagctcggagagttccgtctatggtgctgcccttgtaaacaccggccacatctactatgaaatcggtgaaatcgacaaggctctctattactgtaaacagggcagaaaatatctggaaaaatcagacaatccttttcccctccttattgagcttgcacaggaagccacctatagtatctggtcaaaaagactgggcatggcccggggtataattgccgagttaaaagttatagaggagcagcttcaaagcagatatccggatgaaacctttactgatctgagtgaagttctgatttactactatgacacaatgcagcagtccgaaaaacgtgacgcagcttttttggattttgccgatgccctttccaattacgacggttcctatatcgacttcgcggaaaatatcaactggatcacagataccctgatgaattccggaaaaacaaacttcgttggaagattattgaacatcacaagaaaatccattatgaaatccgggattccccatatccagctgcagtttttggaacgcgacataaagtatcaacttcggataaaaaatcatgacgaggtgcacaagctcgaatcgaaatatttcagagtcagctgcctgcgtaatcgtgagaacctgcgtatctataaaacaaatataagcatccataacgatatgaaccatctccgtgaagagacagcccgcatcgaggaggagaaccgccggcttctgcgtgaggcttcgatcgatcctctgacacagattccgaacagagctcttcttaatgaaaaggccgagtattatttttcgatggctgatcagaatcaggtctcactgggtgtcgagatgcttgacattgattttttcaaggagttaaatgatacctacggacaccagcagggtgaccactgtcttcagctggttgcgagcattctgaaggacatctcgtgtgatcgtattttttcagcgaggtacggcggcgacgaattcatgatcatctactatgacatgacggacgctgacattctgaaaaaagccgagcacatccgtgaacgtatcaatcagatgaagatcccgaacatcaactcggaaacgtctgatttccttacaatttctcagggcatcagaaactccgtcccaagagacagcaaccgtgtctgggactacacctacggtgccgacaacgccctctacaaagtaaagaagactaaaaagggcggcatcctcttaatccacaacgccgtaatcgacagatcggtgcttgagaatgactcgataaacgactgattattaaggaggttttcatgatatattcaggcatttcgcattacgctgaccagcgtgatgcttttttcctcgaggatggcagactgcgcataagaatcgccaccagccgtggtgatatgagtgccatatatctgcacacacaggacaagtacataggtcttgaccgcgctgacaccagagcctgctacaaaatgcaccgctatgccagcgacttcggacacgactatttttctgcggatatagatattccaatggcagggcagtttaaaaaaaatcctgatatgctctgcctccggtattttttcgagatggttgatgaggcaggagcccgcatctggtacggtgattcgagatttttctcaggtgagccgggtgatgtcgaggcgatgtacgactgcccgcttatctcccgccgcgagcagaccttccacgtacctgactgggccaaaaatgctgtcgtctatcagatttttccaaccagatttgctacaactgaaaaggttcctgacaagctctggtacaaggcaccgattgactgggatgatgacttaaaaggaaatctccagggcatcatagagcacctgccttacttaaaggaactgggtgtggatgtcatctacatgacgcctattttccgctcgaatacctcgcacaagtacgataccatcgactactactctgtcgacccgtcactcggtgatcaggatgacctgcacgagcttgtcgacaaggctcacgccgcaggtatgagggtaatgctcgacggtgttttcaaccacacatcacctgacttctttgcatttaaggatgtacagaaaaatggcaaagcgtcaaagtattataactggtactacctcgacagcgacgatatctctttcggaagtgaaacgtcaaagccttcgttccagagctttgcgtatgtcggttttatgccgaagcttaatctctcgaatcctgagactgcttcatatgtgattgatatcgcctgccactatataaaggattttggaatcgacggctggaggctcgatgtggccgatgagatcggtcactctttctggaaaaaattccgcagggccgtaaaagccgtaaatcatgacgctcttctcgtcggtgaaatctggcatttttctccggatttccttcagggcgacgagtgggattctgtaatgaactacgctttctataaaaatatcgcctccatgctctgcgacggaaatctgtctccatccggtttcctgtctcagcagggtttcctgaacggtcagtatcacagtgctgtccttcctgtcatgtggaatcttattgacagtcatgacaccagccgtttcctctggagagccggtggcgacaagagaaaacttgctcttgctgctgctttccagatgcttactcctggcacaccgtttatctactacggtgatgagattgctatgaccggcggtgatgatccggacaacaggcgcggaatgctttgggataaggacctgcaggatatggatatgtaccactggtaccagcgtctcacattcttccgccacacaataaacgctcttaccgccggcagctactcgagtgttaatgctgacgatgacaagtgcctgcttgagtaccacttaagttccggcgaggttctgattttccacactgccgacggcgagacaaacgctctggaatacaaaggatacaaggaactgctctccgatgaaaccttcgacggcacgattccgggatacgggtgcgtactgctgaggaaggcgtgaggcagctgtacgtaagaattccagttgactgacatacagaaacaggatttgctggaatatgtatgtaattacccaaaataataaagaaaagaggaagaaaaatgtactacggtttaaatggtttttgggactacacctacatcctggtaattattggcgcagccatctgtctgcttgcgtcggcacacgtcaggaagcatagctgcaattgcggtagccgcgcatgagtgtggacacgcaatgcaggataaggaaggatacgcggcgttaagacttcgaacaggcatggttccggtagtaaacttcggctctacgatttcatggccgcttatcatcatcggacttttcataaacagccacactggatatatcatgatccaggccggaatcatctgcttttcacttgctgtgctgtttcagctggttacactgcccgttgaattcaacgcttcacacagagcacttgtagcactaaaggcatacaatatcgttgatccagaagagttaaaaatggcccgtaaagtacttgttgccgctgccctgacatatgtagcaggtgccgcctcatcaatccttcagcttctcaggctgctgcttttatttggcggcagagacgacaactgaaaaatatacgtgatgaactggaacaatgagcgtaacttatgaccctaataaaaaggaggcttttatggacattaaaaaaattgttgttgccggcggaggcgtacttggaagtcagattgcttttcagtgtgcatactgtggatttgatgtgactatatggctcaggagccagggaagcataggacgcacccagccaaagcttgacaaagtacatgccgcttatattgacgctatcgatgggatggctgacggcaccggagcctggtgcgcgggaatcgcaaattcggacgattttgacaaagatgcctgcctgaagaaggttgaggacgcttacaacggcataaagctcgagctcgatatgaaaaaagccgtaagcgacgccgacatagtcatcgagtcgatggcagagaatgagactgcaaaaattgatttttacaagaaaattgcaccacttcttcctgagaagacaatcctcgtcacgaactcttcgaccctgcttccaagcactttcgcgaagtacacagaaagaccagaaaaataccttgcgcttcattttgcgaattcaatctggaaaaacaacactgctgaagtcatgtcttcagggcagacaggcagaaagtattttgacaaagtaataagctttgcgaacgacattcgaatgatcgcactccctgttgaaaaagaaaagagcggctatctgctgaactcgatgcttgtacctttcctgctctcgggactcgatctctacgcaaacggagtctccgatccgaagagcatagacctggcatggaagcacggcaccggctcaccgaaaggacctttcgaggttctcgacaccgtaggtctcaccaccgcgatgaacatagtcgaacagtaccagaaggtaccgggacttttaactcctgtcctccgcaagatgatgctgccgtataacttcaaaggtatgaaggccatcctccagaaatacatcgacgagggaaagctcggcatggcaagcggtgaaggcttttacaagtggaactgagacttctttacgtaccgtttttagatcgccactttttggtacgtaataatcgggccaggattacggactaagaagtgattctataaatgagtccgtaaattaccgtcagagcccagtccataaaatcaaaaagtacccagaaaggaacccaaaatgacactacttgacagatttttaaaatacataagcgtctggacgacttcagacgaggactctgacactgtacccagcacggcaagacagctcgagctggcgaagattctggaaagcgaactccgcgaagcaggaattgatgatgtaagcactgaatcaggctatgtctacgctcatctccctgccactgaggagtttaatggacacaaatccgtcgccttcatctcgcatatggacacagctccagacttcaacggcaaagacgtgcacccgcagataatagaaaactacgacggaaacgatgtaatacttaagggaagcggagccactctttcagtcaaagatttcccagagcttaaaactcttaaaggccgcaccctaatcacgactgacggtacctcacttctgggtgcagatgacaaggcaggcgacgcggagataatgactgccgtatcggaaatcattgcagaaaaagcaccacatggcgacatctacatagttttcacacctgacgaggagataggaaaaggccctgatcaattttcctttgaaaaatgccgcgcagactacggttttacagtagacggagattacgagggtgaggtagtctatgagaacttcaatgccgcaggcgcgcatcttatttttacaggaaaaaatgtccacccgggcgaagcaaaggatataatgaaaaacgctgcctccattgcctgcgagttccagagcctgctgcctgaggctgaaacgcctgagcacaccgagggcagagagggcttctatcatctgaccgatatgagtgggaactgcgagcacgcagagctaagctacataatccgtgaccatgacgcagattcgtttgagaacagaaagcgatttatgaaagatgcagcttctctcttaaaccataaatacggcgaaggaaccgtaaatcttcagataacagaccaatatcagaatatgatctcaattatgaaagaccactctgatgtaatagatatagcacgcgaagcaatccgctccgtaggccttacccctatcagccgcccggtcagaggcggaacagatggtgcgcagctctcattcaaaggcctgccatgcccgaatttaggtacaggcggctacggattccacggaccattcgagcactgcaccgtagatggcatgcagacagaggtaaaaatcatcaaatatctgatgacacatcctctttccagataaagagtccgtcctgctcatcatggcttaaaatggatgttgcttcaggagcaggaagccttggaaagcagcaattgcgatagctttctatatgcttctcatctcactagcggttgagactgatacgagctctctgcccggcgcatggtcgttatcgcatttatatctgttttggcggcagcgattgtggaaagctatctcatttaaaaaataaaagcaggtccaccctcaccccttcctcaggtgaaaaatggacctgtttttttcgtttatcctgaatcaggctttagccttttttcttaatttcttttccttctcaagtatcggctggaatcggtcgacctcctgcttgatctcctttgacatgacgagcaggcagataaggttagggacagccatcagagcattcatgatatctgagatgttccatacgaggtcgagagcctgtgtgcagcctacgtatacgataagtgagaaaattattctgtaggccatgatcgcaggtctgttgttctttaccaggtattcgaaggccttctcaccgtgatactcccaaccgaggattgtcgagaaagcaaacagaatgatgccgatagaaacgagatattttccgacagggccaagtgccgactcaaatgccgcaatcgtgatgtcgacgccctgaagcggcttaccatcagctccgacagttccaaggactcctgatgaagcaatagcgatacctgttatagagcatacgataatagtatcaaagaaggtaccagtcatattgatgtatccctgtcttacgcagtcatctgtagtagcagctgatgcagtgatagcagctgaaccaagtcctgcctcatttgagaagcatcctctcgcgacaccgtaccgcatcgcgttcatgactgaaacagttattgttccgatgattccgccaccgacagccttaggattaaatgccataacaaaaatctgataaagaccagccggaacatttctccagtttacgatgattactatgaggcctgctactacataaaaaacagccatagaaggtactacaacagtcgatatttttgaaatactcttgataccaccgactacgataagaagtgtaaatatcgtcattatgattccagtcacatagagaggtacatgaaatgaggccttaagagatcctgaaatcgagtttgcctgtgagaggtttccgattccaaatgaagcgattacggcgaaaagtgcgaacaggaagccaagaatgcggccggctgttttatttttgaagccgttcttcatcgtatacataggaccgccggacatctcgccctgctcgttgacctcacggtatttgatagagagcatgcactcggagaacttcgtggtcagaccgaagcaggctgaaatccacatccataccaatgctccaggaccaccggagaacattgcagtagcgacacctacgatatttccggttccaatggtggctgcaagcgctgtcatcagcgctgagaacggcgatacatcaccggttccacggttttttgtccttgcctccttgctgagtaccgagtgaagcgcatagcctaagtttctccaggaccgaaatccggtcctaaacgtcaggaaaactccggtcccgactaagaggaccagcatcaccggcccccacacaaatgagtcgattgagctgactatactgtttaacaaatgcataattttgctcccttcatttcactttttcagtctgatccgaatcagcccctaaaaaacaaaaaaagaccatggcaaatgacaccatcgtccttcaaatatcgtttatttttataagctgaatgaatctatgtaaaatctttattaagtagatattttaagcatttaggatttgattgtcaatgagaaatatcctaagggggtgcggaccaaaaatctgacaaccagaaatggcttatttgcaacaaaaaagaggcccgaaggtctctaaaaaatatctataactcgttaactaccgtatttaggtatcaaactcccgtctcaataattatttaataaaaaatttattatttttaatcccgctctgcaggcgggcagaagcagtttattaagtctttctaatttttgattttattagtagaaatatgttatactgatgatgaataattatagatagtttcagtaaaggaaagaaaaagcgaaaggaaagacatgacactactagaccgtttttttaaatatgtctcagtgtggactacatcagaagaaggcgccaaagagacaccgagtacgaagaggcagctcgacctcgccgctgttttagagaaggagcttaaagagatcggtgttccggaagtcagcacagagaagggatatgtttatggacatctgccggcctcacctgaattcgcaggaaaaaaggccgtcgcatttatctcgcatatggatactgccccggatttcaacgggcagaacgtacatccgcaggttttcgagaattacgacggaaaagatatattgcttaagggaagcggtgctacgctttccacgaaagatttcccggatcttttagaccttaagggacgcacacttatcactactgacggcacttctctccttggcgcagacgataaggccggagacgccgagatcatgacagctgtatcagagatcatcagcgagaaggtcccacacggagatatttacatcgtatttactccggatgaggagattggcaaaggaccggttcatttttcatttgagaagtgcagggcagactacggctacacagtagacggcgactacgagggcgaagtcgcctatgagaatttcaatgcggcctctgccaaagtcacgatcaagggaaagagcgttcatccgggcgaagcgaaggatattatgaagaatgcagcttctatcgcatgtgaattccagagtcttatgccacaggcagagtcaccggaacacacggagaagcgcgaaggtttttattacttaacggatattaagggcagttgcgaaaaggcagagctcgattatatcatacgcgaccatgacagcgagtcatttaaagcgagaaagaagtttatgacttctgctgccgatttgatgaatcagagatacggggaagggaccgcagatctgactatcacagatgagtaccagaacatgatcgaggtaatgaaagatcacgaagacgtaatcgaagcagccagggaagctatccgctcgataggacttgagcctttaagcaggccggtcaggggcgggacagatggcgcccagctttcattcaaagggcttccatgtccgaatttagggaccggtggatatggcttccatgggccatttgagcactgcactctcgaaggtatgcaggacgaagtcaggattataaagtacctgatgaggaatccgctatgatatttttttgggaggttggctatatgtataagtggtcatttgatttcgaagtaatttcacttttaatgactgtacttctcctgattgacatcaaagcatcaaaactgctcccatcgaaaagcacacgactgtttctgcacactatagggactcagatcgcccttatagcatcagactttattgcctcgcttcttgataattatgcgaagggaaagtttattggatttcagatctttataaacaccgtttattttgctctgatatttttcttcatggcatccctgcatattttcctgagattcttctccttcgaaaaaagaagactgtttttcaagctgaagccatacgatttcattccctgcgctatagccaatgtttttcttattgccaacctcttcacaaacgttgtctttaaaatcgatagcgcaggattcttccgtggccggttgtattactatatcatatacccttatatgattgtcgagcttgccatctgtgcgataactatcgcaaggggcaggaactacatcattggaaaagtaagagcaggtatctatctttcgcttgcaatgataacctgtgtctcagcttaccaggtttatttcaaacctggcaggcttatcatgaacctcggattttcttccggtctcgtgatcatgtacgtggtatttgtaagcactgaggacaacaaagagaccaagacctctacattcaatccgaatggcttctacaaatacatgagagagcggattatgtcaggcagtccgttcaaggtatttttcatcaagatccagaattacagctctgttctggccacctacggcagagaaaatacagacgaacttttacgacagatcggagtcgatctgaagaaaaaagagcagaggaccttctatctccacgcaggactttttgcaatagttccggagaatcagagttattatatgattgacgaggtcctcgtaaatgatgtaacatctaaggagcgctcacttgacgatgctcaggtggatctctcttaccgcatcgtgacctgtgatgaatccgccaggttttacagcccgcaggagatgctcgagtctgtctccgatgcagtcgatgatccgaaatgtgataagccacaattctcccctatatcttctgatgacatcgcaaagaccatcaggaaatcagagttctataagagtattttcaatgcacttgaaaacggcggagtccgtgtgtactatcagccaatcttcgataactcgctcggtcgtataagttcagctgaagccctcgtccgtatctacgacaaaaaactcgggcttatcttcccggaccagtttatcccgctctttgaaaaaaatggtgcgatccttaagatggggcttatcgtttttgcgaaagtctgcagctttataagagacaacgatatggctgcactagggcttaattagtgtctgctgattagcaaaaaatctttaaaaattgcctaaaatacgcgatttctggctcaatatagggtataatagatgcatggatttttgatatttcattcatcttttcgtgcagtttctgaataaaattttaccctcggagcattaaaatcgtgtataaagcaaaagatagtcagagtattctttttttgatttcatcagccgctcgggatgcacatgaacccggaaaaccgctggatcaggctggcagactcattccatgggatgaatacgaagaaaagtatgcttcccgtttcaagagtgatacaggaaatgtcgcaaagccatgcatggctctcggagcactgatgatcaaaacgtttaggcttctctgacagagagcttgtagagagatcacagagaaacccgtatctccattatttcatagggctcccgggattcaggagacgccgccgtttgatgcagcacacttgtagctttcagaaagcgcatagatctcgacatgagtcagttcatgaatgacatcctgcttgaagaaaataaagcgaagcaggattcagagaacaaagacccgcatgataaacgacaacggaagctccgaggctctgctgcagtaggaagaaaatctgacaagactgaagtccgaagctgctgataaagatgtaaacagcggaacgctcataatcgtgcgacatgtgcaccctcatacatacgttatccacaggatttttcactgctgaacgaagccagggaaaaacttgaagatatcatcttccgtatctgcggagataacggactttacagaccgcgtacttactgcagggaggcaagaaaggattacctcaaccttgcaaaatgcaagaaacgctcaaagaaaagacaggcgacagtacgcaagcagctgggctatgtgagaccgatctgggctacatcacagatatatatcagacggatatgcacttctgccaaaagaagaaaagcttctagatcgatcagaagctctatgagcagcagaaatacatgtatgacacaagacgcataaagtagccgacaggatcgtaagcatcgcacgccgtatatcagacctatagtgagaggcaagacgaaatctcccgtggaattcggtatcaattcgacctcagtatcgatgaggaccacatgggaaggatcgaaaagatactttgaccatacaatgaatccgaagtccttaagagagccgtgaatcatacaaaacacggacaggacattatccggagcgtgtcttgcagatcagatctacagaacaagagaaaacagaaagttctgcaaagaaaacggcataaggctctcagggccaaagctcggaagaccgtcaaaggaactcagtgctgaagaaaagcacattgaatataaagacaatacagacaggatcgaagtggaaagagcttcagcctcagcaagagatgctacggtctggactctaaaaacaaagcttgaagaaacatcatacgctctgtaggctttccatctttgtgacgaacctgttcagaatccggggggcatggcgtcctgaacgtatttgtgcttttttcaaggtactgtttttgaccacagatatgcggccgttatatataaatgcggaaattttttccgcggtataacctgctgattgctgaaaatgcggttaatcagcatacactaattacatagaagtaaacctctctcctatccagtgcatgcagccatcactccctgatgacctgatctctatcgcagaaagctacggagttgacttaaaatacatcaattttgaggttactgagaccgctgcgattccgacggagatgctccgccacctgatgacaacccttatcagccacggcgccaccttctcggtcgacgacttcggtaccggatattcgaatattatccgcttggcaaatatgcctttcagcatcataaagatcgacaagtccatcctctggaactacttcaagaccagagatgacctcgtcccgcggatctacgagatgcttaacatcgaaggctacaatctcgtgacggagggcgttgagacagacgaaatgcacctgtggctcagagacgttgcccactgcaaatacgagcagggctacctctactcgaagcctatcgacgaagacaacttcaagaaatatctgtcagagcacaactgccgccctatctcagctcctgtcaaaaagccatctcctgcaggggaatcaatggctgcaatgtaatctatctatcatcaaccgctgaaaagtaatgtatttggaggcacatcgcaaatgaaagaatatagctttacacctcagggaacctgttcatcccagatcgatttctctatcgacgacaacggcaaactccacaatgtcgttttccacggcggatgccctggaaacacaaaggccgtcgccaaactccttgaaggctacgacgcaaaagccgctgtcgatcttctcaaaggcaatccgtgcggcacccgcggcacatcgtgcgccgaccagctcgcgcgaggcgtcgagaaggccctgggtcagtagggacggttggagcggttgttatgctgtcgcgagtccgaaggacgaagcgagagcattataaaccgcccatgcgatagccgtccgcgactgacgagtccgtaggacgaagtcagagcggaaacggcgaaccgctctttttgtcccattttctgacaattcaggctaatatgccagggctgacgtgagaaggcacgccagggcggacacgagggatggcgtgctcagtgcgcgttttcctgttcgtcgcgcgcgcctatttgcggccctccggccaatgtatggtttccatgcatttatggctcaggcgggtggccgcccgggccgcagctagcgcgcttcctcactacggaaaacgctgaattcgcccgccatcctccgtgtctgcactggcttggtttccaatcaagtctacagacacttgacagtcgctcgatgtcctttcgtgtctgcaatggcttggtttccaaacaagtcgacagatacttgacaagtcgctcgatgtccatccgtctctgacttggcttggttatcaacatagaaaaatttctgggaggaagttaacagactcatgcctcacttatttcgatcatgggcttatttatcaacatagaaaaatttctggtcaggaagctacaaattttggctttactgatttatcttgttgaagcgaattttcactatgacctattagaatagcaaagtgtaacaaaaaatcgtgaattcaattcacttacagcattcaatacatgaattgaaagtaaattttctgtcacatcctgctaggtagatgtactatattgataaactaatattattttggagaaagacggtggaattttttatcacaaccagctccgcgaaagctctattgtgataaacaagcattaaaataacctaccggcctttttgcttttcgcatcttccggctccgcgacagctctattgtgataaacaaatattaaaataatgagccagctttgaaacttttgtacaatctagttatcatcagaaaggaatctcatgatatattctggcatttcgcattacgccgatcagcgtgatgcttttttcttggacgacggcaagctgcgtgtgcggatcgccaccgcgcgcggcgacatgggtgcggtctatcttcacacccgtgacaaatacattgacccggcgcagcaggatacgagagcatgttataaaatgaagcgctatgcgagcgacttcgggcacgactatttttcagcggacatcgagataccgatggccggacattttcaaaagaatccggatatgctctgcctccggtatttctttgagctcgtggatgaggctggtgccagaatctggctcggcgactcacgatttttcccgggagagccgacagacgtcgaggcgatgtacgattgtccgcttatctcccgtcgcgagatgacgtttcatataccggactgggcgaaaaatgccgtcgtctaccagatttttccgacgcgctacgcgactaccgaaaaagttgatgacagcctctggtacaaggcgccgatagcctgggacgacgacctgcacggcaatctccgcgggatcacggagcacctcgatcatataaagaagctcggcgtggatgtcatatacatgacaccgatttttaaagcgaataccgtgcacaaatatgacacggtcgactattacgcggtcgatccgtcgctcggcgacgaaaatgacctgcacgagcttatcgacaaggcacattcaatgggtatgcgggtcatgctcgacggcgtattcaaccacacatcgccggactttttcgcgtttaaggatataattgccaacggcagaaattcaaaatattacgactggtactatctcgacagcgacgacatttcaatgggcagccggaccgagaagccgtcgtaccagagttttgcatatgtcgggttcatgccgaagcttcgcctgtcaaatccagagactgcgcagtacgtgatcgacgtcggctgccattatatcagggattttggaattgacggctggaggctcgacgtggcagatgagataggacactcattctggaaaaaattccgtaaagccataaaggcaataaatccggatgccctgctcgtcggagagagctggcatttttcaccggattttctgcagggcgacgaatgggattcggtcatgaattacacattttataaaaatatcggtgaaatgatcaacgatggaaatatcacaccgtcaggatttttgtctcagcagggctttatcaaaggcggctaccattctgctgttttgccagtcctttggaatctgatcgacagccacgacacgagccgttttctctggagagcaaatggagacaagcgcaaactcgctctggcagctgcttttcagatgctgacaccaggcacgccttttatctattacggagatgaggtagccatgacaggcggcgacgatccggacaaccgccgcggaatgctctgggacaagtccatgcaggatctcgatatgtaccactggtaccagaggctcacatttttcagacacacgataaatgccctgactgccggcgattacacgagcgtctctgcggacgacgagaagtgtctgctcgaatatcacctgagctcaggcgaagtacttatcttccacacagcagacggcgatgtcacagccaaagaatacaaaggctggaaagagctgctcaccgacaaagaattcgacggaacgataccaggttacggctgtgtactcgtcaggattgaccacaaatgaatgacagaatagaaaagaaaaataacccgttatctgcactactgctgcttgttgcggcggctttatggggctttacttttgcgttccaggatatgggcgcagaccatattgatgctggttccttccttgccatgaggagctggacagcgtgcgtttttctgttctttgtaataaaaatcgccgacaagatcaagatttcaaaggggataccaacaggacagccaactactcacaccatgaggaggcactacctgactggtggactgatatgtggggcttctctgttttttgcttcatttttccagcaggcaggactcgcttatactacgacagcaaaggcaagttttatcacagcactctatgttattatcgtaccgattacctgcgtgttcaggaagcagtttccgaaagctcacgtatggtttgcggtaggtcttggagtcattgggctctacctcctttcattttcaaaaggtcctgatggaatcaatccaggcgatatgatcattatgatcagtgctcttttgtggacggtgcagatcctctgcgtagattatttcaaatatgcgatcgatggcatcagactttcgttttaccagacactgactcaggggctgattgctacagcagtgatgctcgtcaaaggactgcctgccatggaaaatgtgatggcagctcttccagcaattttattcgctggcattttttcaagcgggatagcattcacactccagatcatagcgcagggtgggctcgacccgacttccgcttcccttatcatgtgcctcgaaagtgtctttggagctatcggcggctttctctttcaggggcagacccttaccggacgggagcttgccggctgcgcaataatgtttgccggaatcgtgatctcacagcttcctggccgcgaaaaaacaaagtaaaatcttgagatcatctcatcctttctgattttacatgaattttacactgtcacgatttctgattttacatcggcagtgtaaaatttaagtaatgaaaaagtaaagcaggacaggttcgccttgactgtaaaaagaaaggatatgcagatggacatttttgacgtttttacactcataggaggactgagtctgttcctcttcggcatggaccttatgggcgatgcacttgagaggagcgcaggcgacaagctgaagaacatcatcggaacgcttaccaaaaagaaaatatgataaaaaaatctatttcagtttgttctcgtagactataaacttattttcgtgaagtatttttatatactgaccgagcctttcgtagaggggctcggccttttctccgaattcatcttttacgagctgcccgatctggtagacagtagtcctgccatctagcttctgccagacgaaggagccgaattcatcgagctctatgtctgagaagcgcgggcgcttgaaaacagtctgggcaatttttgcatagaaacccttgtgctcgactcttatgagcacatggccgttgtcacctactctccattcatagaggcggttcggccggggtgtgtagtctaagagattatcttttttagcggacatcacttatttcccttttttcatggtctggtggaaaagagaccaggcgagaagtgcaaacaggatcagagaaccgatgcttccaaggctgaaggatgaagagacgtctacgtttacctttgtggcagcaagcgctgcgagaaggataccgacgagaccttctcccgcgataagacctgaagaatagaggattccacggttgtttgcggcctttctctcctcctcagtcagacccttcttcttatctactgcaaggcggatcagaccaccgaccatcataggaattgagatatagacaggcaggtagaggccaactgcaaacggcatgaccggaatacccattatctcgactactacaccgatgaacactcctgcaaaaataagtgcccacgggagatttccattcataacgccctcaacgaccatcttcataagctcagcctgaggtgccggaaggtccttgcttccatatcccaaaccgctgtttaagaggtagagggtcccgccgatggcaactgaggaagtaagcacacctactatctcaccgatctgctgcttataaggagtagcgccgacgatataaccagtctttaaatcctgcgaagtatcacctgcgatagcagacgcaatgcagatgatagaagcaataacgatagctcctgtcatgcccttgatcccgacatttccggcagcctttaaggcagctgtaacgatcaggagtgtagcgatcgtcatacctgaaacagggttatttgaggaacctacgataccaaccatgcgggcagatactgtaacaaagaaaaatgcaaatattactataaggagtgttccgccgataccaaccgggaacgtaggaacaatgcagatcagaagcgcgataactatgattccaaggatcaggaatttagccggcagatccttatttgttcttacagattcgccgacctttgagccgtaccctttcattgaaccggagaaagcattgatcatcgtaggaagcgacttgacaaggcttatgattccgccgcaggcaactgcgccggcaccgatgtacttgatatacgaagaccagatagttgcagcgcccatagatgagatcggagcagatgcagggtaaatggtcatttttccaccaaatacatagataagcggcatcagaacgagccatcctaagataccaccggtaagcatataagaagagatctgcggtccgcagatatagccgacaccaagaagcgaaggaagggtatccattccgataccagcccccttgtagctcttgaaatcataagtgatctcagatggaaaaatcttaagtccatctgtaaggaatttaaaaacagcggcgattccaagacctgagaaaactgtcttggcacttgctccgccctcttcacctgcttcgagaacctctgcacaggctgtaccctccggatacggcagtgttccgtgctcctgaacgataagcgcatttctcagcggaaccatgaaaagcacaccgaggacaccaccgaccatacagataagagcgataagtccaaatgaagggtaggccgtctttccatcgtttgcccacataaacatagctggcagtgtaaaaatagcgcctgctgctactgactcaccggctgatccgatggtctgaaccatattgttctcaaggatggaatctctgtgcaggataacacggataagtcccatcgaaataacggctgcaggaatcgatgccgagattgtcataccgatcttcagacccaggtacgcgttcgccgcaccgaataagattgccagcaggatacctactattaccgaaaacggcgacagctcccgcatcgttgtgtctgcagacacaaatggtttgaattcttttgtttcgttactcatttctttacctttctttcctttattccccaagcccccaccaaatggcagactttaagggccgcttcccgcagctgtaaagtaatccacggaaagcagcccttctattataaatgtgatattttcgggtgtcaactagaattaatgcaggctgttgcacgtcaaaagccaacattatgaagcggccatcagcttatggctcactcaatgcgcgttttcctgttcgtcgcacgactatttgcggctacttttcaggcatatccattaaccctgcatcagctcatcacctggcttatatgatttaagccttctcataaattcatctttcggtactttatacttgctcaaagccctgcttgcagcgacatctacagacagtgttccgtcgtatgccagtccaagaagctcatcgatcttcccctctgttctgccttcttctcttccttcttctctccctatacattgtcaagcattttttgcctgaaaaataaaggttttcattgttcctcaaaataaagaatgagtcaaatattgtgagcatttctgtgtatctggtacaaaatatccctgaataggctattttcgtaccagatacacagaaatgctcacaatatttgactcattctttattttgaggaacaatgaaaacctttatttttcaggcaaaaagtgcttgacaatgtagggaggttttcactatggcttatttaccaggatttttcggagagaatttattagacgactttatggacagtgttgatcagttttggaatggcccatcagtccgcagcgcaagcaatgccgcttatggccttatgagaacagatattaaggagaacggtaataactacgagctgtcagttgagctccctggattcgataagagcgatatctcagttgagcttaaagacggctatctgaacctttccgctaagcattctgagaacaaggaagacaaggacaacgaaggcaaggttcttcgtcaggagagatacagcggaagcgtcgcccgttccttctatgttggcgaggacttaaagcaggaagatgtccatgcgaagtatgacaatggtatccttgagctcacattcccgaagcaggaagctcgcgagaagctgccggagagccatatcatagagatccagtaagctgattttatattttttataatcaggggcgcggcacttttctgccgtgccccttcgtatccttttatagagaggaggcataaccgtgaatatacagaaatttacccagaaaagtatggaggccattcaggacgccgggaaactcgcgtctgactatggcaaccaggagataacccaggagcatcttctgctggctcttttgcagcaggaaaacgggcttatcccaaagcttttccagaagatggatatagatgtgggctattttacaaatgatgcgacgatgatggtccagaacctgccaaaggtgtcaggcgcgggacagaattacgtcggaaaaggtttgaacgatgtcctgatccacgccgaggatgaggcgaagaagatgggcgacgactatgtttcagtcgagcacattttcctgtctatgatcagatttgcgacaggatcagttaaagataaattcagagagtttggaatcacccgcgagagattcctcgaagctctttcgactgtcagagggaatcagaaggttacgactgataaccctgaggatacttatgactcccttgagaaatatggcgaggaccttgtgaagaaggccagagaccagaagctcgatcctatcatcggacgtgatgacgagatcagaaatgtgatcaggatcctctcccgtaagacgaagaacaatcctgtacttatcggccagcctggtgtcggcaagaccgcagtcgtagaaggtctcgcacagcgtattgtgaagggcgatgtgccggataacctgaaggataagaccattttttcactggatatgggtgatcttatcgccggtgcgaagtacagaggcgagttcgaagagagacttaaggcagtgctgaacgaggttaagaagtccgagggcaggataatcctcttcatcgatgagctgcaccttatagtcggagctggaaagacagaaggctcgatggatgccggaaaccttttaaagcctatgcttgcgagaggcgaactgcactgcatcggtgccactactttgaacgagtaccgtgagtacatagagaaggatgccgctctcgagcgtcgtttccagagggtccttgtggatgagccttcagtggatgagactattactatactccgtggcctgcgtgagaattaccagacttaccatggcgtccgcatcactgataacgcgcttatagcagccgcagagctttcaaacaggtatattacagacaggttcctccctgacaaggcgattgaccttattgatgaggcctgcgcccagatcaagactgagaagaactcgaagcctgaagagatagatgaacttgaacaccgtaacattcagctgaagcttgacgagatgtccctcgagaaggagacagatgacatgtcgaagcagcgtcttgaggatgtaaagaaagagctcgctgagaacaacgaaaagctcgactccttgaatgctgaatgggagaacgagaagaatgctgtcgaccgtcctgccaaactccgtgagcagatcgcgaatctccacaaacagatggagctggctgagcgccagggcgactatacgaagatggctgagatccagaacggcagactccctgagcttacgaaggagctgaatactgaagaggccaaggtcaaggatgacaatttaaagcttgtacacgaggcagtggatgaggacgagatcgccgagatagtaagccgctggacaggtattcctgtaacgaggctgaatgagtcgcagcgtgagaagatccttcacctcgacgataagctgcatcagagagtcatcggacaggatgaggcagttgagaaagtctgcgatgcaatcttaagaagccgtgcaggcataaaggatccgaacaggccgattggttcgttcctcttccttggacctacaggtgtcggcaagaccgagcttgccaagactctggcagaggcgcttttcgacaacgagaacaatattgtccgtatcgatatgaccgagtacatggagaaatactcagtctcccgtcttatcggagcgcctcctggatatgtgggctatgatgaaggtggccagctgactgaggctgtcaggagaaaaccgtattcagttgtacttttcgatgaggtcgagaaggcacatcctgatgtgttcaatattctgcttcaggtacttgatgacggccgtatcactgattcgcagggcaggaccgtggacttcaagaacacgatcatcataatgacttcgaacctcggctctcaggaacttttgaacggaatcaatgccgatggaagcatttcggacagtgcgagggcatctgtcgaggcagacttgaagaaacagttcagaccagagttcttgaacagactcgacgagatagtcatgttccatccgcttactaaggacgatatcgggcacattgtaggacttcttatgagaagactgaacaagagactctctgagagagaattcaaggtcgagctgactcctgaagccaggagctatatcatcgaccgcggattcgacccggtttatggcgcgcgtccactcagacgattcctgcagaagcatgttgagacgcttgccgcgcggataatcctcgagggaaaagtcaacaagggcgataccatcgtcatcgacaagaaggcaccgaccaagccggctgtgccgaaggacccgaatggcgacgacctctttaccgaagacggccatgtcgagaacaacctcgattcgctgatgggcggagcggctattgaagatctctacgcctatgtcaaacgatgacatttaatggatagaagaaagcctcccattctgctatactgttagcagatgggaggctttttttatgtatatagcaagtgacaaacgatatgaaaaaatgaaatataaccgggtcggaaggagcggcctgaaatttccagctgtctcgctcggtttctggcacaacttcggcaataatggcagttacgaaaatatgcggcagatgatgcggactgcttttgacctcggtatcacccagtttgacctggcaaataactatgggccggattatggtcaggctgagaaaaatgccggcagaattctgcatgaggacttcatgccttacagggatgagcttgtgatcacgtcgaaagccggatacgatatgtggcccggcccatatggaaactggggcagcaggaagtaccttatcgcaagctgcgaccagtctctgaaaaggctggggcaggactatgtcgatatcttttatcatcacaggccggaccctgacacgccgctcgaggagacaatggaggcgctgcttcagatcgtgcgaagcggaaaggctctctacgctggaatttctaattacaacgccgagcagacgacggctgcagtaaagatcgcgaaaaagatccacctgccgcttatagtcaaccagaggcgctattctatttttgacagaaaaatagaacgggaaaacctgaaaagcacggctgaaaaaatgggcatcgggatcattgccttcagcccgctggcacagggacttctgactgacaggtatataaacgggattcaaccagacagccgcatagcccacgatgggagatatctccacaaagaggatctgactgaaaagaaattaaaagctatcgtccagttaaatgatatggctgctgcccgtggccagtcgcttgcagacatggcgcttgcctggatcatgaaggacaacacagtgtcgtcagtgataatcggggcctcaaagccagagcagatagaggacaatgtcaggttccttgagaacagcagcttttcagcggaggagcttaaaaagattgacgacatctcaaaaagcgtgatgtaacaatcagacagcaacaaagagccatgcacagctggtaatgtctggcgctccgcggatccggagattactttgacaagtctctcgatttctgagcggcagtccttactgcgtcgatcattgcggccctgagtccgtctctttccaaagcggcaactccctcaatggtagttcctgaaggggaggtgactgcgtcctttaattcgcccgggtgtctgcctgtgtcgaggaccatttttgcagagccgaggacggactgggctgcgaagatataggcctgctttctaggcatgccctcggctacagcggcgtctgccatggcttcgatcaccatatagataaatgcgggtgatgaacctgagactccggtaactgcgtccataaggctttcaggtacgaattcagcttttccgaaactgttgaagaggtcgatggctgtttttctgtcatcatcagtcgatttctcatcggagcagagggcgctcatagcctcgccgaccatggccggagtgtttggcatagagcggattatgtgaaggtcaccgccgaggatgaaatggagcttctttaagtcaaagccggctgcaatagagatgataagctggtcttcggtcaggacgtgctttacctctgcggcgacatccggaagtacgtttggctttaccgcaaaaaatacaatgtcggcattggcggcttcgcagttgtcgagagtcatttcaatgccgagttctgaggcgatgcggtttttcgtctcttcggtgtggcaggaggcaatgacctgatccttagatgccaggccatttttcaggatgcctttcataatggcagttcccatgtttccggcgccgataaaacctattttttttctcatattaaagaccacctttcctgagataagagctgtttcaattgagctgctcagataaaaacgtttttcgattgctggaactaattgtatcacaaaagaattgttttgtggtagaatgaaacaaatgtactttttctaaggagattcatatggatttatttgattatatggctcaggaaaaaaagaaggaggaggcgccccttgccgcgcggatgaggccacagtcgctcgatgagatcgtcggtcaggaggatatcatcggaaaggataagatgctctaccgcgctataaaggcggataagctctcgtcggtcattttttacgggccgccgggaaccggaaagaccacgatcgccaaggtcatcgcgcacacgacgagctcggaattctgccagataaatgcgaccgtatccggcaagaaagatatggaggacgttgtatctaaagcgaaggactcgctcggtatgtacgggaagaggacgatcctttttatcgatgagatacacagatttaacaaggggcagcaggactatctgctcccgtttgtcgaggacgggactataatccttatcggagcgacgactgagaatccgtatttcgaggtgaacaaagctctgctgtcgaggtctattatcttcgagctgcattcccttacctttgaaaatattaaaacaatacttaatagagccttgaccgatcagaataaaggcctcggcaggcttgacattaaagccgatgaggatgccattgattttctcgcagacatggcaaatggggacgcaaggagagccttaaatgcccttgaactcgctgctcttaccacaacaccggacgcagacggagcgatccatattgacagggaagttgcgtcagagtgcatccagaagcgggtgatcggatacgacaaaaagggcgacggacactacgatacgatatctgcttttatcaagagtatgcgtgggtcggatccggacgcagcagtctactatcttgcgaagatgcttacagccggagaagatatcaagtttatcgcgagaagaatcatgatctgtgcatcggaggacgtaggaaacgcggacccgatggcgatggtagtagcggcggcagcagcttcagaagttgaaagagttggccttccggagagccagctgatcttatcgcaggccgcgatctacgtggcttgtgcgccgaagtcgaacagcgcgacaaacgctatctacaaggcgatggacgtggttaaggatacgatgacggatgaggagccctcgtatcttaaagatgcgcactacggcggttcatcgaagcttggacatggaatcgggtacaaatatccgcacgactatccggggcactatgtaagacagcagtatctgccggacgcagtgcagggaactgttttctacgagccttcggatcagggaagagaagcagagatcaggaagcggcttgagagcctgaaaaattcatgatttggtagtcaaccttttgaccaccaaatcataatataacgaaaagaccgggccactcgtttgagtggcccggcttttttaaagggaagtaaaaaaggttttaaagagctgcttcgtacagcctgctgatatcttctttcgtgtagctccccggagtgtttttgatgtttccggccgaaaccttgaggcagttttcggtaagccacgggatatcctctttcttgataccaagatctgtaagtgtgatatttagatcgatatcggagagaaggtttctgacttctccggcacagtcctcagcagtgaatccaccgagcatacgggcgatacggccaaatttcaatctgttgtggctgaattcggactcgataaccacaggagtcagagccgcaaggcctttgccgtgagttgcgtttactttgccgcttaccgggtgctccatgccatgggcaagagttacacctgcggtatttattaccatgccgccgaaagtagctccgagtgtgatggctgcccaggcttcgtcgctgtcatcgcccttgtagagcctgacaagattttcagcgataagaggtatagcgtagaggcagagggcgtcggtaacaggctgtgcatttctcgctgtgaatgcttccatgcagtggcagagggcatcgaatccgacagaagcgagaacgctctttggcatcgtcttcatgacatccggatctacgatggaatcctttgcgacgatcgcaggagttcgaagcgacttcttgtcgccggtcgcaggatctgtaagaactgcgaaaccgttggcctcggaacctgtgccgcaggtggtagggataagtacgagagggagggctgctgcacttgatttcctgccgaagatgtaatctgaaatatcaccgtcattttttgccatgaaggcgattgccttggcgcagtccagaacgcttccgccgccgactgcgacgattacttcaacgctgtcgtcctttgccttggcggctccttccatagcagttgtcgtaagtgggttaggagttaccttgtcaaaaatctcagtggacattccagcctgatccagcagtccattgatcttgtagagaagtcctgattttttcgaactcgagccaccggttacgatcatggctttctttccataggcgcttgcgagcgttccgacctcggaaacttttccggcaccgaaatggatatttacagggagaaaatagctgaaatctgaggacattgcaggaatgtcgtctgcggcagcttcctctctgccgagagatttctcgatgctccagacggcacttgcggcagctttgcccgcaggagcagctccctcgacaggcttgccgtttatcattgcgttgagcggagcgtagtaaccgaacttatccttatatacagctttgcagccgattatgaagaagatgccgagaacgtaccagcctccggcgatagcccactcctgtggagcaagggcagcacctgaattcggaaggatgtagaggaaaagcatgattccggatgtgatgactgcaatagtgccgcagagcatgccgtggcttactttgtagggacgggccatgtttggttcttttttccttaaaataaggaatgacatcgcaaccatgaagtaggcgagcacacatccgaagttacctgcatccgaaacccagacgagcatctgtctgccgaagaacggtgcgagcatacttaagattccgataagccagatagctgtagtaggagtcttgtgctttgggcttaatttcttaaatgcggctgggatcatgtatgactcagccatggagtaaatggcacggcttccgccaagcatgaacgagttccagcttgtgacgataccgcacataccggcgatgattatgacttttgccatcgcttcgctgtggaaggcttttgccatagcgtcggcggtgacgagtccggaagcagaataggaatttactatagactttgcatccattacgtagcctacggcaaaaattacgagggcgtagaatgtgatggcaaggacaatagagaggagaagaactttacctatttttttgagaggaatgttgatctcttctgctgcctgagggataacgtcgaatcctacgaagaagaacgggctgactgcagctacacggatgatgtttccgattatcgtaccgttcgtgcttccgttgaatacctgtccatcaaggtttgaaggggaaccggtgataaaggaagcgactacaagaaggattccagcagcaccgatggctaccgtaaggatagtctggagaatagcggctgtctttgcacccatgaggttgattatggttataaggaaggcaaagacaactgcaactgctacccatgaggcgtaaaccttgaatcctgcgatcgtgtacatgtagcccttcaggaaccccggccacaggtaggagatgatggtagggaaggcgcaggcctcgaaacaaacgactgagacgtatccgaggatgatggcccaggtacagatgaacgatccgtaaggacccatggctctcatcgagaagacgtgctcgccgccgcactcaggcatggctggcgtaagttccgcgtaggtcagtcctatgaaaaatatcatgacgccgccgatgaggaatccgagcattgcgccgatgacgccggccttctcaatccagtcgcccgactgaacgacccagccccagccgatcatagcgccgaatgcgattacgaggatatcccacgagctgaaaactttgtcaaattgtgatttgttctgctgtactggcatatgatcaatctcctttctcttcgagcatctcaacaagcatcagaagatactgggctgtcttttcccaaccgaggagactgctgtctattaagatatggcggtttttcctgtcgcctctgtaagtcccggtgatgtatttgtgccttgcgtggttctgttcatcgttgtaggagacaatctcttcagctttttttctgctgactttctgagtggacattaccgacttgatcctgacctcttcaggagcgtagatgaatacgtttaagacatcgtttctgtcctttaagatatagtcgctgctccggccgatgatgacgcaggaagacttctctgcaaatttgtggattacttcgaactgagccgaaataactctgtttgtcaggtttgcgtacctcggtccgagagtcgtgtcaaatgtgtagagcacgctctttttctggtcggccttttctacaaggtctttgtcaactccgattctctgaacgacactgtcgacgagatctctgtcataatattcgattccgagcgccttggcgagcatctgacctatctgaggtccgccggctccgtattcgcacccgattgtaataacgatatgtttcattcgcttattccctcatttttctaaaaaaggccgctgaatactactgtattcagcggcctcattgccatctggtatatggaagttattttatgctaaaagtggcttgtcccaaaggtgaagcttggttccgatgccttcctttacggctctgttgtagcagactgtgccccaggcgacatcctcaacaggcattccgcctactgagtagacgatgatctcgtcgtcgctctcacggcctttctgctttccgttaatgatctttccgacatctttgatatcgtcatctgtgatcaggccctcatgctccatatccatgaacttagtgccgaccatcgtgacatttccataagtaggataaggaaactcggatgcccatgccttgtaaagtccaagcgcatcaactgcaagtgtgcagctctttgcgagatagtctttgtcgaattcagcaccgcccgggcaggcgaaagtgcatccaggcttaacccactctttctcaaccttaggatatttgcttaagtcgtggccgcttgtagcagcgaagataacgatatctgaatctcttacagcatcttcaagggtgtcgaccttttcgactttaaccttcggatatttctctttggcgaattcagtgaactcgtcgattcctttctggcttcttcccttgacctttacgagctcgatcgaagggcaggcaaccatcatagcttcaaaggaagttcttccgataacaccaggtccgcagagacctgcgacctttgaatccttctttgcgagatacttaagtccggctcctgatgtagcgccagtacggtaagcactgatcaggttggctgacataaatgccttcggagcacctgtatccttgtctgtcagtgtaaacatcaggatagaacgaggaagtcctttcttcttgttctccatgtttgagccgtaccacttgactccggcgttatcaaacggagcaccgatatatgcaggcattgccatgaatctgcggtcctcgcctttgcctgaaggcatctcagggaatggagattcttcagggaatgccagcttggtgccgtgtgaatagtggttctcgccgcccatcataaagtcgccgagatcgagaagagaaagaaccttgtccatagtctcgacgcactccggcatgtctgtgacaccggccttaaccatgtcctcttcattcaaaaataaaaaatcaactgctggatattcactcataactaatgcctcctgtaaaaataatctttttttcctaatccggactatcgggaaaacaaaaaaggcgccacgttaaacggcggaaaaaccattcaacgtgacgcccttgtcatctctgttgccccatattttggcattattctgaatgaaattattgtaaaaatcggcactaaaatatttacatccacaaaaaatgatttatactacttcacatagatttggaacgaggaatgattttatggagacaaagaactggaagaaagacaagcttcgcgcctcgcagccattctttgtattagacagcgaaagctttatacaggagtcgtacagaaagatggggatttcccatttttatatgatccgcaaggaaaaaggagtcacattcagggcgataccggatggctgtatcgactttatcttcagctatagtgaggatgggctcaaagcctctgtacttggcactccactgtctgccaaggacgacatgatgggcggcgatacggacatgttcggggtaaggttcctgccgggagtgcggccgacagggcttacagtaaagcttaaggatctggctgatatggcgcttccgctcaaggatttctacactgatgagtttgattttgacgggctttataagcttgacgactttatctcaagggtccgttttttcctaagccagtacaagaaactggaaaagagagaaccgaagccttatggaaaagaggcacttttcaatgcggtctgtgatatgatctaccacactgacggacagatcaggatatcagatctggcggtagagacgagctactctgagaggtacatcaggaaagtcttcatggaggagatgggattttctccaaaaaaattctgcagcattttgaggctgcagcgtgcgatagagtttataaattacggttatgacgaggatactgcagactgggccacagacttaggctattacgatcagtcgcagtgtatccgtgatttcagaaggtatctcgggatgactccgagacagtacagaaaactcgtgcgggatggagactatgtcggaagggcggtttatgctcacgacataggacttaagatataaggcttcagataaatccggtatatggagtctgggccacactgttgtacatccatttgatcagagttatgaaatcaaataccggaagctgtaccgcgctctgaacggcgtaggcgtatggcggcatatcgctgcactcgagcactacggcaccaatctcatggtattcttccacagcttcttttgctttaccgaccacttcttttgtgacgatagaattgtcaaaatatccgcgatcttcaagaattgcagaaaattccttttcgtggcgcagatcttttattacaagtctcgattccatttcttccgttatcccgacatccctaaggagatgaggggtgatagatgccttgtttgcagtgaggactgcgatcttctgatctggctttaagattggaaggatccagggtatctgcataaggcttgacattgcagccgggatatcgaggcttctggccagaaatttttgataatttccaaaaaaaccgcatgcccctgttactgctctgcagccttcactctgaagctttaatgcagctttaaggaccatgtccttaacctgcggctcagtattgaaaagttccgtctctttcagcccctcgacaggcataagccttaccgggaacggataagtgtaaccgtttacaacgtttccgggaagcatcggataggatacgcagtcgatataaattataccgattggaaaacctgcgatattctgtcccggcttcatctgtattattgtctggtttgtttccggagtcatatatccatattgataattttcaaacatattcaggcctccaatccggtgtaattatgcgaaccgcttgaaatcgagcttgctgatatcaaaatccgtcggcctgcctgctactatctctgccatgaattttccagtgatgggagaaaggcagatgccgtcgccttcgtgacctgctgcaatataatatcccgggatgctgtcaacatcggatactattgggagatggtcttttacgaatggccttacacctgagtaggtgcggatgcactttatattcgcaagctccgggaaaaatctcatcgcgcgctcgcagatggcttttacagtctcgatttcagttctgatgtcgtagcctctgaagagtctgttgccgccgacaagcaggttgttggaattcgtgtattcgaggttaaaggcgatattctgatcttcgacaagctttgagacttttctcttgaagttgatgctgtcaaatttgctcatcatgtagccgtactccatgatcttgttattgcagaggcgcggagtctgctcggaaacgaggtttgtaccttttctcggttcgataggaatgcttagacctgtcagctttcctacgaatggagcccaggcgccggcgcagtttacgatgcgctttgtgtgtatcgtcccgtaattggtctctaagctttcgactgcatttgtcttgtcgttcagattgatctttgtgatcttgcagtaggtgtatttttcaaggccgaatttttcagcttcatatgtaaatgcaaaacagagacggtaaggatttactgcgacgctgctctcaggtggtgtgtagagagcaccatacagatcctttgagatatgcggctccatctctgacagctcgcggctgtctatcatgcgcatcttgtagccgtccttctgctgggcttcgcagtatttggaagcggcggtaaattccggttcggtctcacagacatagaggcagcccttcggggtgtattcgaaatcgtaatcgaactcctttgcgagcttcccgaagtagtcgatgctggcctggcccattttggtatcaagccctgggagcttgtcgcagattactgcaactgcgtcgcagtggcttgaagagccgctggcaatatcaccgcgctcgaggagagctgtcttgtatccctctttggcaaggtggtaggcgacgctcgttccaatggctccggcgccgattaccacgatatcgtaatatttttcgttagtcatcttcaacatcccctttcgctaattctccaaaagttacaggacgtacaggaggcctgactgatgaggtaccggtctcggaagcgggaactccaagctcttttgatatgatctgctggacaagtttctcacaggtccttccctgacacaggcccattccggctctggtccttctcttgacaccgaccacatctctggcaccatcgcgaatggcttttttgatgtcgccgacagtgacttcttcacagcggcagacaagcatatcatctgctaatgcttcactcatggctgataccccctttcaatgcttctgacttcattggcgtactctatgggaatatcgatagtgacaacgggagtgtgatcgtaactggcaggatttacaactttgcttacagttccgtcacagatgtattctccctttctatcgactgcgtggcacttatcgcccactttcgggacagggtagtactcataaggaaaagacactgacgcgattccccttcccttagtcttgttcactacgaaaattgccatgcccggacattttgctatgcagtttccgcagcctatgcattttctggtatctatagttggaagatttgtgatgggcgagccgatatggatagctccgaatttacacgatgcttcgcagggattgcacggtatgttctgaacacactcgattacggcaactggtccttcctgatatcttttttcatccgggagagtctgcagagattccagttcactatattccagatatcctgttttaatatatgacatgatgactcaacctccttaatctgtttctacttattggaatgctgcagggacctttacagtctcgctgtattcctccatcatggctttcttttctttcatacggcgctcgccaaatggcccgagccggagtgaatcaagccttgaccagatctcgctcctcatcgcatctgcatcttcatgggaaatatatccgagctcctcagctgcacttattcctgcgatcttaccctcgtcgagtgcggtgttcgcctcctcaactccggtgctgtcgccggctacaaatacacctttcaccgaagtctcaagcctctcgtcgtggatcgggacgtagcctccgagcggaccgtgaaatttcagggcgcaaccggcgagttttacgagatccattgtcggcttcattccggttgcaagagtgatcacgtcacattttaaagtctcttcagtaccagggaccggctgaaaatggtcgtcaacagcggctgtaacgcatccgcatacggagccgtcctctccggcaagtgcttcgatgatcgtgcggcttgtatatataggaacgccggcccgccggatctttgccgcgtgtaccgaatagccgccgacctttggagcagcttcgagaagggcaactacattgcatccggcctgcatcagctgatatgagacgatgagtcctacgtttccactgccgatcattacgatattttcaccaggtcttacatggtttacatttaccatggtctgagcggcaccggcacccattacaccaggggtggtccagcctttgaaccggatcgcgttttctgaagcgccggtcgcgatgattatcgttttggctttaagagttacgaggtccttttccccgttgtcaagtccccgctcgattccgactttcccgccagggaagattccgattacagtgctctgcagccagatctcaactcccgcatcacgggcctgctttaaaagcaggcttcctatttcataaccgcgggtcccggagtggtgggcgctcgatccgaaaaatttatgaatctgtttaaagagctgcccgccagcttttaaattcaggtctacaagcagagtatctgcaccggcctttccggcttcaatggctgccgataatcctgaaggaccggcacctattaccagcacatctttatgaatcatggcgaacctcctttgaaagaccatcctgagtctcaactaccattccgtcgtgtgcaggagttatgcaggtcctgacatttggaatgccatctacgaccatcgcgcagtcggtgcactgtcctattccgcagaacagccctctcggctcatggcgttttacggtgtaacgattgatttttatcccggcggcaaggagtgcggacaggatcggctcaccatcgtaagccggtatctttttgccatcgactgtgatctgaattttctgtccggctggcttgcagtcaagaatgatatgattttctatccgttcacccattattttgacctccagtttaaaaaataaattaaaatacggctacgaactccatctctacaaggcatccgtcaaccatatctacgcactgggtacagcaccttgccgggaaatctccctcatcgaagtacgctctgtagacttcgttcatctcagggataagtgagatgtccttgatgtagatcgttaccttgccgacatctgcaaatgaggcaccggctgcttcgagaactgtcttggcgttctccattgtggctgtggtctgtgccttgatgccgccttcaactaccgcgccgcttacgtcagtcccgatctgggtagtgaagataatgtttcccatctttactccaagagcataaggtccttcacactcgccgcactttgatgatgtaatctgttctctcttcatagtaattacctccctacattgtcaagcactttttgcctgaaaaataaaggttttcattgttcctcaaaataaagaatgagtcaaatattgtgagcatttctgtgtatctggtacgaaaatagcctattcaggagggtccactttttaaaacgtcttcatatctcgtttttaaaaggccttatgtataccccgtcagctatggcagcgacctccctgtgtctaccgggatctttgtcccaacttccttcgttccgcctgcccacaaccagggtgtcagcttagctcctttcagggtcgtgccctatggaaaaaattcctgccgactactggctcattctttgtaaataacttactgaccatgtatcttccacaacacaccttgcggtggacgtttacctgctgtttccaatggcatagtctttgcctgtgtgctacattcttttacatcgcagctggcctcaaccgactcatatgctgtcggctcagacctgcgatgtgcttggtatgctacctatttctaacggccacatctctgtgtccatatctttccttcgtatgtctctaagcatctttgtgccatcataatctagccttttgccaggattacataaaagattctgatcagcttgcaggcaaccgcgatatagcctcatcttctttaacgggttgtcctttcttgtccggtagtaagtatacaattccttgaactctgcattcttgcctaccacagatactgctgcttcatacagcacatatctcagcctttttcgtcctcgatagcttatgtgactttctcctttgtgctttccggaactggtctccactattgcgtatcctgcaagtttctgaagctgtcttggatcccaaaacttcttatgtctcctacttcagcaacaacccatacgccgttttttcgccatccccggtatctcaagagtttgttaacataaggtatatcacggtcttctcattcagcttttctaacagttctgcaaccctatgacggtatttgtcatagtcttccagtagctccgctatctcaatccttgctgcctcatgggcggtctgcttccctatgctgttcagcgcagcttcgtatagctcaacagccctcttgtgtccggcgccgcggatttttgctttcctccagatcttctctatccgtcagctcccagtttcacaatgtcttccgggagaggcgccctcatgaagaatcattatccctgttatcggatcgggctgtgtataaacgtcttgattcagggaaatatatgctgaaccatctcgcaagcctgttcgttacgcgtgtcagttcttcctgtgcctggtatctcagggatgaaagcaccctcacctctgcatatacaccttccggtatgtagggtatctggtaccttccatctttcaccagccctgctatcacctttggatccttgcggcagtcttcagtggattactgtcatccactcttcgcctgttttacatgatatggattcccgagaacggtcctcattccatgagttggagaaatgccccaagttgaaccagtatggccggttggctccattcctgtattacggcatcgagtccattctttgatttgagatcctccatccacgccaaaacatatagtaaccctcttcactatttctaaactcgaagggttccgcagagatctctatccctctgtatgtaaacgctctggcgtcatgcttctcactgcctattcgatccccacgatcattgtcgtctctgtgatagccctgatcctggcattctgtgatctgtcgatttttgttgcattacttctggtctttgtgttactattcatttgtgatctctctgttctatatgttttaccaactatgctgagtcagtaaacttattttacattgaggtattactttttatcaaccttcctttccggaattccttatatatgtattatacaggaagctccttgtcttagtaaaaaacaaacggcagattcgaacctcgtcgttgagattgaatgctgccgtttcttgatctgttgaggacattgtatgcaaaaacgagaaataagtaaacttcaggatttacatatcagacataaaaatatataataactgcgtaacaacaaggctttggagggcaaatttcagatgaatatttcacagtataagctccttttagacatagctgagacgaaaaatctgacgaaaacggcggagaatttcggatacacccagcccggtgtcagccatatcataaagtcgatggaaaaggagatcggcttctctcttatcgtcagggaaaaatacggcgtgacactgacaaagtccgctgaatctcttatacctgttatgaaaaacgtcgtgaaggaaaacgataagcttgagcagatgataagctccataaatggcttggagagtggacttataaccatagggacatattcgagtatcgcgatccatatacttccgcaccttcttaactcctttagaagtcagcatccgaatctcgacgtatcgatcaaagagggcggtgtcgaccagattttggccgggctttcggacagatcgatcgacatagcgtttttaagtgacgtctcaaaggacatcacatttataccattcagggacgatccgatggtggcggtactgcctaaggactatccggtggatgatcctgacaaatttgacattcacaatttcgataaagagacctttatcatctctgccgatggaaatgatgccgacatccacaatgccttaaatgattcgggagtatctccggtgtttaaatatacagtcttagatgacaggactgttatggccatggtggaaaatcacatggggataagcattctgtcgaagcttatcgtaaagggatttgaggacaggcttaagatcatcccgctcgatccaccgtacaggaggagactcggaatggggattctgtcatacgattctctgtctccggcagcaaaaattttgattaatttttcaaaaaaagtactgctttcttcctaatagatggaaaaaaataaaataatttttttataaaaaaactattgactgaaaattttttatgtggtagggtagagaccgttaacacaaataaatcgcttaagcaatttataaatctggattattcagatatgcagctggcaaaggcgctgattccaaaaaagttggaattggcgcttatttttttactacagagaggtgatcaaattgagcgagaagaaaacaatggtatccctcaacaatatttacaagcatttcggcgagaacaacgttttgaatggagtaaatatagatatcaggaagggagatgtggtagtcattcttggtccaagcggatcgggaaagacaactcttctgagatgtatcaatttccttgaaagagctgaccagggtacgatcacgatagataattacactgtcagctcaaaggaaaagaaacagtcgaagatcctggcactcagaagaaaaaccgcgatggtatttcagcagtacaacctgtttagaaacagaacggctgtcgagaatgtcatggagggccttcgggttgtaaaaaaggtgccgaaggccgaggccaggaagaaggccgaggcagctctcgataaggtcggtcttctcgacaaggccgatttctatccggctcagctgtcaggcggacagcagcagagaatcgggatcgcgagagcgctcgtgatggagcctgatctgatccttttcgatgagccgacatcggcactcgatccggagcttgtaggcgaagtgctctcgtgcataagagatgttgcaaagactggcattacgatgatagtcgtaacccacgagatagcgttcgccaaagaggcagctacacgagtcatcttcatggagggcggagtagtagtagaggatggcactccggatcagctgatcaatcatccggaaaatgaacgcacccagcagttccttgccagaataaatggagccgcagcaagtgcgtaaaacaattcacaaatttgatatttctcaacaatatcataggaggtggcctattatgaaaaagcattgtttgaaaaaatatataatatcgtccgtacttacggcaggacttgtagtttcaatgtttactggatgtggaaaggcttccggtggcagcgcatcaggaaaaagcagcatcgcggcaatgcagaaaaacagtgatggcacatacaccgtaactgttgcagtcctcgatggcatggccccttacacatacactgacaaagacggaaagatgcagggctatgatttcgaatggatgaaggcagttgatgaaaagctgaagaaatacaagtttaaatacgtttctgtcggcgccgatgcagcaccggcagctatccaggcaggaacctatgcattctcagcttcagcgcatttcgttacacctgccagggcacagcagttcattttaagcgtcccggaatcgtattatccggtaaacctgatctctagaaaagctgacagtttcaagaaatttgaagatctcgacggtaagtcacttgtcccgaacccaccaaatgacggactctctgttgtattaaagcagatggccgccaagtatccgaatgtaaaatacactcaggatcctacttctgaatatatcccttacgaggatggcttaaagggcgttatcagcgggaaatacgactgctggttcggaggaaaggcgatgtatgacgacatcgtaaagaataacaaatccgaggcagatgctacgtactgctcagaccctatcacctgtgctccgtgcgtggccgttataaataaaaacctgacagatttaagagatgcgataaataccgccacctgtgagctctacaaagacggtacacttcagaaactttcaaagaagtggttaaacgacgatgtattcgccacagcaaagaatacgaagacgctgtttgactacagcggctattcaaaggacaaagccaactggtatcagagtactttgaaataagcactcttattgggctgaaaggagtttcatatgtcaaattttttaactatcgtaaagcgatattttccttcattgctcagatctctgccaacgacttttgaaatgcttttgatctcagtggtaatagcgctggcatttggactccttctgaccatgggaaagttgagcaggaacaagatcgtaagagctgtctgcactgtatatatctcatttatgagagggacgccgatgatggtccaggtgcttctcgtatttatcctgatccctctgatagcgttccagaacggcgcgaatatcggaagctggaacaatatcatctatgcgataatagcgtttacattaaatgaagctgcattctacgcagagattttcagaagcgcttacaattcgctggaccgcggacagatagaggcggccttaagcctcggaatgagcaggatgcaggtgtttacgcgcgtcatcctgccacagggagccgcaagcgctcttccgaataccacaaacatgacgatagagcttatgaaaaacacctcgatcgcttcggttatcggaatctatgatctcttagggcaggcgcagcagctcgccaaaaacagttacggcgtcggccagatccagctctacatatttgtggctctgatgtactgggtgatcggtcttatcattctctcgatttccaattttgcaacgaacagattgaacaagggcaatgctgcttacaagaaagtgagcatatttgccgtgagaagctgagggcaggaggtgtttagtatgtttcagtggagctttttcgtagaatcacttaaacctataatccagtgtatgcctgctacgcttgagcttaccgcaggggcagtgcttctggcacttgccctgggaatcgcagcggcaatacttgtaaggtgcaggtttcatgtggtaaatgtgatatttacagtggtcaattcatttttaaagggtattccgattctgttatttctgtatcttctgagcagttcgatggacggcatcatgacaaaactcgccgtgatcttcaatttcacatacaatgtcaggcggccgccggtattcgcattcgcgatcctggcgctggcgctttcctacattccatatatgtgcgatatgatcaccaccgcctacgacactattccaaagggacagacggaggcctgcgaggcactcggattcactaaatggcagacgatgcacaggatcataatcccgcagatgatggtggccgcgatcccgaatttcgggaaccatttcgtaaaccttctcaaagccacatcgctcacctgtatgatcacaataatggagatgatgggcggcgcaagaaactttgcgacgatgaaccagagatttctggaggcctacaccgcatgtgcactgctttactgggtggtattcatcgcatttgaaaaggtgttctctatgatagagaagcgtgcaggcagatacttaagtgccgcaatccctgcgaagaagagacatagaaggcttcttatgtctgctggtcgcaaggacgaagaggcagaggacagaaaagtaaatatcgcataaaaatgatcgacggaggaaacagagatgagtaaaaaatatattatcactctttcccgtgaattcggaagccttggcagaccgatagcgcgaaaactttcggagtttctggggatagattattacgacagggagatcgttgagaagaccgccgaaaatctcggcctgccgctcgaagtcataaagaacaccgaggaaaaagtgcagagcagattttttgctatgggctttccgcttggcaccggcgcaactgatcagcaggatcagatcttcagcgagcaggcgaggatcattcgcgacatgactgacaaaggctcatgcattatcgtaggacgctgctccgactatattctgtgtaatgagaagaactgttacaggatctatgtgtattccccgttagaggacagatacagaaactgcgtcgactatctgcacatcgatccgaatgaggccagaaagatgatagctaaggtcgacaaggccagaaaggcgtatcatctgcactacgcgggctatctgccgggagatgaggccggccacgatctgatgataaacagttcagtaatgggtgtagacggcacagcaagatgccttgaaaaagtcatacgtgtaaggttcggcctcgaagacgggactagaagctgatttaaggggtagtgtcaaaaagctatgaaaaacctgggccgaaaaaaatggccacattggaccttgaaaaactgcagatattttacttttgagtaccggacgccacccttgacagacacacactgatccgcgtgagtcgatgccgccgaccgtgagactcatgaacagacagtcttctcccgtcgaaagtcatcccattgtagcgcggctccggtgtgccatcaagggcatgcactggtgggtggctgttattcaaaacgcctccggttcgaatcctgaacagacagtcttaagcctctgtttgagactgcatcttgagcatttgctgtgccctaggtacatcattaccgtaagcgagttatcatggggcgtcagccccgcataaaaaccacgtccaggaaggcatcctagatggagaaacttataattcacacaagattttcagaagaatccggtggcaggcttttatggcagcttcgctccatggcatcagctgttcgagttcgagtctgcatatctgcatgaggacggtgatcaagaggaaaacaagatatttgtaaatgttaaatcattggcatgagctgtttcaacaatcgaatcaataaacggcagcactggcttcggctccaccgactgtgtcgcagaacagccagttctttcttccgactgtgcacgacgaatcgatctttcggtatcgttgttcgaaagactgcagtggccgtcctcaaggaaggtcagggaagtctccctgcgattctgggcatagttcaccgcctttcgatcgctgactcgtgactccatccaacgcgtactctccaggcaccacaggtttctctttttcgagccgggttctttccttgtcataatcgccggacatggtgtgttgatcacacgttcgcccggaataatcgattacaatactcaactccctgcactgcagggctgactgtaatcaaactgtttccctttcgggatggcgtctatgaagatgcgtcgaggtgtgcccaacggtacaccgcttgatccccgacactttgttatagcctggtagccgtcggtttccagaaatccgttgaatccttcagaaattctttggcgacatcgccgcttcttgttggtgaataatggaacaggatgatcggaggaagccatcatcgccatacggaaacaccagagaaacgattgcgtctgtgccctccggccgtcttccttcagcacctgatcctggtctcatcgcccatggataatcgcggaggatcagctgcttggtgcagtaatctatgaccggaaagaaacaggtctgtgaacattggatgatccagcctcaagagttgaccttgaaagtgcagtccgtactgcttccagtctttcttgacggtagagcgggacactgttgacgtatttctggtacattgtccatgcgaccgctgatgaggaagcatagcttttctttatcagagcctcagggacctttgttgacaaagactggtttatcagcatcaccaagcgctttctgcagttcgggcacacatagttctcgctgtaatactcgatgacacttacctttgcaggaagtatttaagctcccgcctctgaactccacaccgaccttttccatctgtgtcccgcattccgggcagaccttctggtcatccggagagggatgacgactttttcgacaggaatgcctttaaagagttcgttatgatcagatcttttctttctggtatgagctttgaccggaacagattcaacatctgcctcgtggtcgacggtcatctcagcttcattgaaaaggctcatctgacctgggatgtctccgacattcttctcgctgagcgcccaaagagttttcttgtaagataatcgatctgctctttataatttgctgcgggtgttctgttcggaaatggtggtctgaagtgtactgatcagagaatttagcgtgtcgatggtagtgttcagctgttttatagtgtcgcgtaattcgcggtttttcagttcagctgcgctggctccacggtggatcctcctttcgaattgatacatttattatatcagaaaacgggcaaagaaaaaccgtgaaagccttgattttactgttttttcggcactttttagtcaatgatctcagaagctttttcggtatttcttagtgccagatcatccgtctgagtggtttcggctgatcgaccttaagacctgacatcagccagtcgaactgacgccaggtgaggtctctgacctctgttttgtttctggccactcataatgacctttaacggtaagacgcttgtaaagaagcaccatcccgtcaggtcatgcagtatagccttgatgcggtcacggcgtttgccacagaatagaaaaagggaatttgaatagggatccatgcgcagctgatcttcgatgataggcacagaccatcgatggaacgcctcatgtctgtgtagccggtcaccagatagatatggtctacgccggaaatatcgcctaacatttgatctccttcagataccggaacaccgcgtctgatcgctgctgaacctgcatcatttggatccggattgttattccattggcaataacttcgatctcatgggaattgtcaaggtacgattccaccggctcctttgtaaagaaaccagggatgtatgttcatcggatggatcatccggaacaatcgaaacaggaacaacctcctgtacgacaggttctggccggatctcttcggatctcggccggatcagtttttcagctgcactattttttctgcaacggctgacccacatatagaaagtgcccggcttaattccgttctggcgacaccattccgcatctgtcagtccggaacgccgacactcattgatcagctcaatgcgcttatcctcagggacgcgctcagctctggaattcattgttgttggcctctaacatgtgaatagagtaaaatgcttacatctcacatcttagaaggttttgcctggaaggttacccgccctcagataattcgcttactcatacctgccattacctggcatggttcctgctttttcaatctgcggaaactggttaagtgacttgaagttcgcgtgtttgtgaggacgtagaaagttatagtaggccacccacaatgataaatcgtagttggcaccttccaggttgtcaaagccattggtatgtcgatatgagccttgtaggtcctgttcagacgttcaatcagctgcttgtatggacggaactttgtcgttacggatcatcgtttgtaagcccaagaccggtggtgatttgaatttcatcttgttaccgaaatgctcgagaaactgttgagctgcaagcgggtaggcactgtacccatcagcaatgaaacggaatccttgggatgatgtttttgatgtggttgaatgccatacgcatggcaaggacacagggaccgacgcttcgattagacgaagcccgatagccgataatcgatcgactgacagcatccatgatgaaccagacgaatgttttaacacctctgactttgatgtatgtttcgtcggcagtccaggttttacctggcttgtaatcgtaatggtcaacgaatggtcttacgcacatggcagcaagcttgcaatagttcgctacctgctgatgagagacacgaaatccatacagatcctgcagagccgtgaggtttacgcagtgacagctgaaggtttacgtgaagtgtgagacacagtcccatgatgtttgcgtcgtactttttgaaacggaacgttgcaatcctgttggaatcattgtccagtttcatctgaataaatcgacatgaatccctgtaaagatagtggagtttatactcgtacttttcgtcctcttcatctggtttgatctttttcagccgagagataaaacgacattcgggttaacgcacttccagacggtaaagaccttttggttttaacaaggacaagagcacggccacagaatgggcacttgtactgatagtttttgtgaaaacgcttatcagaggcaaacgtcgttccacagatgcacagatactggcctttggaaccgttgttgcgatagaggtattcagcaggagctccacagcacggacagcgtgtatcagctgggatgtcgcacttgcctttatgctgatcggcttcagctcacggccgttgtggctgcgctggtattcacgacgaagatgtttcagtcctgtggatgattggaattatctcaggaagcttatcagttttaaattttggttttggaccgtgagtcgtcatgagcccactgtttgagaggaatatatctgcagatgaaagttaaaagccacgcttttgataattaaggtcttgaatgatttgaagtaaataacgtaaatgtccagagcatacttctttctttgtgagaatgtttggtttggccacttgaattatacacaaaaacaggggggtgttgctctttttgtgcaaaatcccttgaaatcaaggtttaacattgtattcatgctatagcatgacactaccatttaaggatgggggaaaatgtatgtcaaaggtactctattttaatattgctgataaccttgattatgagaataaaaagctttcagaatggggcattgacgatgtggaactgatcgagataaaggacaaggactataagaaatccttcggcgaatatctccgggacaccggcgcggacggagtagtggtcgaatacgaccaggtgaccagagaagtcatcgagatgtgtcccaatttaaaaattgtctcgcttcagagcataggatacaacaatatcgatgtggacgctgcgacagagcacaagatctgcgtctgcaatatcccgggcttctgtgcaccggaggttgccctccacactgttgcgatgacactcgacctggcgcgaaagatcacattttatgacaggtcggtccagaacggagaatgggaaccactctacggatatactctccaccggctgacagggaaggtctttggcatggtatttttcggcaccataccaaaactcgtagctcctatgataaaggccattggaatggacgtcttagtctacgctccgacaaagacaaaagagtatctcgctgaattcggatgcaaaaaggcagagactttggacgagcttctggaaaagtcggactttgtttcgctccactgccctcttatagagggtgtcacctaccacctgatggacgatgccgcctttgataaaatgaagccgacagcctttcttatcaatacttcgaggggttcggtagtggatgaggccgcacttgtcagggcacttaaacagaagaagattcaggccgcagccatcgatgtgatcgaggacgagatgaacgaaacgagcgatctgttcggactcgacaactgcattctgacgccgcatgcggcatttatctccgaggactccttctatgagggccgtgaacgggctcttaaaaatctcgtggacaggctttctgcaaagagggatggcaggccggagagcatagtaaatccggaagtcctcgaataatatttttccctgtggaacttctgcaaaaactacaaaaaaggcttattttacaagaaaaagagctgttgcaattctatttcaatatggagctgcagcagttcttttttatttttacttccgaaaaatacaagaattaagttctctttagtcgtaccatacatagcaacaaaagcaaatgaaaagcaatgacaagggcgtcacatatcaaggatatgtggcgccttttgtttatggaaagaaaggagcagcttaatgggcaggatttcacagcatcccattcttggagttcagaacgaagaaaagaagatcgtcaccttcaaatatgacggtaaagacatgcagggatatgagggcgagcctattgcggcagcactcaaagctaacggagttatggttcacaggtacacgatgaagcagcacaagccgagaggaatcttctgtgcgatcggaagatgtacagattgtgtaatggttgttgatggagagccgaacgtcagaacatgtatgacaccgctcaaagagggtatggatgtcagaacccagtatggcgtaagtgataaaccatttgaccagcagtaagaccggaggataaataaatgaagatagagagatttgatctgataatcgtaggtgccggtccttcaggactttcggcagcaattgaagcggctaagcgtggaatgaaggtcgtggttttcgatgagaacgcaagacctggcggacagcttttcaagcagattcataaatttttcggctcgaaggagcacaaggcaaagatcagaggtttccatatcggcgagcagcttcttcaggaagccagggatgccggcgtaaaggtagagctcaatgcgactgttgtaggcctctatcaggacagagaagtcgtagtcagaatgggcgaggaagttcaccacttcaagggtgatgcagtaatcatcgcaactggcgcctcagagaacatggttctcttcgacggctggaaccttccgggagtcatgggagccggagctgcccagacactgatgaacctctacggagtaaagccaggtgagaaagtcctgatgctcggttctggaaacgttggactcgttgtttcattccagcttctgcaggcaggatgcgatgtagtcgcactcgtagatgcagctccgaagatcggtggttacggagttcacgcagcaaaggtcgcacgtaccggagttccattctacctctcacatactatcaagaaagttgaagggactgatcacgtcacaggtgttacgatcgcacaggtcgacaatcatttccagtttatcgagggaacagaaaagcacttcgatgttgatacggtctgcgtagcagtcggactttcacctatgtcacagctcctcaagatggcaggctgcgagatggaggataatccgaagagaggcggtcaggtacctatcatcgatgattatggaaagacttctgttccgggaattttttcagcaggtgatgtatcaggaatcgaggaagcttcatcagctatgatcgaaggcaggatggccggagtcgcagctgccgagtatctcggatttatgacagccgatgagaagaagacagagcttgataagctaagcacttcacttgaatctctgcgtcagggtatgtttgctccgaagaacagaggcaaaaatatcacagagacagaagagggcattccgatttctacaaatcttctttcgaagggcttcgtagcagatgacgagattgaaagataccctggagttatccacaaggcaggtatccaccctgttatcgagtgtacgcagaacatcccgtgcaacccttgccaggatgcctgcaatcagggatgcatctctatcggcgacaatattacagcacttcctatttctgtaaaagacagtaaatgtatcaactgcggaatgtgcgttgcaagctgcccgggccaggcaattttccttgtggatgaagatacaggcgacggaaaagcaagcattacacttccatacgagttccttcctcttccggaagtcggagcaaagggcaaggcactcagcagaaaaggcgagcccgtctgcgatgcagaggttgttaaggtccgctcttcaaaggcatttgacaacacgagccttcttactataagcgttccaaaggaatacgccatgaaggccagattttttaaggcagaataagtcaggaggttaatatgagtgaattaagtaacagatcgaaagatataggtgaattcgttccgatgcctgacgatgacatgatcgtctgccgctgcgaagaagttaccaagggcgagatcagaaaagcagtccacgagggactctggacgatcgccgagatcagaagatatttgagatgtggaatgggcctctgccagggacagacctgtgccaagcttgtaaagggaattgtagcccgcgagctgaagtgctcaccggcacttctcgagccggcaacttcgagagctcctatgagacctacagagatgcatgtatttgcagatgagacggaggagacagatttatgatgacatcagacgtaattattatcggagccggtatcataggcaatgcatgtgcttactacctggcaaaaaaaggctataaggtaactgttcttgagaagtcggatatcattggaaacggcggatcgagccgtaacggaggcggtgtccgccagtcaggccgtgatccgagggagcttcctctcgcaatgtacggcattgaaaatctttggccgaatctctctgaggagctcggatacgatgtcgagtaccataagaagggaaaccttcgtctcggaaagactgaagctcacttgaagactttaaaaaagctcgccgacagcgcttctgcctgcggactcgatgtcaggatgatcgatggcgatgaggtcagacagataaacccttacctttcaaaagaagttatcggtgccagctggtgccctacagacggccatgcaaatccgcttaaggctacacttgcttactacatggctgccagaagactcggtgccacatttatcacaggtgaagatgtaaagtgcatcaaaaagatccgcggaaaggccagacaggtcatcacccagactgacacctacgagggagactatatcgttcttgcagcaggaatggcttcaagagctatcgccggtactgtcggaatcgatatccctatggttcagaaactcattgaggccctcgttaccgaggccgagccaaagatgttcgagcagatgctcggcactgcagaggctgatttctacggtcatcagacggaccatggttcatttgtaatcggcggttccactggtttcgagctctacaagaaggacaacggtactccgatgaactacagtgacaccgttccctgtatctgccgtggtatcatcagatacattccgatgcttaaagatgcgaagatcgtaagagcttgggctggatggtctgacaacatgaaggatggtgttccggtcatcgacactgtcagcgaagttccgggtcttgtccttgcctgcggctttaccggccacggtttcggtatcgctccgggagttggtactgttgtttcacagctgatcgctggcgaagagccggtgtgcgatatttcggggctgaagtatgacaggttctatgcgaaggatataaagacggcgtaaggcgaggtgagtgtaataggagcgggtggcgcagatggccgtctcgctcctatggatttttctgtaggtcgcgagccatccatctgcgccgcccgcctcgacatttgcacttggatttaactacaatgctgcggtcgtctcatctgcgccgcccgcctcgacatttgcacttgaatgtaatctacaaggctgcggagcagcaagttttccaaacagatataatatccagacatccagcttcggtggttcgtccaggtggtcgtagacgtacttcccgtctttctttctctgtttcacgcactctgtcagaagatattctatctggccgttcacagaacgaaaatcgtcctccgcccaggcagcaatcgcattgtataatttttcattcagcctgagtggcacttgctttttagccatctcattgcctcaatacaagcttccggaatttacaacaggctgggcgtcgtggtttccgcaaaggactacgagtagatttgacaccattgcggctttcctctcttcgtctagttctacaacaccgttttcgctaagcctgtcaagtgccatctctaccatgccgactgctccatcgactatcatcttacgcgcgtctatgacagcagatgcctgctggcgctgaagcattacagcagcgatctccggagcataggcaagatatgtgatcctggcttcgattatctcaagtccggcatcttccaccttgctctggatcatagcacggatccgctctgcaactacatttgttgacccacgcagacttccgtcgtctgcctggccgtctccggtcgtgtcaatgttcggagccacatcatagggatagatctttactatgtcacgaactgctgcgtctgcctgaagagagagatattccttgtagttgtctacattgaatactgcttttgcggtatcctttactctccagatcacagctacggaaatctcgattggatttccaagaacatcatttaccttctgctttgcgttgctcagggtcattgccttaagagatatctttttagaagctgcattctcatttttcgaagaagccccttgagaaaaacgctgcttactgtcagaatcatctacatctccgctctgtcccagatgagtctttgcggctggatttactgcctgacagaagggatttacataataaaatccctctcccttaagggtgccggcatattttccgaacagtgtcaggaccagagcctccttaggcttaagtatcttaagtccggcaaagggaatcagccccagtcccagccagatcattcccggaataaataataagcgatccggagcatcctctacgcccctgtttattcctgcaattatcagcagaatggccaatatgtaaatagctatccataaaattagaaacagcataccattcttgcgcttagtgataaccttctctgtcatagtgattctcctttccgccctgtaatcaggatcagggcagcacagatatttatttgatatcatattgatatcaaatagatgaggttatgtcaagtgtttttttatttttatagaaagtaatttatgccagccgccatcgcctttgtgcttttatttgaaaccattaacaggcgatatggaactgccttattttttgtgatagtatatctgtgctgattctgataaggagcaaagatgtacgatgaatagaagaactgccggaatgctgcttactgtctctggtggtgtgtgctggggcctgtccgggtccatggggcagtatatgttttcaaatcttggtatggattcgaagtggcttgtcccgataagactgggatttgctggtatcctgatgcttatctactgcttcgcaagatacggaaaagagacgcttaagccctggaccaaccgcacggaagccattgaacttctgctctacgggctgccgggagttgcgctgtgccagtttacatatttccttacgatacagctttccacagcgtcggtcggaacgataatgcaggacttatcgcctgtttttattatggccgccatatgtttgaaaaataaaaggaagccgtccgtcagagaagtcgtggcgattttgctggcgctcgtcggtgtgatgctcgtctccacacacggcgatccgtcaaatctgtcagcgaattcgacggcgctgatctccggagtcatctgtgcgttctgcgtgatgatctacaacgtagttccggtccacattataaaaaaataccctgtctcaattatgcaggcatggtcctttgctatgggcggagcacttctgacgctgatatttagatcgtggagaatttactacgtaccggatatcagaggacttgccgggatcgccttcgtggttgtcatcggaaatgttctggcgtttacggcctacatgaagggcgtttcgtacatcggtccggaaaagggaatcctgtatgggtttgcggagccgcttaccgccgcagtcatcggagttatattctttagaaatccattcacggcagcagatgccgctggtttcatctgcattttcacgatgctgtttttgatcacgaaagccaggacaaaggcaaaagtaaaaacagatcaggcattgaagagagcagcatagtaaaaaagtcccgttgcagtttgttgcagaagtaaaggagaacaatatggcatatgaaaagagcgaaggaatgcgcctcgacaaattcctgaaagtatcgaggcttataaagagaagaaccgtagcagccgatgcagcagacgccggcaggatcaaggtaaatgacaaggtcgcaaagccatcaacgaaggtctatgcgggcgatatcatcgagatcagcttcggcaacaagacagtaaaggcgaaagtcaaggagatcatgaacaccacaaaaaaagagaatgtggcagacatgtttgactatatttagtagttgttatcggatggagaatcgggtataattgaagacgcgcagaaaatattctgcgatttttagacttcagggtacgaggattttctatgacgacagcacgaacaggaaaagttcatacgaagaaacgcataaacgtagtgaagcttttcagcctcgtgcttggcgcagcagtggtgatcgcacttgggatacagcttttttcattatatggaaggtacaagacttacaagcacaaggaagccacagtgaagcaggagcttcaggcgcagaaggagaagcagcagaacctgaaggattacgagaagtacacgaagacgaaggaatacacagagagccaggcgagatcgaagcttggacttctctatgataatgagaccatttttaaggaaaaataaattggattttactgaaaagacagaacgctttatcagagaaagcggtatgttaaggcagagaggatccgtcacggtgggtatttccggtggtgcggattctgtctgtctttttttacaactttttaagctaaaggagcggctcggaatcgagcttaaagctgtaacggtcgagcacggcatcaggggcgacgagagcgaaagggacgccgttttttcgaagcagctgtgcgaaaagtatgggataaagtgcggaatagttcatgtggatgcgcctgcttacgcgaagaaaaatggcacgtcgctcgaggaggcggccaggaagctgcgctacgacgcttttttaaaaaataccgcagagggcgattgcatcgcgcttgctcaccatatggaagaccaggccgagacagttatttttcatatgataaggggaagcggcgtcagagggatgactggcatgaggcctgaggcagaacttcagggcaggcacctgataaggccgctcctttttgcgacgaagcaggagatcactgaagagcttgaaagagccggccaaagctggtgcaccgattcgacaaattccgatgtaaattacgctagaaaccgaatcagacagatcattatcccggagctttcaaagatcaattccggcgccgtaaggcacatctgtgaatcggccgccgacattggaaaaatgtacgacggattcaatgaaaaaatcgacgcgtatttaaaagaaaatgagactgaaaacggcctttactgcgggaagcttcaggacgcggacgactatatgcgcggtatggtcataatggagtatctgaggcgccatctcagaagcatcaaggacgttgggagagggcatatcgacgtcatctcttctcttgttaaaaacggagaaaatttcagctacgacctgccggccggggcagcggtacattttgaatataagatgttaaagactgctgaaagacatgcggacagtgcgttttttgcaggccttgaagagctgcgggagaccggtgcgcagagagtctgtctggcggattttacgctcgaattcttagtcagggactttgatccgtcggaaatcaaagacattccgcaaaaaaactatgaaaaatggcttgactatgctaaaataaataagaaattgtgtgttcggaacagaaggccaggggactggtttgtgatcgaggatgggcacaggcagaagtttaaggagttctgcgtgaaccgaaagattccggcgtcagagaggaatgaaattccgcttgtcgtctcaggagagcatcagattctctgggtggcagggacggacaggatcagtgccgatgcgaaggtcacagaggacacgggaaaagtacttgtaataagatattcgacttcaggaggaattgggtcaaatggaagataagatcagcgttatgctttcagaggaagagcttgataagagaatccgcgagctcggtgcacagatcagcgaagactacaagggcgagagcatatttcttgtatgtatattaaagggcgcagctatgtttgcctgtgagctggcgaagaggatcacggtgccggtagttatggactttatggctacatcgagctatggctcgggcacggtttcgagcggagatgtaaagatcaagaaggacttagacctttcaccggagggacagaacgtacttatcgtcgaagatatcatcgacagcggaaacacactgaacttcctctcacatcttttcgcagagagaaatgcgaagagcgtaaagatgtgcacgatgctcgacaagccggacagacgtgaagtcgatgtagcagtggactatacaggatttactatcccggatgagttcgtgatcggatttggactcgactacgatcagagatacaggaatcttccgtatataggagttgtggaacctgcagataagcaggaataatagaaagaggcacattttggagagacgcagaggaggtctgaacggactgggattttatatcctgctgatactgatagttcttgtgttctggtttctttttacgaacaggtcacagccgaactattctgtgaatgaactgaatcaggcaatacagaagggccgtgtgtcatctgtcagcatccagcagaacagggaagttccgacgggcgaagtagatgttaagcttaaagatgacgacacagagtattttttctatgtgtctgatgtgaaggaagtacagacatatctctcgaataagaatgtgtcatatacacttctcgatgtgccgaaggagaactggctttcagagatccttccgactcttatcattgtcggagcgtttttcatactgttcatggcagtgctcggaggcagggcacagcagacaggcggagtctcttcgcagatgagcaatttcggcaagagccgtgcgcggatgaccaccaaggagaacatcagggttcgcttcaaggacgtagcaggtctcgatgaggaaaagaaggaactcgaggagaccgttgatttcctgaagtcaccagccaaatacacccagatgggtgcccgtattccgaagggaattattcttgtcgggcctcctggaacaggtaagaccctcctcgcgaaggcagtcgcaggagaagccggagtcccgtttttctcaatctcaggctcggatttcgttgagatgtttgtaggtgtcggagcagcaagagtcagggaccttttcgcagaagctaagaagaacgcaccgtgcatcgtcttcatcgacgagatcgatgcggttgcaagacgccgcggaagcggcatgggaggcggtcatgacgagcgcgagcagacgcttaaccagatgctcgtcgagatggatggtttcgaagaaaacgaaggcatcatagtcatggcagctacgaacagagaggacatcttagatccggcccttacgagaccgggacgtttcgaccgcaagatctacgttgggaggccggacatcaagggacgagaggctattctgcgcgtacattcggacaacaagccactggctgacaatgtcgatcttcaccacatagcgcagactactgtaggtttttcaggtgcagatctcgagaacctgatgaacgaggccgctattcacgctgcaaagaccaacagagcgtatatcacagacgaggatatcagagattcatttgtcaaggtaagcgttggtacagagaagaagagccgtgtgatcaccgaggaagagaagaagatcacggcttaccacgagtcgggacacgctgtcctgatgcactgccttccgaagtcggacccggtgaactggatctcaattattcctaccggaccggcaggcggatacacgatgccgcttcttgaaaacgacgatatgtacaatacccgcgagaagatgtttgacgacattgtcgtggattttggtggaagagttgccgaagagcttattttcgacgatgtaacgactggcgcaagcaacgacattaagaaggctacccagacggcccgcgatatggtgacgatctacggattttcatcggctatcggaccgataaactaccagaacggagacccggatgagattttcctcggacgggatttaggtcatgcaaggccttatggagaggctgttgccacagacatagataatgaggtcaagaagatcctcgatgatggctatgccagggcaaagcagatcattactgatcatctcgatgtgctccacaagagtgcagctctcctgatggagaaggagaagatcgggagaaaggagtttgatgctcttttttctgaggatccaaagactcaggaagccgaagaggcttaggagataattaatgaacaaagaggcgctgttctcagacggaacaagtgaatataccaatccgtgcgaaccggatgcgttcgacacggtaagactgcgccttcgcactgccaagggagataacctgcgggtgagcgtatttgtccttgaaagtgggaaagagctcacctgcttaaaggaagagagcacgaatgatgaggtcttcgagttctacgactgcgatctcacactcgaagacaagctggttacttattactttaagatccgctcgaatgaggggatgctttactatgacaggttcggagtttccgactctctaagaccgcagtattttttcaagatctgtccggggttccataccccctcgtgggccaagggcgctgtcatgtaccagatccttgtagatcgtttctgcaatggagacgagtcgaacgacgtagaggaaaacgaataccactatatcaatacatattctcatcacgtggccgactggaatactccgccggctgattttgatgtagcaaatttctacggcggcgatctcgagggcgtgagacagaaactctattatctgaagagcctcgggatagaggctgtctacttcaatcccctttttgtatccccgtcaaatcacaagtatgatatacaggactatgactatatagacccgcactttggcaagatcgtaaaagacggcggcgagaatttaaagccgggcgactacgataacaaacacgccacgaaatttatcgagagggttacaaataaggaaaacctcgaggctacaaacaaatttttcgtagatttcgtggaggaagcgcattcaaagggcataagggtcattctggatggcgttttcaatcactgcggttcatttaacaaatggctcgaccgggagagaatctacgagggcagagagggctacgagccgggcgcatatatttcaaaagacagcccgtatcactcatttttccagttctatgaggataagtggccttacaacaaaagctacgatggctggtggggcaacgacactcttccgaagctgaattatgagggctcaaaggagctcgaggactatattataaatatcggccgcaaatgggtttcacctccgtataactgcgatggctggagacttgatgtggctgcggatctcggacattcgccggagtacaaccaccatttctggcagaggttcaggaaggaagtaaaggatgcaaatcctgatgctgtgatccttgccgagcactatggcgacgcttcaagctggctctccggggaccagtgggatactatcatgaattacgatgcgttcatggagccggtgtcttttttccttactggaatggagaagcactcagaccgtttcgagagtgatctctacggcaatggccgcgtctttgagattacgatgagacacgcgatgtgcgagtttctgactccgtcactgtactgttcgatgaaccagctttcgaaccacgatcactccagatttcttactaggacgaatcacaaggttggccgcgtcgctgagcttggaagtgctgcggcaggagagaatgtaagcattcccgtaatgaaactcgccgcgctgattcagatgacctggcctggtgccccgacaatctactatggcgatgaggccggagtagtcggcttcacagatccggacagcagaagaacttacccgtggggtaatgcggactacgaacttattgactatcacagggaccttatctatatgaggaggttcaacgaggcactcaggactggtgctctgaattttctctcgagcggcagaaactatatctgctatgcccgttttaacgagacgcagaagatagtgatcatgataaactctggtgaggacgatctcgagacagatgtaccggtatggaaggccgaagtgcctttaaactgtcagatgcatatgatatttggaacgaacaaacggggttactcccttatgtcgataaaatgcgatgttgtaaacggctatgtgcacgcaaagctatctggaatgtcgggggtggtatttgtctatgaaaaataaaaaactgaccctcggcatcgtagcgcatgtagatgccgggaagactacgctctccgaggcgatgctctacgatgcaggtgtattaaggacgctcggaagagtagataagggcaatacagcgctcgacacagatgaggtcgagaagcacagaggtataacgatatattccagagaagccagactttactgcggagacgtgctgcttcagtttatcgatacaccgggacatgtggactttggtaccgagatggagagagtgctgccggtcttggatgccgcagtcctagtgataagcgggatttcaggagtcgagagccataccaggactctctggaaactccttaggtactataagatcccgacctttatttttgttaataaaatggatactggccgtgtcgacaggcaggagatcttcgacgggcttaaaaaagaactgtctgaaaatgtcattgacttttcaggcgaaaagaatgcttatgaggaagagctcgccttttgtgatgacgaactcttctctatttatactgagaaaaatatgctgccggaccaggcggtgagcgctgcctttgcgaagcgcgaatttttccctgtactgtacggcagcgcccttaaaaatacaggcgtaaaggagctgatggagcttataacctccatgactgttccgggcaggacgaccgaggactttggagcatactgctacaaagtcacgagagagggaaatacgaggctcgtccatctgaagatgacaggaggctctcttgctgtcagggaaaatattggtgaagacaaagtcacaaggatcaggcttttaaatggtgataaagaggagagcgtgggtgaaattgaggcaggcgacgtcgcagctgtcgaaggcctggaccacgtcaaagccggggatgcccttggctcatgcactaaaccaaagcaggcgctccttgagcctgtcatgtcgtttcaggtgataccgccctcggatgtgagtgcacagaagctctacgacgatatgaatgtattaggcgaagaggacccgtcactttgcgtagagtggatagagcagacaaaggaagtccatataaggctgatggggcaggtccagctttcagtagtaacggaggctgtaaagaccagatttggctatgtcgtaacttttggcccggggaagataatgtacaaggagacggtctcggagccagccgagggcataggacatttcgagccgttaaggcactatgctgaagtgcgtcttctgctcgagccgggtgagccgggaagcggtattgtggcagagagtgagtgccctgcagatatcttagataaaaattatcagcagcaggtgctttcgaccttaaatggctatcaccaccgcggagtgctcactggaagcccgcttacagatgtaaagataactctcgtcggaggagctgcatccacaaagcatacgatgggaggagacttccgaagggcaacgataagaggcgtaagacagggacttatgaaggcaaaaagtgttcttttggaaccatggtacaaggtcacacttacgataagaaacgacgcggtcggaaaggccatgaacgatctgatgcagatgggaggaagtacagagccgccgcaggcagtgggcgaggagactgtgcttacaggagaagtcccggtaagctcatttatggagtattcgaagagactttcagtctacaccagcgggcctggagatgtctccatcgagaatgccggctacaggccgtgccacaacgcagaggagataatagaagagcggcattacgaccctgagggcgatacgagaaatcttccgtcctcggtcttctgctttcatggtgctggtgagaatacgccgtggtttctcgtggattcgatggcgaagagcgagcaagtcttaaaaggcgatgacagagtcaactggaaatacactgcagaggtcataaagcaggccgtttcagaagtcgaagagcagtatgaacagcacgaagagaggctgtccggcggaggcgccatggaaagccacagtaccagaaaaggctcgtatcagggttacagcggtatgagcccggatctcgaggagatatttgtaagggaactcggcgagataaagaggcctttttacaataatgactcggtcagggattacgaccgcgatgaaaatatcagaactgcaaaggaagagtatattgcctcacattccgtggcagcggagaagcgccgcaaccagaataaaaaacactgctaccttatagtggacggctacaatgtgatccacgcatcggcagagctttcatcactttttaaagaaaatatggaagcggccaggacgaagctcgtggacgaggtggaaaactatcagggattcgacggagcagatacgatcgtcgtattcgacgcctacaagcgaagcggaagtgcggacagagttatcaagccccgcaatgtgaaggtcgttttcacgaagcaggaccagacggccgatgcctatattgaaaaatttacacaggaacacaaggacagggattctgtcagagttgtgacgagcgatggagcggagcagaccatagctgcaggcaatggagccatcagagttacgtcgaaggaatttttacagcagttaaaggattcacatctatgaagataatgcactgtgcagacatccatctggattcaaaaatggagagcaggctgacctgcgagcaggctgcaaagaggcgtgaagagatgcttatgacttttcatgacagccttgactatgcggcggagcagggtgtgcgtgcagtccttatttcgggtgacctctttgacaagagacatatcaggaaaaccgtaaaggacaaggtcgagcaggagatcgtaagccatagggagatggacttttactatctcaggggaaatcacgatatcacggattttctggacgagatggatgaattaccggggaatctgcaccttttttcaaaggacaagtggacatcatatccgcttccagatgacaatatagttatcaccggacgcgagctggacgcaaaggcctcgcccgatgtcatgagcgagcttgtcctcgaccagtcgaaggtaaatatagtcatgctccacggaatggacagcgagtaccctgtccatgacaattcctatgtgatcgaccttacgaaaatgcgcggcaggtacattgactacctggcactcgggcatatccacagctacagatgggagaagctcgacgagaggggagttctctgctatccgggatgcatggagggcagaggttttgacgagtgcggcaaaaaaggcttcgttgtcctggacattgataaagacggtgtaaaaagccacaaatttatctcgctcgcgagaagggaactacacgagataaaagtagagcttgcacctgaggacgacctcgattcgatcatttcaaaagttaaggatgttttaaattattctccagagaaggacctgataagggttgtccttaccggacgcaagaatatggacttagagatagactgcgactggataaaggacaagactgacaggaattttttctactacgaagtaagggatgacacgaagaccaagataaactacgagacttttgcgaacgacaggtccttgaaaggtacctttgtaaggactgtacagggccttgacatggatgaggagcggaaggccaggatcattgagatcggtatccgcgcgataatggaggggagcctgatcgaatgatacttgaaaaatgctacatagccggattcggcagacttattgacaagaccttcacatttggccctggtctgaatgaaattctcgaggacaacggctggggaaagactacatttgcggtctttattaaagctatgttttacgggatggaatacgcaccgcggcggtcggggcttacggagagggagcactacaggccatgggagacggcctcatacggaggcactctcgacttttcaatcggagagaaaaaataccgtatcgagcgacagttcgggcacagcaacaaggaagacgagttcgccgtctacgatgccgcgactatgcttccggtggatgatttctcagaaaatatcggtgaagaaatatttgaggtcgacagggaatctttcgagaagagtatttttgtgccgcagggttctctcgaaaccgagatcacgagcaggctgaacgccaagctcggcggacttggcgccgttcaggacgatatgaaccgttttgacgtcgcagtgcaggccattgacgacgcgagaaagaaatatacggctaccggtaaagtaaatcccggcaggataaaagttttaaacgaccagatcaagtcccagaaggaaaagtctgaccagatttcaacgcttcagaatgcatatgatgcgaagtcccagatgcttctcgacaagcgcgcagagcttagaaaactcgaatttaaaaagagccagatggctgattcactggcatcgatcgccaggagcgagaagtcggtcggcgcctaccaggccaaaaaggacacgctcgacagacaggaggagatactgaaaggtctcgacgacttctttgcaggtgggcttcctgaagatcgggagatagatgaatgggaagcgcgtgagcgtgagatcgagcttgagaagaatcaccgcgacctcctccgtgaaaaaatacccgacagggacgaacgagactttttaggcaggctttttactgataaccctatctcaaaaaatgacctcgacaactggaagcagcaggcctctgagatcaaatccataaggatgaaaggcgaacatgtccagatgtcggaggaagagaagacgcagctggccgatttaagggaatttttcaagggaggagaacctgcggatgaggagatgcagaaggagctctctgatatcagccgcttaaacgagatctcaggacagatcaagagcttaaatgacacctaccgcaagagaaaaaaggccgtaaagaacactctgcagctccatcagatggaaaacagcgtgatagggactgtgatcctggggattatagcagcggtatttcttttagcgggctttgtctttataaaaataagtgaagatggtattctggctcaggttataggctttggaagctttgtggcgggtgcggcattcctgatcatttttgttacgcagatattaaggagacagcacaataaaagcagatatctctcgtcggctgaaggtgagatagtcgagtcggagagaaatctgggcgaactgaatgatgagtacaacgccttagacgcttctatcaacgacttcattaagaaatatccggtagaggcggaagaccggcagcaggcgatcctcgagatccacagaaaaaaggaccgtttcgacactctctcagcagaggagcagaagtacaacgagaacactttgggaatgatggaggacctctcgtcacttcagctgtcgctgtttacagcgatggataaatatgcaaagatttttaatattgatctctatgaagaggacaatgtcgggaacctgatcagcaagctcgaagaaaaatacgacgaataccaggagtatgagaagaatgagcaggaataccagaggatcgtggcatcgattaacaggatgacgaagggactgctctcggtccttaagactttcccgcttaagagcgatatctccgatctggcagcctgtatcagggagatcagggcgaacgctctcctgtacgcccagactcagaaacaggtcgatgagataaggggagaactcaagtccttccatgtagaagaacttgccggcaatggaaagaccttacaggacctgcagtatgagcagaaacagctggatgagcagatttcgcagcagaaacagtatatcgcagacgacgcgaaggaacttgagaacaggtcggctgaacttctcgaatgtgaggaggccagagaaaaccttaaggaactcaatgcgaaaaagtccgactacgagggaaaggtaaagcttttagaggatacgaaaaagtatttaagcctcgcaaaggaaaaatttcttcaggtctacatggagcctctcaggaacaggctcaattactacctgaaaagcatttatccggatacggacgaagcgatactgacagatgacttcgaactcgatatgaatctgtcagtatcggttacgggaaagagcggcggcgggaagaccaggagtatagactacctttcgaccggctatcaggatcttgcctcattctgctcgagggcagcgcttatagacgtgcttttcaggcgtgagcagccgatgataatcttagatgacccgttcgtaaattttgacgctgaaaaaatatccgacgcccgtcggatgatgcagacactatcggaaaagtaccagataatttacttcacctgtcatggcagcaggacaatgaaataaaagggaggcactatggcaaatataatggattacctcgactggagggccgacgtacctttttcagtgagcccatataacgaggtcgacaaccttattttttccacgatggcatatatagatttcgacggtgtggtcccggggttcgagagggacaggccgctttccatccgtgaggtcaacgcgagatactggagaaaacactcgcacgcggaaattcaggacaggaaggcctttgtgtcggatgctcctttcatccttgaaaaaatgaccggaagccgcaggtaccgcaagcttaaaatgctccactacattaactctgtcaatgaggatatgtctcttcaggtttctgccattacgattctgccgggagatggctctgtatatgtagcataccggggcacagatgatacgcttatcggctggaaggaggacttcctttttgcctataaggacatgacggtaggacagaaggaggccgtggattatcttgaccggactacagactgccttccggatgacatgcccctctatgtcggaggtcattccaagggaggcaatttcgcagtatttgcggcagcattctgcagacaggctgtgcgggacaggataaagacggtctattcaaatgacggtccgggctttgtgcaggaagtcgtaaagacagacgagtaccagtccattgagcataaaatgataaaatatacaccggaattcgagctgataggaggtctgatggtcgacgattcggagtctgttatagtaaaaagcgactcgaccggggcgtatcagcatgacccgttcagctggcaggtactcagagaccacttcgtcttagcggacagccacagtacacaaagcgttgtcttaaacgatgcccttggacgctgggtttcaaaggaaacacctgaaaagagggaggagtttatcaatatcctctttggcctcttcaaggaagctggcgttacgaaggccagcgagctcggaaagaacaggataaagacgtcaattgccatgatgaatgcactcagaaaactgcccgcagatgacagggctacatttctgtctatacttaaggatctggcgcgaagcagcggcagtgcactccgtgatgcgatcctcgatgtagagactaaatcgaatacatggtaaaatattaaaaaagttgttgacaacggtgagataccgtgatagaatactttttgttcgcgcggtggggcatttacgagagatcagaagtactccacgggtgatgatggagaggtatcgaagtggctataacgaggcggtcttgaaaaccgtttgtccgaaagggcgcgtgggttcgaatcccaccctctccgcttcaggaacctgtcacagcagtggcgggttttatattttgccctttatggcatttgaagacctatatccggtgggaactgagtgcggaattcatatgagtgcttacaggacattatacctgataactacacatgcgatgctgaatcgatcagtgttcggacttctggagaagtacccaagctggccgaagggacacccctggaaagggtgcaggtcgttaacagcggcgcgagggttcaaatccctccttctccgctctgacttgtatctggatcagatgcaggccagtaccgcgtggccttgattcaaaaaagaaatgaaaaaagtccttgacaatcgagaccaaacgtagtattatttataagtcgcccggaagggcggcagacagatttcttaaaaagaaatcaaaaaagtccttgacaaacgatgagagttctgatataattaatgagctgtcatcacaagagacagtaagaaccttgataactgaacagtgaaacaaccttgaaagatttctaagagaatttaaatcattcgagtaaactcgaaaccttttaagaacagtaaagaagaaaagctaagcttttatcttagcagttcggacaattattttaacatgagagttcgatcctggctcaggatgaacgctggcggcgtgcttaacacatgcaagtcgaacgagctttatggccacgatcccttcggggtgacggccataaagcgagtggcggacggtgagtaacgcgtggataacctgccatatctgagggataacagctggaaacagctgctaataccgcataaaactgtgggaccacatggtcctgcagccaaagctccggcggtgtatgatggatccgcgtctgattaggcagttggcggggtaaaggcccaccaaaccgacgatcagtagccgacctgagagggtgaccggccacttggacgagacgagacggcccagactcctacgggaggcagcagtggggaatattgcacaatggaggaaactctgatgcagcgacgccgcgtgagtgatgaagtatttcggtatgtaaagctctatcagcagggaagataatgacggtacctgactaagaagctccgctaaatacgtgccagcagccgcggtaatacgtatggagcaagcgtttaccggatttactgggtgtaagggagctaggcggtcttacagtctgaagtgaaaaccctgggcttaaccctgggattgttggaaactgcaggactagagtgtcggaggggcatgtggaattcctggtgtagcggtgaaatgcgtagatatcaggaagaacaccagtggcgaaggcggcatgctggacgataactgacgctgatgctcgaaagcgtggggagcaaacaggattagataccctggtagtccacgccgtaaacgatgaataccaggtgttgggtcccattgggattcggtgccgcagcaaacgcagtaagtattccacctggggagtacgttcgcaagaatgaaactcaaaggaattgacgggacccgcacaagcggtggagctgtggtttaattcgaagcaacgcgaagaaccttaccaggctgacatccttctgacagtgatctgtaatggaacatttccttcgggacagaagagacaggtggtgcatgtttgtcgtcagctcgtgtcgtgagatgttgggttaagtcccgcaacgagcgcaacccttatcttatgtagccacaattcggatgggcactcatgagagactgccagggtgaacctggaggaaggtggggatgacgtcaaatcatcatgccccttatgacctgggctacacacgtgcacaatggcgtaaacagagggaagcgaagctgtaaagcctggcaaatcccaaaataacgtcccagttcggactgtggtctgcaacccaccacacgaagctggaatcgctagtaatcgcagatcagaatgctgcggtgaatacgttcccgggtcttgtacacaccgcccgtcacaccatgggagtcgggaatgcccgaagtcagtggcccaaccgcaagagggagctgccgaaggcagttgataactggggtgaagtcgtaacaaggtagccgtaggagaacctgcggctggatcacctcctttctaagggaaaacgagtagggattgtttcactgttcagttatcaagagggcaggagctccgaatgataattcaacacttctggtgccgatgcgtttgcgggaaacacccgttatgacatcccgaacacgatggttagacgcagacggccgatggtactatgctggtaacggcatgggagagcaggtgggcgccagaattaattgggcttatagctcagctggttagacgcacgcctgataagcgtgaggtcggtggttcgagtccacttaagcccactgccggaccggttgggttggcatataattaaataatcctgttaccttttacaggtgaatgggggcgtagctcagttgggagagcacctgccttgcaagcaggggtcaagggttcgaatcccttcgtctccactgtcatcgaaagagtgacttgcaggtaccttgaaaacttcatacattattagaaaatatctaatgcaatgtttagtatttctctaaagaaatgctaagacatccgagtaaaaccaagaggtctttcagagagatctgagagaacacaaatgcttttaaagcaaagatcaaagagatgcaacgctatgcatcgaagaatcagaaaagactgatcaagcaaaaaagagcgcagggtggatgccttggcaccaagagccgatgaaagacgtgataagctgcgaaaagctgcggtgagctgcacataagccatgacccgcagatgtctgaatggggaaacctgctgcgagcgatcgcagcgtcataacgtaaatccatagcgttatgaagggaacccgtgaactgaaacatctaagtagccggaggaagagaagaaacattcgattccgggagtagcggcgagcgaaaccggaagagcccaaaccacggtgctgcactgtggggttaggaccgcataaatgatccgttgatcttagcaaactgttttggagagcaggccgtagagggtgagagccccgtaagcgaaaggagagacggcatggcggtatccagagtaggacgggacacgagaaaccctgtctgaacacgcggagaccactccgtaaggctaaatactacttggtgaccgatagcgcatagtactgtgaaggaaaggtgaaaaggaccccgggaggagtgaaagagaacctgaaacccgtgttttacaaacagtggaaggccgcaaggccgaccgcgtactttttgtagaacggtccggcgagttgcgcggactggcgaggttaaggcacgagtgccggagccgaagggaaaccagtcttaacagggcgatcaatcagttagtgcagacccgaaaccgggtgacctacccatgtccagataagccgccgtaaaaggcgatggaggtccgaacgcacacctgttgaaaaagatggcgatgaggtgtgggtaggggagaaattccaatcgaaccgaatagctggttctcctcgaaatagctttagggctagcctcggtgcagtcttatggaggtagagcactgaatttcgcgggagcgtcaaagcttaccaagaatatcaaactccgaatgccatgtagatgatcaccgggagtcagactatacgagataagttggatggtcaaaagggaaacagcccagaccaccggctaaggtcccaaagtgcgtgttaagtggtaaaggtgtgtggatttcaaagacaaccagatgttggctcagaagcagccattcattcaaagagtgcgtaacagctcactggtcgagaggtcctgcgccgaaaatgtccggggctgaaacacgacaccgaagcctggaattataataattggtagaggagcattcagagtcagcgaagctgtaccgataaggacagtggagatgcctgaagagagaatgccggaatgagtacgagaggaaggtgtgaatccttccggccgaatatctgaggtttccagggtaaagctgatctgccctgggtaagtcgggacctaaggcgaggccgcgaggcgtagccgatggaaagcagtttaagattcctgcaccctgtccagacagaactgtggggacgcagagggaaagcgcgagccgggaatggaaagaccgttgcagcagaggaggcgcatgggcagcaaatctcccatgcaagccaaagcggtgatgcggagcgaactataaagtagcgaagcgcttgagccactccgagaaaagccgctatcgttctgtatgggcccgtaccgcaaaccgacacaggtagatgaggagagaatcctaaggccgacgaagaagcattgttaaggaattcggcaaaatgaccccgtaacttcgggataaggggtgccttcgagatggggccgcaagaataggctcaagcaactgtttagcaaaaacacaggtctatgcgaaaccgaaagagtatatgggctgacgcctgcccggtgctgaagttaagaggagaagtcacgcaagcgaagctttgaattcaagccccagtaaacggcggccgtaactataacggtcctaaggtagcgaaattccttgtcgggtaagttccgacccgcacgaaaggcgtaatgatttgagcactgtctcgacaatgcatccgtgaaattgaagtaccgtgaagatgctggttacccgcgccaggacggaaagaccccatggagctttactccagtttggtactgggattcgtgatgcatgcacaggataggtgggaggctgagagacgagtgctccggcattcgaagagccgctgttgggataccaccctgcacattggatttctaaccagccgccgtgaaccggcggtgggacaatgccaggcggggagtttgactggggcggtcgcctccgaaagggtatcgaggcgctcaaagcttgcctcagaatggtcgaaaccatttgaagagtgcaaaggcgaaggcaggctgactgcgacaccgacgggtggagcagatgcgaaagcaggacttagtgatccggtggtataaagtgggattgccatcgctcaacggataaaagctaccctggggataacaggcttatcactccaaagttcacatcgacggagtggtttggcacctcatgtcggctcatcgcatcctggagctgtagcaggttccaagggttggctgttcgcccattaaagcggtacgcgagctgggttcagaacgtcgtgagacagttcggtccctatccggcgcgggcggaggatatttgaagggagctgcccctagtacgagaggaccggggtggacggacctccattgtatcagttggaaccagtcccatagctgagtagctgtttctggaagggataaacgctgaaggcatctaagcgtgaagcccaccctaagatgagatatcccgtctttaaaagacataagatcccttgaagagtacaaggtagatagggcaggggtgtaagagctgtaaagctctcagctgactgtcactaatagatcgaaggcttgatcaagagttcgggttagataagagataatgtatgaagttttgaagcgtatctgctttttttataatcctcgatagctcaatggtagagcactcggctgttaaccgagttgttgtaggttcgagccctactcggggagctgatttgaaggactgcatgagcagttctttttttgtataagtgaaaaaacagtatttttataatgtagtaacagtttaggtacttgatacaaactggctcttgtagaggctatagtgagaatttcccgtaaagtaattcaatttcttattagccagtatatatccggctccgcacgagtaaatattgaaattaatttcaagggtgtttgctgtacacttatatccaaagacaaatctcaaaggtttctggtttgaaattttacgaaagtattgcatccaaaaggctctggttagtcttctcgtttatcatcagatcttcatccgtcggattttcctttttttctccgcagatatcgattccaacaacgttatttaagcaaagcgcagtttttaatactgatacaatctgatcgagggtataagatccctgcgaccagtcagtgcgggcgaaatcttcagacatcaaatctttatcgagggaaatatagagcggggtttctatttttttgagagtctctgacagatctgtaaagggaatgtaaaatgtatcctcaggaagcggagattcctcctctatgagcttcgaatcgactccagccataaatatacgtccgaggttaggaaccgtctcacgggcttctcttgcccatcctccgcaggatgtcagaccggcgaaaacaggtggctttgtatcgggatgattgtccagaagaagcagcgaaaatggtacagaaatttttcgcataaagaacagagacatatagtggtagtttccggagtctataaaacggacaaacggagcctgaggaagagaattaaattgaagggtatgtacttcctgagaaaaactatcgatacgctttcgtatttctctgcaggctgagtcatcacagtaacagtttgtcccgggaatatcggacagatcgaccatcggagtcctgtttctatacaaaccactcaaattgaaatataaatattttacaatatcttttgacatttggcacctttttttgtacaatatatctaaacaaatcggaatgagcgataaaaagctccacagatagaaacagtaaagggggtattattatgtatccagttatttctataagccgtgagtttggcagtggcggacattctatcggtgagaaagttgctaagcagcttaatgtgccttttctcgatggcgagatcatcacgaaggcagctcaggaaagcgggtatgccaaggagctcgtagaggaagagggagagaccacttcagctgcgaataagtggttcgatatctctgccgcttctgctatgtatttccagagccctcaggacgagatattcctggctcagaggaaggtcattcttgatgcagcgaagaaaggaccatgcgttattgtaggccgctgcagcgattacattctcaggaatgctgagattccatgcatgacagttcttatccatgcagatatgccgcacaggatttcgagagttctcgacaagtacggcgatatcacgaatgtcgatgtccgcaagcgtatcaggaagaaggacaagcagagacggacatactaccgttattacacagaccagcattggggcgattaccagaactacgacctcgctatcgactcgggcagcctcggtgaagacacctgtgtacacctgatctgcgaacttgctgagaagatggcaaaggagaatgaagctgctgagaagaagattcaggaaagctgaatttcaaatgatcagttgaatcaaaccaaaagaagggctgctgcttttgcaacagtcctttttagttgtcagaatcttttacagtatcttcccagaatctgactgctgtatccatccatccttctgctgatgtatggtaaccgagacctacgccgtgcggcagatcgaaaaacttctcgtatttatatctgatcccgttctgtttcagtgccttcgcaagcacgtccgtatgagcagccatcggaactaaaacgtcatttcccccgccaaacatatagaccggtgggtagtcaggtgtgatccacttctggacacagacagaatcgcgcttgcttttattgaagcgtcctttcagtccgaacatgtaaatatttccgcgctcggagagccagatgcctatcagggcgacccagatattccagtaagggtgtttcatccagtggttgatattagtccacgggtagcctaagataaggcagccgggtttcatggcattgtacttctcatagccccaggctttgcttccaaaaatgcctgccagattaccgcctgcggaaaacccgacaacagcatagtgatccatatctacattgaactgatcggcgcgggctgagataaatctgacagcggcagccaggtcatgcatcggagcatgagatgaacagtcgagcccggcacggtactcgaggacaaaggcagtgtaccccagctcattcagcctggcagctactggataaccctcatctgtcgtacagaggtgagcgtatccaccgccagggcagacgataacacacctgctgcgctttcccgtatcatttagaaaaacggagagccttacggatccccgtttttttcgctctgcgatctcctccatcgaatatacagggaactgcataaatctaccctgatccctgagcactttcatccggcgaagaccttttctcctgttgcaggcgaaagtctttataacgtacatcctgatcactgaaaaaacagtcagcaggaaggacaggataagatacacttcgaagatctgtaatattgtaaatcccagtatcttaaaatgcattaaaatattccttttttatctttatcgttaccgacaaagcgcattctggcaatgttcctggaagccggttcgtctgaatcgaccttgacacctttcagcatcagcttcgccttgcacttgcggcagtagcggccggtagcgatcggggcaccacaaatctcacagaagagaccactgccttctgtactcttaaagtagagacgctcttcacgtacccactggtagagctttctcgtggaaacgccagtgtcgagcgcagtctgtggaagactggaatcgtgggtctccagataatcctttactttatcgaaattctcccggtccttttcgaggcactggcggcagacatctggcccaataccaggataggcaaaaatacggccgcattcggtgcagtatctgagatcgtactttcccgaggctttgctaagacctttaagatccttatgatattcgtctgtcttcataggccgctcctctcaaaaaagtcagggcagaaatgacagatcattcatttatcgtccctgcctgcaaaacgcatctttccgctgccaaacctgctgttcatatatccctttttcttgagtttgatctggcattcagtgcaatatcttccaaaacttatcggtttgccgcacaactcacacctgaggcctgagaggccttcaccaaagcagagcagtccttccctcgcccatttggtcagagtatcgaccgggactccggtagcttcagaaacctcattctcagtagcgtgatgatctttcagataggctttcacccgatcgaaatcttcctgttccttcttctgacactgaggacagatggcttcacctgcgccgctatatggaaagactcttccacagcggctgcagtatctgagttcggtgtgattcttgctttctttatatttcttaagtctgatcaaataatcgcgttcgtcatccatcgcatactcctgctgaaaatcagccgtgtaagcctctggcctggcggtccatatcctcgacaactatgtcgtagatctcgccgagagaggcacagtactcaagaaccttccagggctcattggtatgatagtgaattttgataagatcctcatcgcctacagcgagaagacagtcacctttgaaatgatccttgaaatattggttgatctcatcctcatcgagatcctctccatcaataagaagctgggtatcgtaacggtactctaacatagaaaaatcctcctgtttgtgttcagtcttttatacaatgattatagcgcttttagtgtttttcttcaacaaaaaaggccctgcaatgcagggcctctgtttatataaatcagtttttgttgttaggattgttggcgttattgttcctgcggatcatagctctctttctctggagaggatcgaggattctcttcctgatacggagactctccggagtaacctcaagcagctcatcggtctcgatgaaatcgagtgcctgctcaagagaaagaatcttaggaggtaccagtgtaagagcttcatctgaggaagaagtacgggtatttgtcagatgcttcttcttgcagacattgatctcgatgtcttcgtcacgattgcaggcaccgatgaccatacctgaataaaccttagtaccaggtccgatgaaaagtgttccacggtcctgagctgcgaaaagtccgtatgtaacggcctctccagcctcgtatgcgatgagtgaaccctgagttctgtaggcgatgtcgcccttgtaaggagcgtagccagcgtactcggtgttgatgattccattacccttggtatcggtcatgaagtcacctctgtaaccaataaggccacgggccgggataaggaactcgagacgggtgtatccgccgttaatcgggcgcatgccctgaagctcacccttacgggctgacagcttctgaataacgactccctggaactcatccggaacatcgacataggccttctccataggctcgagcttcttgccgttctcatcgtaatgatagaggacctcagccttgctgactgcaaactcgtatccctcacgtctcatctcttcgataagaactgagaggtggagctcaccacggcctgaaaccttaaaagtatcagggctgtcagtatcctcaacacgaagagaaacatcagtgttaagctctttgtagagtctgtctctgatgtgacggcttgtgacatattttccttcggttccggcaaatggactgtcgtttacgatgaagttcatcgcaatcgtaggctctgagatcttctggaatgggatggcaacaggctctgcatcctcaccgcagatcgtatcgccgatgtggagatcagagatacctgaaatagcaacgattgagcccatcttcgcttcgtcgacgtcgaccttgttcagtccctcaaactcatagagcttggtgatacgaacattctccttcttagaaggatcatggtggtttacaacgacgcagttctggttcagcttgatggaaccatttgaaacttttccgataccaatacgtcctacatagtcattgtaatcgattgtcgaaataaggacctgggtattggcatccggatcgccctttggagccgggatatactttaaaatagcgtcgaaaagcggagtcatatccttcttctcatcgccaagctcctttatagcgtagccgtctctggctgaagcatagacaaatggagcttcgagctgctcatctgtagcgtcgagatccatgaagagctcgagtgtctcatcgaccacttcttcaggtcttgcgcccggacggtcgatcttattgatacatacgataacaggaaggttcaatgccagagccttcatcagaacgaacttcgtctgaggcataacgccctcgaatgcatcaacgaggagaacaactccgtcgaccatctttaagatacgctcaacctctccaccgaaatcggcgtggcccggagtatcgacgatattaatctttacgtttttatactttacagctgtatttttggacaggattgtaattccacgctcacgctcaatggcacctgagtccatgacacgatcctgaacctcctgattcgcccggaagacaccgctctgccttaacagctgatctacaagcgtcgttttaccgtggtcgacatgggcgatgatagcgacgttcctgatatcttctctagtctgaatcattttaacacctcatctgatatattaatattttatattacaaagtaacttatatattatatcattccaaaagcacaaaacaataagaaaaatgacgaaattacttctaatatgttcgaaaatttaggcaatatgaccgataagactctttgcgaaaaaatgtgttttgtgataaaatagcatagattatatggtaacggcagcagaggctgagaactatcatagaaaggtacttatgtcaaagattcaggtatattacggcacgggtatgggaaagacatccgcagcactcggcaatgctataagagcggcttcgaatggaaaaagcgtctacatcattcagtttctgaaaggtcagctgaacgaggagtactttaagcggcttgagccggagatcaaagctttttcatttgagcggtccacgcacaactttaacgagcttggtcctgaggagaagaaggaagagaagcagaatattttaaatggactcggtttcgcgaagaaagttcttacgactggtgagtgcgatattcttgttctcgatgagttcttaggtctttccgatgagggaatcatttcgaaggacgagatgatagaccttatctctctgggatctgactctgtgcagcttattcttaccggcacgactatgccggagggcctcagggaaagatgtgaccagatttttaacatcaaggatgaaagcaatcagtaaaaggagaagaaatggctgtttttaaaggagcaggtgtggccattgtcacgccgatgaacgccgatcagacggtgaattatgacaagctcgaagagattatcgaggagcagatcgctggtggtacagatgctattattattgtgggtaccacaggtgagggatctacacttacgatggaagagcacagcaagtgcatcaagatggcagtagagttcgccaggcacaggatccctgttgtagctggtacaggcagcaactgcacggctacagctattcagctgacacaggaggctgaagagcacggagctgatgcggctctcgttgttacaccttactacaacaaggctacacagaagggactcatagctcactacagcgctatcgccgattcgacgaagctccctatgatcctttacaacgttccgggcaggaccggtaccaatatcgcaccagagaccgcagcatatcttcacaagacgaagaagaacatcgtcggtgttaaggatgctaccgctaatctcgccgagacttcagagatgatgcgcctctgcgacggagacctagagctgtattcaggcgaggacggactcgtagttcctatcctctcagttggcggcatcggagttatttctgtagtatcaaatatcgctccgcgctacgttcatgagatggtcatgagtttccttgcaggagatattgagaagtcgagaaagatgcagcttaaagagcttccactagttgacgcactgttctgcgaggtaaaccctatccctgtaaagacagctatgaatctgatgggtaaggaagtcggaccgctccgccttccactctgcgagatggagccggctaatcttgagagacttaagaaagctatgaaggattttggattactatgacgaaggttattataaatggcgcgaatggccacatgggtcaggtcatcacgggtatagtgtcgaaagacgccgactgtgaggttgtcgcaggtattgacccatatacagagaagaagaacgactatcctgtttttgctgcactatcagagtgcgatgttgatgcggacgttatcatcgatttttcaaatccgaaggctattgacagtctgctggatttcgcagtagagaagcagatacctgtagtcctctgcacgacaggtctttctgataagcagatcgaggaagtgaacgaggcatcgaagaaggtcgccatcctccgttcagcaaatatgtctctcggaatcaacacattcttagagcttctcgagaaggccacgaaggtttttgctgatgcaggctacgatgtagaagtcgttgaggctcaccacaatcagaagctcgacgctccgagcggtacggccattgctttggctgacgcgataaacgaagcagcagatggcagatacacctatacttacgacagacacgaccgcagacagaagagagatcctaaggagattggcatctcatctatccgtggtggaaatattgcaggaattcacgagatcatttttgcaggcgaggatgagatcatctcattcaagcatcaggctacatcgaaggccgtttttggaaaaggcgcagtagaagctgcgaagttcctgaacggaaagcctgcaggtctctacgatatgagacaggttattgcagccaagggctgaagaaaatttcatgagaaaagagccgccagtgatcgatttcactgacggccctttttttgtacttataaaaattattttgtggccttaagtgccttcttttttaagaatacgtccttcaaaactgcaggatggaaaaggataagcatcgggaacagctcgagacggcctgacaacatatcaaagataagcactatctttgaaaaatatgagaggtccgcaaagtttgccgacggtccgactgctgcgaggccgggtccgatgttgttgtaagtggctgctacagcagtaaaggtagtaaccaggtcttttccctcaatcgatacaaggagaacagacactacgaaaataactaagtatgtgatcgtgtagacatttatcgaacggagcacatcgtgttctacgcactctccgtccatttttatcttctttacactcttaggatggatgtaggagttggcttcctttatcacggtcttgatggcgataacaaggcgggagaccttatagccgccaccggtagagccggcgcatgcacctacaaacatcagcgctacgaggatcaccttcgaaaatgacggccagaggttgaagtccactgacgaaaatccggtcgtagtgatgatactgcttacctggaagaaagaggctctgagagccgattccacggtgttaaatctcggaaggatgttgaagaaaataaggaatgtagatgcgaagatgatacagaagtacgttctgacttcctccatcttgaaacttttcttcggctccctgtcgagaatataatagtaaaagttgaagttcacaccaaacagagcacaaaaaattcctgttatccactgctgaagtccggtgtaacttccacagctgtcgtttcttacaccgaaacctccggtgccggctgagccgaatgagatacagagtgtatcaaacaacggcatttttgcgatcagcaggaggacgatctctaatacagtcatcccgagatagatcttgtagagaatacttgcggaatttctgatcttcggtgcaagttttcctactgaaggtcccggagattctgccttcatcaggttgatattcgatccacccgacataggtattacagcaagaaggaatactaagactcccatgccgccgacccagtgggtaaaacttctccagatcagagaggtgtgtgaaagtgcttcgacatttttaagtatcgatgatcccgtggtggtaaaacctgaggatgtctcaaacatagcatcgatgaaattagggatctcgccggttaacacgaacgggatcgctccgattatggagatcaaaatccaggtcagggcagtgactacgcagccttctttcaggtaaaacatcgtgtttttgggcttttttctgctgagaagctgtcctgcaaggaagcttgcggctccgacgatgacataggcaaaagcttctttttcctggtaaataatgccggtgactataggcaaaagcatcagagctccgactatagtcatgacttttccgattacgtatttgattatagactgattcacagaaaaatggcccccttatgcgagaatatcgacaatatcagagaaaccggtatgcgtagttacgatcattaccgtgtcgccaacctcgatcgtatcttcacctgttgggaaaattatacggccgtttctgtttataaatgagaccataacatgtccgcgcaggcgcagattcttgaggggagttccagtagctggtgaaggctttccgatgcggaactcgatagcctcaaccttgtcatcgtacatatggtagagcgtctcgatatttgaatccatcgaggcgcgcttggctctcgcgtaggcgataatggcctcggaggtgatgatacgcggatatacaatgctgccgaggtccaggttatttatgacatcctggaatgcgaaacgattgatcttcgtgacgatcttggccttgctgacctgcttggcatggagggtaaggaggatgttctcctcgtcgattccggtgagaggtacaaaggcgtcggcagtctctatgccttcctccttcagaagctctgcatcagtaccgtctccatttataattatcgcgttcgggagaagttcggaaagctgctcacagcgctcttcgtcgcgctctattatctttacggaaatattttcaccgataagctgctgggcgagatagtatgcggctttgccgcctccgattatcatacagtcgcggacatgaaatgtagggatgccgagagactgcagggcatttttgccgtagtggcgggaggttacgaaagataccatatcacctgcggcgaagacaaaatttccgttagggatgatagcctgcccgtcgcggaagacggtggtaaagagcagattcttcgtctctttggcaacgctgtagatggccttgcctacgagctttgaactttcgtcgactttgaactttatcatctgtgcttcgccgtgggcgaacgaattgacctcgagtgcgctcggaagatagaggatacgcgcaacttcaagagcggcctccatctctggattgatgatcatcgcgaggcctaatctgtcacgcaggtagttgagctctgtagagtactcagggtttctgactctggcgatggctgagcactttccgattctcgtggcaatagtgcagcagagaaggttcagctcatctgaatctgtaaccgcgataagaaggtcggtatcgtctataccggcctctttctgcaggctgtagctggcaccgtttccgacgatgcccataatatcgtattcgttagtgacatcactgatcttctgtgcgttctcgtcgatgatagtgatgtcgttgccttcttttgagagctgtgcaataagggtgcggccgactttgccacatccgacaataataatatttagaggcttgacctcagaggggtcatcctttgaaaaaatacccatggtcctccaaccttaaagtgttccgaaaattctgtctcccgcatctccgagtcccgggcagatgtaagcgtctttgttcagctctctgtcgagatggccgatgtaaatctgtacatcagggtgttcattgtgaagtctgatgacaccctcaggtgcagctatgatgcacatgaatttgatcttctttccgccgtgctgcttgatgaaattgatagcagcagaagcggaaccgcccgtcgcaagcatcggatcgacaacgactatagtacgctgctcgatagggcttgggagcttgcagtaatattcgtgaggctcatgtgtcttcgggtctctgtagagtccgatgtgtccgacctttgctgtaggaacaagagaaagaactccgtctaccatgccaagtcctgcacgaagtataggtactacagcgagcttctttccagccagaactggcgtcttgcacttctcgatcggggtctctacttctatatctttaagaggcagatccgagagagcttcaaaaccctccagcatcgcaatctcacctacgagctttctgaactcgtttgttccggtgttcttgtcgcgaagacgggaaatcttgtgctggataagagggtgagtcattatctttacgttctcaagattattacaatcttccattttccactcctttatttaataaagttcaaaagcgtgacttttgactcttgcatcatcatattatattgagtattacgggtttagtcaagacatgaaaaaaccgccatctctggcggtttgcagtcatcagacgcctacgtctatgtggcggtagagtttctttgcgatagaattcagagaactcataaaatctgaacctttcccgaacatgtcctcgaaatccgcctcatcgatattgtcaaaagctgactcggaaagcttcatgtatccgtcatcatcaaaggtgactccgagatcatcgagttcgtcgctgtacttctcgcggaggctcttcatctcatttacagctttcttagcatctcgattcgaagagtaggatgaactggaatcgactgtattgttgtaagtgtcggcgaaggccttcatcttcttataaaaatcggccttctcgatcttgttgtctgtctcgtccgggtcaccgtagtctacatcataaagagtgctgatgctcttctgaagagccgctgtatctgcgataataagcttcggagtcgaggtctcttttctggctgacttctttgtaagtgaagtatcggtcgacttatataaattcctcagataaagattatttgtaactgtgtaaccgctcatatgataagtctcctttataattttatcggaaattttttatgaaaataaactccctatggaaaaaaattaccgaataatgtattatgtaaataatttataaagaaggagctttctatggatcaaaaagaaaaagtcatcgtgatcgatttcggcgggcagtacaatgaacttgtggcccgtcgtgtcagagaatgcaatgtctactgcgagatctactcttacagagaggacattgagaagatcaaagctatgaatcccaagggaataatcctcacgggcggcccgaacagtgtctatgaagagggcgctgccacctgctctccggaactttttaacctgggaattccggttcttggtctctgctacggcgcacagcttatgatgtatgtgctcggcggaactgtagagaaggcagaggagagagaatacggaaagactgaacttacgattgatgagccgggttctctggtattttccggagtgtcggagaagtcgatcgtctggatgagccacaacgactacatcacgaagacggcagcaggcttcaggacaatcgcgcacactgcgaactgcccgtacgctgcggttgaagatactgatagaaaattattcggattccagttccatccagaagtgctccattcacagtacggcagtcagatgcttaaaaatttcgtactgaatgtctgcggatgctctggcgactggcgcatggacgattttgccgagagcactatcagacagatccgcgagaaagtcggagatggcaaggctctttgcgctctttcaggcggtgtcgattcgtctgtagcagcagtcctgatgtcaaaagctatcggcaggaatctgacctgcgtcttcgtagaccacggtcttctcagaaaagatgagggagaccttgtctcaagagtatttggaccggacggtccatatgacctgaactttgtcagagtcgatgcctctgagagatttttcaatgatctgaatggtgtcattgagcccgagaaaaagagaaagatcatcggcgaggatttcatccgcgtcttcgagcaggaagctaagaaaattggcaaagtagactacctggttcagggaaccatctacccggatgtcgtagaatccggcctcggcggtgagtcagcaaagataaagagccaccacaatgtcggaggccttccggactatgtcgatttcaaggagatcattgagccgctccgctatcttttcaaagatgaagtaagagccgtcggccgtcacctcggtatcccggatgagctcgttatgcgccagccgttccctggcccaggtcttggaatccgcatcatcggtgaagtcactcctgacaaggtaaagatcgtccaggaagccgatgccatcttccgtgaggagatgagcagggcaggtctcaacaggaccgccggccagtatttcgcagccctcacaaatatgcgctcagtcggagtcatgggtgacgagcgcacctacgactacgcgatcgcactccgcgctgtaaacacagtcgatttcatgacagcagacatcgtcgagataccgtacgaagtcttaaagacagtaacttcaaggatcataaatgaagtgagccacgtcaatagagtactctacgacatcactagcaagccgccaggtacgattgatttgatgataaagcgtgagacacagattgcgtccgcctcgcttttgcaagctcgcttgcaaaagcgaggcggacgcaatctgtgattgaacctaacagacagcgagcagaagcgaagcggatgcgagctggatggtaggtgactcacgctttatcacgtagaggaaaatattataatatcagtatagaaaaacatagaaagccatgagaataaagctctcatggctttttgtcacaatagcataagtttatccgcgacagcaccagttttgcctgtggaattccagatgattttcacaatagatacatttacagatttacagcaccatataagcattagtatagtgcatggtgttttcaccatacgcatgaaaaaagtcggtcggcaccaaaattctggaaaattattggtactattacagacggtttgaatctatagtgaaaatatctgcttgacaggaaaattttgttggtgctgctgtttattgtacagatctgttgtgaaaatatctgaaaagctagtagaattattgggtgttgtaaagaggttatcagatatgaagtacaagaaaatttacacctgtaaagatgatacagaggcggcagtaattctgggaatgctttcagcatcaggtataagagggatgtcccgtgatgtggaacagggggatatcatgaatgtgatgtccggtactacgctgtacggaaaggaaatctgtgtgcctgtggatcaggtggagaaggcccggagtctgatgaaagattatgattctgcggcagagaaagaagagacagtaaagaagccgaaggtacggattccatatcttatcgtgctggttgtatttgtggtagcagtagtgctggcaatagtgatgagttaaggaggcgtactatcttgaatagtgcatttggaaaaatagcagtggggcagatactgctgatcatctgctgtattttttacctgatatggtggagcatatcttacaggccaggcgttgaggtgaacagggcgggaggactgaacggaatcctgcttatgatcacggaggccataagtatggcggcagtgctgcttgtaattaggggcccccgcgaagcctgcttcgtggggagaggaggagcagcggaacggatcttgcagtcggctgtttttcaagccggctgcgagggagtgaagcttgcgatgacgaggctgctaatatgataggtgtgaaaaagaacatcattgccgtaagtatgggaccggtagatgtggtcatgttcaatcctgtcatcatgcgaaaggcaaaaccatatgagacagagtttttctggctttattgcagaaataatccagcatgaggtcgaccatctgcaggggattctgatttagattatagttatttgtataaggacagtggtttttgcgcctactgtcctttattttacgcagcttttgagaaatttataaatgaagatcattgttcggtatttgaatttataattctttcaatagctgtttcaggggctagtagttcattagcgatgtaagcatggactgctaaaaaagcttttacgaacgcaaaaatgaacgcaaaaaaatacgcttgtttttgcgttcgctttgtgctatgatacagttaaaataacggaagaagggataacgaatatgaaagaacagaaaaatttggaatttaaagaatctgttaccaatacttttcttaaaacagtaagtgcatttgcaaattatggaactggacgtatcaagtttggcatacgagacaatggggatattgtaggcatttcagacccggagaaaacatgcctcgacattgaaaatcgtataaatgacagtattaacccggtcccgcaatatacgttaagcataaatgaaaaaaattcagtaattaccttggaagtggaggaaggtcttaataagccatatttgtataaatctaaggcttatagaagaaatgatactgcaacaattgaagtagataggctggaccttacaaggcttattctggaaggacagtcgtcttcttttgaggaactgccgtcaaaaatggaagatcttcatttcacagatctggagaaaaaacttaaatccgtactgcaccttgaaaccttttcaaaagacactcttaaaacattggaattgctggataacagggacaacattaatatagcaggagaacttcttgcggataaaaacagcttcagtggtacggatattgtacgttttggagacagcatcagcattatgcttgacagggaaatacatgagcatgaatctgttctgcttcagtatgatgaagcagtcaatatgtataggaagtattatcaatatgatgaaatcaaaagtattacacgagaaactgtaagcctgattccagaagatgcttttcgtgaggcagttgctaatgcactggttcacagagcatgggatatatcgagcgatatcaagatcggtatgtatccggaaaaaatagaaataatatcgccaggaggattgccaaaaggtgtaacagaagaagaatatctacgaggcggaatatctgtactgcgaaatcgcattttggggaatatattctttcggttgaatttgattgaacgtttcgggacaggaataagaagaattaatgaagcgtatcatgacagcgaaaagaagcctgtgtttgatatttctgagaacagtatccgtatatcattgcctgtggtaaatacagataatattcctaatacgcttactgaggacgaaaataaaatatataggctgctgaaaggctattctatggcaagttcagaaatagcagaaagagctgcttttggaaaaacaaaaacggttaaaatcctgaaaaaattagtggaagacgggtatgtaagatcaaacggaaatgggagaggaaggaaatattcagtagatttgtactgactagttgatatgcatagagttatagcggtcagaagaaatagctgtccgtatgattaaaaaagaaggaaaagttatgatgaaattatctatgttccaactgttgaagactttgaaaaagaaagatcttcggctgaaagcaatattaaaataaaacctttaaaataaaatttctgtaatcttaggacgaacggtagtaaatcggtgacgaacggtattgaaaggccgctgaaatacatggtaaaattatagtcgtaacaaagaaatgaaggctattgggaaaggaaaaattcaaatggatttatatgcgattgtaggattaattagtggagcgattgctgcctgattgctgtttctttataataagaaaaaaataaaagtacctatgtgaagaatatcacttttcttgatgtgtgtaaagacaaccggatttagaaaaagtaaaatctaaatggaaacaaaactgtacaaaggatttcgtgaagtgagtattgatgctggtggaaaaaaactagcatgggcttttggtatagttggcggaattggcggtgcatgtggcggagttgttgctggcactggtgctggttctgcagttccaggaattggtactgttgcaggtggcattcttggtggaattggtggtgcttcagcgggatttacggccggttttgctgcaggacgtgcatactaaaatttgcagagaggaaaagaaaatgaaatttattaatgaaaaagataaaaaaagatctatgatattatttttaatgctaatagtatcgcttttttttgtaccatatatttcaaatccgggtatacgttttgcgatttcatttttactagtcattctatttattaatgctgcagttataattggtaagttatttaaatatattaaaaaacacaaaaaatagaactgcaaatttaaataaaaaacatagtgcattaaattggtttataccagaactgatttctttggactaaaaattagtcaagtccaaatttgtgtgtaaattaccttttggtataacagtcaggcaaccagcatacctctttgattatcagctataactttaagctcagagcgtatgtctgatgatatcaactgttgataagttgctttactgaatgcagctttacgtacagcatatgcttcgttaagttccattaaagcggaacccatcaggcggatcagtgacctctcatttgggaagataccgataaccctagatctccgctttagctctttgttgatccgctcgatatgattggatgtgcggtaatacttacgcatcccggatggaaggtgcataactgtcattgagctctcaaagccttcatccagacactgcattgctgcttctgcaacatcggaataatcgcttatgatccggtcttttattttgaccgcttcatcttcggtctttgcgttgaacatttcagtaagttcagtgcgaaggcctgactgatatttcttaggcgctttgtcagctatgttctttgaaaaatgaaactgacatctctgccatgggactgacggatcaaccacctttgatacttttcttgtagaaacgccatttactaccatctcggccattccagctacaagagctgcctcactcctggaatagttttcaaagatcatagtcttaaaaggctgattacgatgacggggaacagtaagcgttatcctgccgatccttgtgtttaatttgcgctcacggctgccgttacggctgtctgtgcgatcatcagaacgttcatagcgatctggtttaagctgttcagttgattccgccttgagcacgctgtttaggcagttctgcagtaaagctttgaaagcatcatcacgattttctgaaagtaactgtagaatttcttcctgatttagtgtaatattgagttgagccattgaatcctccctacattgtcaagcactttttgcctgaaaaataaaggttttcattgttcctcaaaataaagaatgagtcaaatattgtgagcatttctgtgtatctggtacgaaaatagcctattcagggtcactttttaaaacgtctcatatctcgttttaaaaggccttatgtatacccctgtcagctatggcagcgtacctcccatgtctaccgggatctttgtcccaacttccttcgttccgcctgcccacaaccagggtgtcagcttagctccttttcagtcgtgccctatggaaaaaaattcctgccgactactggctcattctttgtaaaacttactgaccagtatcttccacaacagcaccttgcggtggacgtttacctgctgtttccaaggcatagtctttgcctgtgtgctacattctttacatcgcagctggcctcaaccgactcatatgctgtcggctcaggacagctgctgcgatgtgcttggtatgctacctatttctaagctgccactatctctgtgtccatatctttcttcgtatgtctctaagcatctttgtgccatcataatctacgccttttgccaggattacataaaagattctgatcagcttgcaggcaaccgcgattatagcctgcattctctttaacgggttgtcctttcttgtccggtagtaagtatacaattcctgaactctgcattcttgctaccacagatactgctgcttcatacagcacatatctcagcctttttgtcctcgatagcttatggactttctcctttgtgctttccggaactggtctcactattgcgtattgcaagtttctgaagctgtcttggtcctcaaaacgtttatgttcctacttcagcaacaaacccatacgccgttttttcgcctatccccggtatctcaaggagtttgttaacataaggtatatcaatggtcttctcattcagcttttctaacagttctgcaaccctatgaagtatttgtcatagttccagtagctccgctatctcaatccttgctgcctcatgggcggtctgcttccctatgcgttcagcgcagcttcgtatagctcaacagccctcttgtgtccggcgccgcggatttttgctttctccagtcttctctatgccgtcagctcccagtttcacaatgtcttccgggagaggcgcctcatgaagaatcattatccctgttatcggatcggcggtgtataaacgtctttgaattcagggaaatatatgctgaaccatctcgcaagcctgttcgttacgcgtgtcagttcttcctgtgcctggtatctcagggatgaaagcaccctcacctctgcatatacaccttccggtatgtagggtatctggtaccttccatctttcaccagctgtatcacttggatccttgcggtcagtcttcagtggattactgtcatccagctctttcgcctgttcatgatatggattcacgagaacggtctcattccatgagattggagaaatgcgcccaagttgaaccagtaatggccggttggctccattcctggtattacggcatcgagtccattctttgatttgagatcctccatccacgccagaaacatatagtaacctcttcactatttctaaactcgaagggttccgcagagatctctatcctctgtgtaaacgctctggcgtcatgcttctcactgcctatatcgatccccacgatcattgtcgtctctgtgatagccctgatcctggcattctgtgatctgtcgatttttggcattacttctggtcttgtgttactattcatgtgatactctgttctatatgttttaccaactatgctgagtcagtaaacttattttacattgaggtattactttttatcaaccttcctttccggaattccttatatatgtattatacaggaagctccttttaggtactttgtttattttcgtcgatttacattataccaaaaggttgagccagtggctcttcttaattttcgaatttacaccattatacagactttatctctagatacaactcaatcttataatatttgtagacataagacaccagtcaattggtgtcttatttttttcttgaaaaataattagcaatgaatctaaataatatgtaaaattctaaaaagatattgaaaattaaaaaataaaaaattatatctgtgtttgacatataatatatttaatgatatagtatttatacaaattgcaaaacatatttaattatttagaggtaaagcacatgcagcttacagaacgtgaagacaaacttatgaacatgctctgggatgggaataaggaactaactatcgaggagatgaaggattatcttggtccggaggagttctctcatgccacactttttaagatggtaaaagcacttgaaaagaaaggtcttctagaggtctgcggtctcaggaaaagggcaaaaaattattcaaggatattcaagccgtcaatgaccaaggaacagttttataccaagtatatcctgagcaggaatttcagcagtaaaggtctgattgagatatcggcagcactgactggggcagcaaagcctgagaatgatgaggaacgtgacgaggagattgaacatctacaggctataattgatgaccttaaaagcggattaaaagacagaaaatgagaataacgttgtattcatgtgtatcgacatttatatggaccagttttttcatacttcttttatatatactgagagtgcggcttaagcttacagagatatgcagcatagagagcacgatacttatctatatattttgtgtggtaaggctcctgttcattgtagaatttccgtggactaagaattatgagtgcggatatttattcaatccattatatacatttctaagaagcaatgttgtaaacaacagcggtatcaggctaaagacatatgaattatttcttatcatctggctgtcggggattgcggctggattaacatttgtcatcacaaagtatctgacattcgcaaaatatatgaaaaagatggtgtttgtcagatgtgaggatgattacaggatgtttgaaagaatatccgataggaaagatattacaataaatgagtgcaaagggataagtagctctttttgttatgggatattacataaaaacatagtgctccctcagcgtgagagaacggatgaagagagattttttatcatacggcatgagtacgcacatatacagaacgacgatctaattgtaaaacttatgctcaatatcttttgcgcaatgttctggtgggatcccttcgtatatctgctgataaggagaatgaaccagtcgtttgagatacgctgtgatcacagggtgatcgaaggtattagcgatgatcagcgtgtggcgtaccttgagacgatattaagtgaatacaatcgtggtggcagtacaggaaaatgcacaatctctgagttttcacccaaaagacaaactgatatggaagaaagattcattgaagtatcacgttaccgcaagggacagacagggaaaaagaaattcctgatagttatgcttgctgtcatcataatggtgatttcatattcatttgtatttatgccggaatatgaagctccagtaggaaataatatggagtttatcaatgaagatgtacatgtatatgaagaaaacggaaaatattattttaactataacaatgataagagagaaataagcagggacatgtatgaaaaactaaaaaacaaataaaataattttacttaaaataaaattacttttatatgtgaaaataactaaatatttaatgaagggaataatgtattattatgagaaaaaacaaaaataagtggcatatgatattatttattttcttacttgctattatatttcttgctcctaataaggcttttgcagaaagtattaattcacaaaatcaaacttttattgaattttttagcaaagatgatattacagtcatgtacaggcgttataaaggtaaatatcaatatagaagatggaataagacaaaaaataagtgggttgattcacattggataactataggatgattatagtatttatttaaagagacctattagtaattgaactctttgttgtattatttatggttgcaatcagagttgacagagaatatagctattatatgtcttcagggatactttgttttgctttgatattattagctaaagttttcagacaggagcttcctgtataatacatatataaggaattccggaaaggaaggttgataaaaagtaatacctcaatgtaaaataagtttactgactcagcatagttggtaaaacatatagaacagagaggtatatagaacagagaggtatcacaaagaatagtaacacaaagaccagagtaatgcaacaaaaatcgacagatcacagaatgccaggatcagggctatcacagagacgacaatgatgtggggatcgatataggcagtgagagcatgacgccagagcgtttacatacagagggatagagatcttgcggaaccctcgagtttagaaatagtgaagagggttactatatgtttctggcgtggatggaggattcaaatcaaagaatggactcgatgccgtaataccaggaatggagccaaccggccattactggttaacttgggcgcatttctccaatctcatggaatgaggaccgttctcgtgaatccatatcatgtaaacaggcgaaagagctggatgacagtaatccatgaagactgaccgcaaggatccaaaggtgatagcagggctggtgaaagatggaaggtaccagataccctacataccggaaggtgtattgcagaggtgagggtgctttcatcctgagatccaggcacaggaagaactgacacgcgtaacgaacaggcttgcgagatggttcagcatatatttccctgaatcaaagacgtttataaacagcccgatccgataacagggataatgattcttcatgaggcgcctctcccggaagacattgtgaaactgggagctgacggcatagagaagatctggaggaaagcaaaaatccgggcgccggacacaagagggctgttgagctatacgaagctgcgctgaacagcatagggaagcagaccgcccagaggcagcaaggattgagatagcggagctactggaagactatgacaatacagtctagggttgagaactgttagaaaagctgaatgagaagaccagtgatatacttatgttaacaaactccttgagataccggggataggcgaaaaaacggcgtatgggtttgttgctgaagaggagacataagacgttttgaggatccagacagcttcagaaacttgcaggatacgcaatagtggagaccagttccggaaagcacaaaggagaaagtcacataagctatcgaggacgaaaaagcgtgagatgtgctgtatgaagcagcagtatctgtggtaggaagaatgcagagttcaaggaattgtatacttactaccggacaagaaggacaccgttaagagatgcaggctataatcgcggtgcctgcaagctgatcagaatcttttatgtaatcctggcaaaaggcgtagattatgatggcacaaagatgcttagagacatacgaaggaaagatatggacacgagatgtggcagcttaaataggtagcataccaagacatcgcaggctgctgagccgacagcaatgagtcggttgaggccagctgcgatgtaaaagaagtagcacacaggcaaagactatgccattggaaacagcaggtaaacgtccaccgcaaggtgctgttgtggaagataaatggtcagtaagttatttacaaagaatgagccagtagtcggcaggaattttttccatagggcacgaccctgaaaaggagctagctgacaccctggttgtgggcaggcggaacgaaggaagttggacaaagatcccggtagacatgggaggtacgtgccatagctgacaggggtatacataaggcctttaaaaagagatatgaagacgttttaaaaagtgtaccctgaataggctattcgtaccgatacacagaaatgctcacaatatttgactcattctttattttgaggaacaatgaaaaccttttttcaggcaaaaagtgcttgcaatgtagggaggtgaaagcgatgattaacaagaaaaatgtgaagggaggactacttaatgacaaagattgaagagagagatgtgatgcttaacttatcgcattagccactatatgtggatggtttgcacatcagccgaagagacctgatggagttagaaacattagaccaaagatacaaccctaaatgaatagtagagccaaaattttggttgtgagcagttggtgagaaggatactagaacggatgatactgaagacatgaaatgtcaatgctatagcgtaaaagactttaaaaaacttgtttaaaatgcaaaatatagtgcttaataatatcgtgcatagaagattaaaatgaaaatattcaggtgattatctgctgatagcggtggaaacgaaaagactattctatttcaaaaagttaaggtaatagattctataattagtgtctgctgattagcaaaaaatcttaaaaattgcctaaaatacgcgatttctggctcaatatagggtataatagatgcatggatttttgatattcattcatcttttcgtgcagtttctgaataaaattttactcggagcattaaaatcgtgttaaagcaaaagataagtcagagtattctttttttgatttcaatcagccgctcgggatgcacatgaacccggaaaaccgctggatcaggctggcagagctcattccatgggatgaatacgaagaaaagtatgttcccgtttcaagagtgatacggaaatgtcgcaaagcatgcaggatggctctcggagcactgatgatccagaacgtttaggcttctctgacagagagcttgtagaggagatcacagagaacccgtatctccagtatttcatagggctcccgggatatcaggagacgccgccgtttgatgcgagcacacttgtagctttcagaaagcgcatagatctcgacatgagtcagttcatgaatgacatcctgtgaagaaaataaagcgaagcaggattcagagaacaaagaccgcatgataagaacgacaacggaagctccgaaggctcgctgcagtaggaagaaaatctgacaagactgaaagtcctgaagctgctgataaagatgtaaacagcggaacgctcataatcgatgcgacatgtgcaccctcatacatacgttatcacaggatttttcactgctgaacgaagccagggaaaaacttgaagatatcatcttccgtatctgcggagaaacggactttacagaccgcgtacttactgcagggaggcaagaaaggattacctcaaccttgcaaaatgcaagaaacgctcaaagaaaaagatcagagcgacagtacgcaagcagctgggctatgtgagacgcgatctgggctacatcgacagatatatatcagacggatatgcacttctgccaaaagaagaaaagcttcagatacgatcagaaagctctatgagcagcagaaatacatgtatgacaacaagacgcataaagtagccgacaggatcgtaagcatcgcacagccgtatatcagacctatagtgagagcaagacgaaattccgtggattcggtatcaagttcgactcagtatcgatgaggaccacatgggaaggatcgaaaagataaattttgtccatacaatgaatccgaagtccttaagagagccgtggaatcatacaaaacaggacaggacattatccggagcgtgttcttgcagatcagatctacagaacaagagaaaaaagaaagttctgcaaagaaaacggcataaggctctcagggccaaagtcggaagacgtcaaaggaactcagtgctgaagaaaagcacattgaatataaagacaatacagacaggatcgaagtggaaggagcttcagcctcagcaagagagctacggtctgggactcataaaaacaaagcttgaagaaacatcatacggtctgagggctttccatctttgtgacgaacctgttcagaatctgggcagggcgtctgacttattttgtgcttttttcaggtactgtttttgacacagatatgcggcgttatatataaatgcggaaattttttccgcggtataacctgctgattgtgaaaatgcggttaatcagcatacactaattaacaatgatacaaaggccgatatttatgaatatgacattatgacaaatatcacctcctgtcttaaataatacgtctgttgtaacttttttgtcaggaaataaagatagattgttgtcacgcgtttttattatgacatagaaaaaggtaatccaaatgctacaattatgatgattgataatcaaaaaaaggaattcaaagatacttctgtacagagaagtagaagatggaaaatggataagtcataactcagggatttttttaacaagaaaaagagtctattttgttaatgacaaagagttaaagaaattatttaaagggttgaaaacaaatgtttccttgatagctgataagctatatttgtacctatttcaaagagacatacgatttcactatatcaaataagaggtacgctatgaagaaaaaagttttggacaacaatgatttgtatggcagccgtggcttgacgcgttggacagaaaaatgggagtaataccagtcagcggattctgcaaagaagactgggacagagacgcagaagacaacaacgaaaccacggcagagaagcaggaatggattcttcaacagtaaaggccgagaatgcagagaaatcgcttccagttaagaaagggtcggtcagatatgagctgacaatcaacgtgtagccattacaagtaatgaaatggtgctatattctgattctgcagtagtatctcttgagagagtctcggaagatgtgacggacggcaaatacaagggagattatgtaaagtcgggactgagaaaggcataaagaaattgatatatcaaatacaaagactggctggacggcactacagtaacacagcactacactctcaaagatataaagtctggttcatccttccacataacactcgcaaaagacatggcgaagaggtgggatttaaaaataagtgatcacagtcaaagtgccggagatggagtgacagctgagaaagatttgatgctttacagtgataatgcctctctcgttgtcggggacgagggaggtggctctcaatgagagcttctttaatacgtaatggcatccaatcttggattaggtgcttttatttgcatactttgaaaaaatcaatctgcaatggaatgcggattataaatatgcaattctatacggaggtggacttatgacaagtggaatatttaacacaccatctggtacagcacagtttatcacagcagcagtataaactgtctcaggaatagctcgattcgtaaagatcctgacaagtgttgaggaatggaagcggaagagccggagctctcagagtctatctgtactatgagaaggagaataaatagctagacgcttatcagccatgcagccatccatgctggaagggaaacatttttccgaacagctcgtgtatcagtttttgcgcgataagcttttttcggcattgctgtttggatgcagtctgcagaatatacccgtgttgtaaaagaagtaagctatggtaacgtgttatctgactaagaacgggcatggacagatagctatgataaatatgcaggagctggtgatatgaaaagcagcttgcattatacaaatttgatagagatgcaaaaaggagaaaagtccattaaagaagaggaaactgtgtcatctgaggaacttagaaaagaaatggggatttagtttatgaaaaagaagattttatgatgaaactgttcgggatatctggtcgtactcaggaatctattgattattggggtgaatcatgatcctgctattttgtcgccagtacaggttaaaaaacagtctggcgcggtctggacaggcaacttcacagtttctgctataacagcagcaacggcctggctttgcaatagtcagaataataatgaagtcaatgaagtcgatagtgaagtaaagtgaagtttttagtgaagtaaagtgtagttttacttcacttacttcacttttttgtaagcgaattatctgagggcgggtataccttccaggcaaaaccttctaagatgtgagatgtaagcatttactctattcacatgtaggaggccaacaacaatgaattccaaggctgagcgcgtcctgaggataaggcattgagctgatcaatgagtgtcggcgttccggactgacagatgcggaatggtgtcgccagaacggaatagccgggcactttctatagtgggtcgccgttgcagaaaaaatagtgcagctgaaaaactgatcggccgagatccgaagagatccggccagaacctgtcgtacaggaggttgttcctgtttcgattgttccggatgatccatccgatgaacaacatccctggtttctgtaccaaaggagccggtggaatcgtaccttgacaattcacatgagatcgaagttattgccaatggaataacaatccggatccgaaatgatgcaggttcagcagcgatcagacgcgtgttccggtatctgaaggagatcaaatgttaggcgatatttccggcgtagaccatatctatctggtgaccggctacacagacatgaggcgttccatcgatggtctgtgcgctatatcgaagatcagctgcgcatggatcctattcgaattcctttttctattctgtggcaaacgccgtgaccgcatcaaggctataatgcatgagcctgacgggatggtgcttctttacaagcgtcttaccgttaaaggtcattatgagtggccgagaaacaaaacagaggtcgagacctcacctgggtcagttcgactggctgatgtcaggtcttaaggtcgatcagccgaaagcacttcagacggatgatctggcactaagaaataccgaaaaagctttgagatcattgactaaaaagtgccgaaaaaacagtaaaatcaaggctttcacggttttctttatgcccgttttctgatataataaatgtatcaattcgaaaggaggatccacgtgggagccagcgcagctgaactgaaaaaccggaattacgcgacactataaaacagctgaacactaccatcgacacgctgaattctctgatcagtacacttcagacaccatttccgaacagaacacccgcgagcagaattataagagcagatcgattatcttacaaagaaactctttgggcgctcaagcgagaagaatgcggagacatcccaggtcagatgagccttttcatgagctgagatgaccgtcgaccacgaggcagatgttgaatctgttccggtcaaagctcataccagaaagaaaagatctgatcataacgaactctttaaaggcattctgtcgaaaaagtcgtcaccctcttccggatgaccagaaggtctgcccggaatgcgggacacagatggaaaaggtcggtgggagttccagaggcgggagcttaaatacattcctgcaaaggtaagtgtcatcgagtattacagcgagaaactatgtgtgcccgaactgcaagaaagcgcttggtgatgctgaaaccagtctttgtcaaatcaaaggtccctgaggctctgataaagaaaagctatgcttcctcatcagcggtcgcatggacatgtaccagaaatacgtcaacagtgtcccgctctaccgtcaggagaaagactggaagcagtacggagcttcactttcaaggtcaactcttgcaggctggatcatccaatgttcacagacctgtttctttcggtcatagattacatgcaccaaaggctgactccgcgattatgccatgggcgatgagaccaggatgcaggtggtgaaggaagacggccggaggcacagacgcaatcgtttctcggtgttccgtagtggcgtgatgggcttcctccgatcatcctgttccattattcaccaacaagaagcggcgatgtcgccaaagaatttctgaagggattcaacggatatctggaaaccgacggctaccagggctataaaaaagtgtcggggatcaagcggtgtactgttgggcacacctgcgacgctacttcatagacgccatcccgaaagggaaacagtttgattacgtcaacctgcagtgcagggagttgagtattgtaatcgattattccggggaacgtgtgatcaacagcacatgtgccggcgattatgacaaaaggaaagaactccggctcgaaaagagaaacctgttctggatgccttctggtcctggctggatcagcagaaacccgttcatggatcccgattcgagaaggcggtgaactatgcccagaatcgcagggagacttccctgaccttcttgaggacggccactgcagtctttcgaacaacgataccgaaagatcgattcgtcgtgcacagtcggaagaaagaaactggcgttctgcgacacagtcggtggagccgaagccagtgctgccgtttattcgattgttgaaacagctcatgccaatgatttaaacatttacaaatatcttgttttccttcttgatcaccgtcctcatgcagatatggcagactcagaactcgacagctgatgccctggaatgacgaagtgcctcataaaaaaaaggcctgccagccggattcttctgaaaatcttgtgtgaattataagttttctccatctaggatgcacttcctggacgtggaatttttatgcggggctgacgccccatgataactcgcttacactttttttgatataatgggtacagaggagatgaattttactgtgaggatgcgtttatatgcagatagaagaactggtaaatggaataaatctggaaagtgacaaagtcgaatttaagggtattatagaagacggcagactttcagatggttcatactcagagatcagttggcttaaaactcttgcggcctttgcgaatactgatggcggcgatatgtatataggtgtcgaggacaagagtcataaggttctggccttagaccacaaaaccactgacagggtgataaggatgatacaccatcagattcgggaaaaaatcgacccaaagataaactataatatcgacacaatccctgtacctgataccagtccaattcgttatgtggtacacatatcagtcagccataatgagaatctgcctgtaactgtgcacagtaaaggcatgattggcatctatgtgcgtaattacggtcagacggagattgcttcatccgagcagataagagatctcgtgcttatgagtgagaatataccatatgatcagccatttacgcagagagattataaaaaagaagatttttcgaagctgttcggttgtttttcaaagactggtgtcgcagctacagaaaaagcgttgatgtcgatcggctttatatcttctgatcggaagctgtccaaaggggctgagctttttgctgatgactgcgataaatctgagacaaggattgtacttagcctttggcctgattttaataagggaagtgatgtggttttagcacataaggaattgactggaaatctgatagaggaaatccaggaagcaattgacttcgtgaatgatcattcagctaatggatttatcaaaacaaacacttccagagagatatataagtcttatccagacaggtccgttatggaagggatagtcaatgccatagggcaccgcaattattttattcagggtgcgcagatagaagtgaatatttttcgggacagacttgagatcacttcgccgggctcgctgctcggcgtaagaaagcttgatcacgagactgatattgcttcgataattccgcggcgccgcaatgaggtgatctgtgcaatgcttgaaatgtgcagatacatggaggaaaagggcagtggctttgacaaaatagaagatgattacagtatggctgatgagagtcataagcctttcgtctcttcagatgcgtcgtcatttactctgactcttcctgatctgacatacgcgggcggcatcgagcctgagaacagtgaaaccgcggatgtgacggtaaatgaagtcatttctggtaaaaatgacctgaaaattcttggtttctgctattataaggaacgcagtgtcgaagaaatcgctgaatacataggcattagtccttcaacctatttccgccggaatacaataaagcgtctgactgatggtaattatctgataaagagatccgctgagcgtggctatagatacgtggcaaaccatagtaaggtattccgccgttaagtgccttatcatccacatttataaggcttttgatacaattatgcttccttaaatacaccaatgccatgtcaaagaaaaactgatacaatataagagagctacactgaaacatcgcttactcgaggaggttataaaaatggactacaaaaaggcagctgatttctgggttgagaaggacaaggactctgtaaaaatggacagtgaagcgctcctttcggagatcgaggcgtttcttggcaggcacaaggtctgtgcactggcaactgcagcaggcgattttgtcagatgtactccgatagagtacaattatgtggatggggcgttctatctgttctctgagggcggactgaagtttcgggcgcttgagagcaacaagcatgtctgcctggccatttattctgagggcggattcggaaatcttgagggactgcaggtaacaggaactgcagagatcatagaaccgtggtccgaggagtacttaaagcttgtaaatttcaagaagcttccaattgatatgatggagaaaatgccacaacctataaaccttataaagattgccccggaagtctatgatttcctggactccgatctgaagaagaagggattcggaaacaggcagcagctgatcattaaatagcactgtcagatcaggaggcttaatactatggcgattcgtgatatttttgcaaaaagcataaaaaataaacaaaaacataaacaaacataaaaaaacaaataaaaatatatagaacaaataaatcccctgtgatataatgctggtgagtaattatcaataaaaatataaatacatttattccggaggtgtgtcaggatggaaaatcctttttctctgactttcggccagaagccgatggagatgatttccagaaaaaatcagctcaggcagattacagatacatttgagatggagtctccgacaaatcatgtcttcatgatagcaggggttcgcggcgctggcaagacggtttcactctcggaaatttcagagcatttcagtacgagggatgactggatcgtaattaatctcaatccagacagcgacatgatggctgactcgatatctgagataaacaggatgagctcttcaaagagactggacatttccgcgaatatcaatatcccagcagccggttctgtgactattaaaaacgcaggaaaagaattgaatgatacctcgaagatgaaaatccttctggatgaaatagacaaacgcgggagacgggtcctttttatcatcgatgaaatagtcagcaatgagtacatcagagtatttgccggacagtttcagatatggcttcgcgaggaacggcctgtgtacctgttaatggcaggactttatgagaatatcagcaatatccagaatgagaagactcttacctttttgtatagagcaactaagatagtcctgaaaccactaagtgtcccagcgatttcggccagatatcaggagatatttgaaatagacgttaaggaagcagcagagatggcaaaggctaccaaggggtattcttttgcatttcagatacttggttacctgaggtgggagaagaggcagccgttgaaaaagctgattcctgattatgacgcagatctggctgagtatgcctatgacaagatctgggcagagctgtcgccaaatgataaaaaagtagcacagattatcgcttcaggtaagactaaggtgggtgaaatcaggaatgagcttggagtctcatcgcagtatatgaatatttataggagaaggctgattgcctctggtatagtgtctggtgataccagggggattctgacttttaccctgcctcgctttgaggtttatataagtctttactgcgaatgagcatcatttactgttaaaccgagaggtttaattacatcttccaaatatatgtggtaatccattagagcttcttcagagttttttaagtgtgatggagtggaataataattgatatggtaaaaacaataggaatagtaagtctttcttcaggagcgatgggggaagaattcgcagagcatgaagtgaaaatcggactgaagcgtctaaaggaatttggggctaacgtaaaaatgcttccccacgcgcttaatggaattgaatatatcaggaatcatccagaaaaacgggctcaggatttgctccaggctttccaagatccggatattgacatgattctttgtgctattggaggagaagatacttataggctgctgccatatttgtttgatcacggcgaacttagaaatgcggtctcaaaaaaaatttttctcggattttcagattcaacaatgaaccatttcatgcttcataaggttggattgaacagtttctatgggcaggcatttttacctgatatatgtgagctggatacaactatgcttccttatacggagatgtatttcagggaactgatcagcaccggctctattagagaaatccggccgagtgatgtttggtatgaagccagaatcgatttcagtccatcagcggtaggtacaccgcttcagagacataggaacgaaggatttgagcttttgcaggggaggccgagattcagcgggcagatttttggcggctgtatcgatacaatctacgatatgtttgatggcactcgctttgctgattctcccgggctttgtgaaaaatatcatttgttccctgagcttgaagactggaagggcaaaatccttcttttggagacaagcgaagagcagatgtctccggaaaaatatcatcaggcattgttatacttgaaagatacaggggttttttctgtaatcaatgggattctaattggcaagccggaagatgaagacaattttgaggaatataaagcattgctgctggaagatatcgggataccaacactacccattgtatgcaatataaatataggccatgcattgccgagatgtattattccatttggcgtaatggcgcatgttgatactgaaaagcagaagatttcctttaaataacagcattctgccaaaacattcattatacaatttcaaaagcaggttgtttttctaagagaaacgctgtaaaatatgtatgtaaattatacagcaacatgagatgacaataaagcaaccatatttggagatgatatcatgcctaatattaaaccgatttcagaccttagaaattataccagtgttgtaaaagaagtaagctatggtaaccgtgtctatctgactaagaacgggcatggacagatagctatgataaatatgcaggagctggatgatattgaaaaacagcttgcattatacaaatttgaaatagagatgcaaaaaggagaaaagtccataaaagaagaggaaactgtgtcatctgaggaacttagaaaagaactggggatttagtttatgaaaagagtagagtattctcagcttgttaaaagaaagctcctgaatctcaaaatgtatattattgagaagtatggcgaaaagaaagcaaaagagattatgacttcaataactgacagagtagatttgcttggttcaaatgaagaaagtggagtcagcatatctcgtatgtatgatatagaaacagattactggtatatttttacaaatcataattattttatctatagaattgaagaacaaaaagtttttattgtacaaatgtttaacgaaaaagaagattttatgatgaaactgttcgggatatctggtcgtactcaggaatctattgattattggggtgaatgatgaatttggttccaaaagtattgcttacagcaaataataaatagatgcaacagaaaagcagtgagtacatttgttttttatgccttatttggcttattacccacttatcacccacccatgaaattattagagagcggatttcattttttacattgtaaaaatgtcggcagaaatcgctgtttttatggatttgtacgggaatttgagcggatttacgtaccgaaatacaagttttgcaaaaaagtatgtaatagaaagccggcaattacatagcaaataaggagtttgacaaatctgtacgtaaaagaaattctcaatttacgtacataataacgattttggcaaatctgtacgtaaaaaacagctggcaattacgtacaaaactacgattctggcaaaacagtatgtaaagcattacgtacaaatcaagaattttggtaaaacagtatgtaaatttgactcagaaaatacgtacaaaacaacaatttttgaaaatctgtatgtaagtagcatcaaagcatacgtacaaaacaacgattatggcaaatctgtacgtaaaattattttgcaatgtgcatctgcacatgaataaacagcagcgacggcctagctttgcaatagtcagaattaataatgaagtcaatgaagtcgatagtgaagtaaagtgtagtttttagtgaagtaaagtgtagttttacttcacttacttcacttaattggtacagggagatgaattttactgtgaggatgcgtgtatatgcagatagacacgatccctgtacctgatactagtccgattcgttatgtggcacacatatcagtcagccataatgagaataactcactttaacttgtactatttatattctaacaccaactacgtgctcaacagtgatgtcttcctgacttattgatgctgcctgagatgccaactgcctcataactctatcatacagttccccatctttagccaatttttttatttttagcgcaaaatatatacaatatatacctacaaccgcaggataaaatgcatataagggatctctcgcacaaaacaatattccaactattgtccagaagaacataatcggcacaataaaaattcccctgcctcttgctaatagtctttcgcagctgaatgaattaaacaagacgaaaaaaggcgataaaatcataattgccaatacaagccaaaaaacatcatcgttaccatgatatgcaattgccgaaaatatacatatcactcctattatttcaaaaattacagctttaactgcaaacccttttcccgattcaagaacataaagataataagacaattctttttcttcatccgaattatataaatatttaatctcttttatcttacggattaaattagattcttgagtttcgttggtgcctatctctctttctatttgaagggcaagaaaatatcttgtttctgcaccttcaagcttcccatcaactttcagacagtctccccatttctcatataatgtacaaagatttgtttttacatctcgaatgttatactttatcttgagagctttcttcagtgtaatttctgcctcttggaatctgtaattctgagaacaatattctgcccaggaattatatatgcttgaaagacctcttttgacttttgcaacaacatcattctgcgaagaagtgcccatagatgcatttaatgctgcgacataagttctttcggcactataataatctcctctctcagcgtattgtttcgccattgatatcagctcatacggatcaatatcaaccctttcaactgttacctttggcttactaaaattaggcatacatttaacaccctttcaagtttgtttcattatatcataagaattaaataagccttctatacaattgaagtatagcacacaacctcactataaggaagagtttttacagaatgtgattacagtagaaatctattaagatttgtaacaacaataacgatatatttaatgtaaagtattagagaatgtttaatgacgttatgttacaatattgcagaaattcattaaaaaaataataatgggagatcttagacaaatgctggctggcaatacatttattaacagggtaagtaatacctttgcacctacaaggtcatcaccgatgcattatgttcatccgcattgggtgagctcgtatacaaggaaggatggaacttttgtacagggattctggagagatggtgatggagatacatcaaaagaccgctcatttggatactttgcaagaaacccaggaaagctgttttaaggagatcccatgtttggaagaggcaaagtaaaaaatatcaaaaaagagaagatttcaaaaaaagtcactattggtgatcatgaaactataataacgcttgatacggcctttacaggggaagtagatgggaaaaaggaaatacttgatgaagtaatgatagataaaatgctcgatgaaatagctgatgctattgcttcgaacaggaccagttataataccattccaagtgagataataataaaaacaaatggtagcgatgcgggcagcaagagccctgctgaaagaaaaacagctgatgataagcctgttaaaaatgacaagtctgccaaaagtgaaattatagagagctatgatccgagattcacattagatcaggtggtattaaatccctctgtaaaggaaaaaataaatatcgccatatctgcgacaaaaaacagggcatttctcagtgagaactggggactggctgagcattttggctcaggcagagcgatcatactgaacttttatggaaagcctggaacaggcaaaagtatggcagccgaagcagtggcggccgcattgaataaaaaggtttatcacatcaactattcagagcttgagtctaaatatgtaggagagaccccaaaaaatataagaaaagcatttgcaaaagccacagaggatgacgcaatcctgatttttgatgaagcagattcgtttctcgggaaaagacttacctctgtgacacaatcggctgattatggcgtaaatattacaagaagtgtacttctgatggaactggagaaatattctggtgttgtcatatttactactaatctgatcaaaaattatgatgaagccttcaagagaaggatacttctgagcgtgtattttgaaatgccagacagggattcgagaagagatatatggaagcttcatttaggggaaaaacttcctgttgcggagggtgtcacaccagacagtcttgcagacagatatgattccttaagcggcgcagatataaaagatatggtgttctacgcggctctcagtgctctggaaaaaggtgctgatcaggtggatctggattcttttgacaaagcaaacgaagttataagagaacggtataatgacaggtcacaggaaatgaagacaaaggttataaagaccgagcagatatcaaaagaacagtatctgaaagaaacgaaaggggtggaagaggatgcttgacgcagttatgactgcatacaaaaagactcgtgatgttcttataggaacatttgcaggaacagatgatgtcgcatatgaagagaccaggttctatgatcttggatatatgaagacacaggtgaaaaaaatacaaaaggaattaaaatctgtggatgataccctgataagcagtgttaagaatgaaacttcttcggcagaagtcgataattacagaaatgatcttatgagaagacgggagatgcttatttttcatatgatctttaccatgtcaaacagctttgcaaatcttgacaattgcagaaagcttgcagaaggccacgatttcagatttatgacatgcattgagggacttgaagaatataaaaaaggaaataaaggaagagcgtttgatctgatcgaaggatactacagagaatttggcagcgtggagggacattacctgataaataaggtgtttggactgcttttatctgagggtggtcagtataaaaaagcaattccatttctatcatatgccttaggatttatgcctgatgatgaggagtctttagcggctctgagcgaatgctataaaaagacaggtgatgaaaagaagcaaagagttctggcggatatcaacagtctgcttggatatcaggaggtgtcataatggaacgaaaagattatgtgcatcctcttcaagacgcagcatttgaaaaatataaagatggtgtttcttttcagaaggatattgaaaatacctatgataacgtggagtataagagcagacgcccagaccttctgggaaaaactgtgagggttacagagaagcagttccacaatgtgtgggagataatggaagatatatacaggcatgagagtagatcgactgttgttcctgtctatgtgtatgaggaatactattatggcgcggagagctacggaataagcaatccatggatagagatctctgcaaagacgatagctgatttttcagaggaagaattgcgatttgtactggcaagagaagtgtataagatcactgatggtgtaacaaagcagaagactatgatggaagagagatttaagggtattaaagcacttgcaccagaagagtttgaggaagtttcaaagctgtcattttatcactggtacaggatagcaaattttacggcagataactatgggtatttgtcatgtggcagtattaaggcttctgtttatgcggtactgaaaatggttctgaacagtgtggcgctggcagagcaggttgacattaaggaatttatagctcaggcttcagagataaacgaattgaatgatgtcttctataaccataccaaagctgatgaacctgtcccatatgcaccacacaggttacagaatctaatggcgtatgcagagtcggagcgtggtatgaaagcaatgatggaaaggatggaatgaaaaatgtttgtttttgtattagccgcaatagttggggttggaattcttgccatgagccttataaagagattttggaatgatataagggactggcttaataatacggcagcagatgtagttcagaagtatctgggatacgatgcaagaaaagcaatgcagaaggctgtaaatagagcagacagggtcatgaataagattcggaatgtggcacaggtttattatcgaaaggatcctcttgcaactcattatgataaagtcacgatggagacaactgctccgacctatgagtttgatgatgagtttgtaaagactgtcaatgaacagggatcattgtcacaagaaatggaatataaacagtaatcaaaaaatatatcccaagcgaggtgagttacgcgatctatttgccttgacagtatgacatatatgctatatattagagttagttgggaactatgtaaaggttttagcaattagcatgagatgaaaagaatatgcaaataacttatcaatgtccagcatgtaaaaagcaattattttatgatgcggaacgtggcataacgcagataaatctaacttgtccatattgtgggaaagttacccttgtatatattaagggtaatgagagattaacagatactcctggttttaaaagagcagcagtgttaggagttagactcataatgaaattattgggaatgtgataacgttgtttttataaaaattgagatcttgcaaataagattatagttggtgaataattatcaataagatcccaagtggtagtgaaaactgctgcttgggttttttgttatttgaaccattctcttgcaattgtagcgtgtattatctcaaatgccttggaggaaccatttatgaaaaaaagcggagaaaccgccgattttatttcggcgatttctccgctaaatttcatttccagcagactgaatcgggagattacttaacctttacagtcttagttgagctccattttccgttgagagaacccttaacggcacgaactcttacctggtatgtacccttcttaaccttgtaagtcttcttaagtgtcttagaagaaactgtctttgttgtccacttcttagcgcccttcttcttgtaagaaatctggtacttagatggcttctttgaagctttcttgtaagttacagtaaacttcttcttgccagccttaactttaagagatgatggctttcctggagttgcagatgcgacaactgtaaccttctttacgttagactttttaagggctgccttaatagcgcttacaacttttgcacttgtgccagtgtaagttatcttcttaagacccttaacgcccttgaaggcttttttgtcgacagaggtgattgaagaaggaacattgattgttgtaaccttctttcccttgaatacgtttgcggcaatgcttgttaccctgtacttaactccaccaacagtgacttttgaaggaattgtaacagtcttagccttttttgatactgacactgatgtgattgtagcctttcctgctttgtaagtatttacctttaagcttgaaagacccttctcacctgttgcgttctttgcagtaaccgtctttttcttctggtcctttgccttagcagctgaactctttgatgtagctgcgtatgaaactacaggagctactgcaggagctgctgtaagtactgtagctgcggccattgttgcagcaagtactctcttgatagaaaatttcatgaaaaactcctttccgcccgaatcgttctatcatgcgatagggactctaaaaaaatattattttccctcttttaactaaagaggtatatctacatgcttctgcatggcgataccgggattatttctttttaccgtaatagtactcattctttccgtagtacttatgcttgccgtaataaccaccatatttcttgtagtagtaaccgctcttcgaacctttgactcggttaaggacaataccaagaagcgggcatccggcgcgctcaagctgcattacggactgttttaccatatttttcgatgtgatgccacctcgtacaaccaggatggctccatcacacttgcttccaatctgttcgccatcggctaccaggtccaatggtggaacatccagaaatgtatatctgtattcattcgatgcatattcgagcagttcttgaaatctctcctgctcaaaaagcatagatggattgatgacgttatcagtatttggcatcaaaaagccgttttcaaggttttttatcgaatagatgctctcattaaaatcgtcattgtgggagaggcagtaagctgtccccttcgccagcttcgagttctttgaagtggacttatcatttgaaagcttcaatccgtacttctcagtcatctgggacttccggagatcacagtcgataagaagtgatctgcttccgctctttgccatctgtgcgaaaagctgcatggaaataaagctttttccctcattcggggtagtagatgtgaccattatcttcttcacatcgcttcccatgaatccgacatttatacgcaggcggttaagcgcttcctctactgcatatggaagctcgaccatgttactaatctctatctcctgcattacttccttatcctcctgctgccatgcagcttatttcttatgtctttcaggccgtttccgacctctggcatttcgtcttgccttccaacggttcttcctgtcgtcatcatcggactcattcttctcgttcagtataccaatatcggcctccgggataactgtaagaggcatgataccgaacattttctcgacatcatcttcggactggaaggtatcatctgatacaaatcgtacggtatagataacaagtataagtacgagccctatgaatccgcctataacgatattcctcagaagatttggtgatgacggagcatcaggtacgatagccggctcgatgatgtgcggctccgacgtatccatcgtcttagggacctgctcgacggcagcatctgcaaccgcattcgcgatgcttttggcctcgttcgggtcctcatctgtcacatcaatctgtactattcgtgtctctccaactacggaggtatttatcatagctgccagatcatcataggtgtacttgagatgaagcttctctatgactgattcatatacaggtctggtctttaaaacctctacatagtcctgcgaaagtgaagttccgatattaaaatcagatatatccacgaccgactttgacgaagatgataccatgtatagcttgctggtggctgtatacttcggggtgatcatgtagtgtgtgacagctcccgctgcaagcgctccaaagatgaagaagaggatgatcgtcaacaggcgggccctgaagtaataaaacagttctcctaagtcgatctcaatctcgtcatttgctttatcgtctgatacctgattttcgtttatagttttgcgatcgttgctcacttttattttcctttatatcatttatcttctaatccaagcatttcgttaagacagtcatatatagaagacttatctgctgtgaacattccatgcttttccttgtcatcgaggattttgccctccttatagctgccgtcaatgtgaagggtgcccgtcatatccttcatagcgaaggtgttgatcaggtagctgatctgatgaccgttcatattggttactgacagatcctcaagctttctatacaggtcattagcaaatgaaggctttttcttcatctgcgccttcgcagctttgataaagccgtccagataaccctgctgtctctccattcgtgcggagttcgtgttatcgtccggcatatacattctctcatgaacgtagtgaaatgcctgatcatccgtgagatgaatcgtcgcaccttccttgagtgacggatcaatagtactgaaatcacctttcactgtaactgtaacgccgtcaactgaatgatttatcgcctttatcgaatccattccgatgctgtaataacctttgatcggaaggtttccgagaaacctcgatactgcctttactgtattcctgcagctctgcttctcatttccgccgtaccagtgagcggtgcagatctgctccgtcgccgatgcgtatgacttaccgtctgtcgtcatcatgtcgacttctgtaagtgtatccctgtctatcggaaggagagtgtaggtgcctttcgtatcatttacagatatgataaggagaaaatccgccatctctccctggtaattcctgcctttcgccttcgtggtgtagcttccactgtgatcagttcctataataaggaagttcgtgatgtcatccgaataagtgtatttcttgtgaccaagcgttatgaccggtccctcgatggcatctgctgatgcatcggcgctcgggctgcttaccgttttcttacggcttttgtcgcccaatgctttaaaagcaaaaaatataagggctacggctgccacagctacgatcactgcaacgaggacatttactctgtcgtgccttctgcccataaagccttgctcctttggtctatctcatctaatgtctctctcccgaacttcttctctatgacttctcgggcatggcccagattcgggtgtctgctcgtggtgttgtgggcgtccgttccaagtatcagtggacgatctcctgtcatagtctctttcgctaatcttccttctctgccaaaaagtccgaactttccgtgagtgaagaactctccgttgtgctgaagaatcaatgggagatcaagaatcgcatcccagacccccctgtccttctggaatcctgcaaagcgctcgatatgtacgagcactactgtaagctgccgctttcgtataatgggttccacctcatcatacatcgatgtcttccactgcgtaaatggcatctcaagaaaaagcactctcttgtcctctgtctgcatgcacagatcatcgagtatcccggcttcacttatgcctttgaaaaaatatgtctcagccgctgccctgtacttaagcttagcatccataccgctgataagctctgctgtcttatcgagagcgtgctgcctgttctccgcaaactgcgaaaatgactgctgctgtgcatagaagtgtggagtaaacaaaatatgattcactccctgatccacctccatggcgagcatctgcctggtcatttctatgtcccggcttccgtcatctatccccggaagtatatgcgaatgaaaatcataaatgtctgacaacgtgcatctccctttttctcagcatattttatacgcttgacattatacttctcagcttgaatcctgtcaataaatgcctgtaaaaaagatggtattttacaaagtactttattaatgggacagtacagctacttttgtcctgcttttggcagcgcgatgtcacagaacaggacgccaggcgcgcgtcagcgatacccgagatcaaacagtttctaaatgacgagatataaaaattgcacatatgaaaaatgagacaaaatagttaaactattcgaaatgcacaataaataacattcgaactgttagctatttgtaacatatcacaacaaaaaataaaaattttaaaaattattgttgattttttatataggctgtggtatcatacttgatgtcgggagagatagaaagatttgataacttaatattgataagccaagcgagatgagagtatggtggatttatagaatgtaccatcatgcttttttttgtgccataaacgggaggaattatggaccacagagaatttatagacagaatcagtgcagatccgatcattaccgcagccaagtcggatgagggattggagaagtcatttaaagcagattctgaagcagtattcattctttatggggaagtggctacgattccgggaattgtaaagaagataaaagagcacaacaagatcgctatggtgcacattgatctgatcaacggactgagctccaagacagcggccgttgattttatccgaagatatactgatgcggacggtatcattactacgaaggttccgctgatgcagtatgcgagaaagcttggactgaataccgttctaaggtacttcgtgctggattcgatcgcacttgataatatcaagaagcagtcgcagccggggatggtccagtcggatattatagagatccttccgggagtgatcctcccgtcagttataaaacaaatcgatgagatcagtagagttccgatcatggctgggggcctgatcagaacgaaggatgaagttctcagcgcattaaatggtggagctgtcgcgatctccaccactaatgaaaaggtctggttcctgtaatcgggcctgtgtccctctgaagtagtgtactacctgcccgggcaaggacttcagacatgacgcgagataaagggtttttaaaaaaggttttcaaaaagggttttcaaaaaaggaggttatttatggcaaagtacgttatggccatagatgcaggtacgacaagcagccgctgcattcttttcgaccagcaggggacaatgatttcagtagcacagaaggaatttccacagtatttcccacatccgggctgggttgagcatgatgccaacgagatctggcagacacagcttcaggtttgccgtgaggctatggagaaggcaggggctacctacgaggacatcgctggaatcggtattactaaccagcgtgagacaacgatcctctgggatcgtcagaccggccagcctatcagccacgctattgtctggcagtgccgtcgtactgcagattttacaacaaatcttcttgcagagcatccggaatataaggatctgttccagaagaagacaggacttgttatcgatccatacttctcaggtacaaagatccgctggctgcttgaccatgtagagggtgccagagagaaagccgagaagggcgagctttacttcggtactgttgattcatggcttatctacaagctgaccaagggcagagttcatgtaacagattactcaaatgcttccagaacacttctgttcaatattaatacgcttcagtgggatgaggaactttgcaagatcctcgacatccctatgaacattcttccagaagccaagccgtcaagctgcgtttacggtgagtcagatcctgagttcttcggtggtccggtacctatcgcaggagcagctggtgaccagcagtgcgcattgttcggacagacatgcttcaccaagggcgaggcaaagaacacatacggcacaggtgcattccttcttatgaatattggcgacaagccgatcatttcgaagaacggacttcttaccactatcgcatggggccttgacggaaaagttgagtatgctcttgaaggatctgtatacgtagctggtgcagctattcagtggctgcgtgatcagatgagaatggttgattcttcaccagattcagagtatttcgcacagcaggttaaggatacaaacggatgctacgttgttcctgcattcacaggactcggcgctccatactgggatccatatgcgcgtggtgttatcacaggtattacccgtggtgtcaacaagtatcatgttatccgtgctacacttgagtctcttgcattccaggtaaacgatgtgcttcacgctatggagcttgattccggaacaaagctttcagcacttaaggttgacggtggtgcctgcaagaacaacttccttatgcagttccaggctgatatcagcaatgctcctgttcgtcgtcctaaggttgttgagacgacagctatgggtgcttcttatctggcaggtcttgctgttggatattggaagaacaaggaagatgtaattaagaactgggctatcgacagagagttcgagccggctatggaaggcttagagagagaaaaagagctcaaaggctggaaacaggctgttgcagctacacgtggctgggctaaagaggactaattactaagaggttataagagttttttcaacaggttaattccttattgagaaaggggtataaacatgacagctcaaatgtttcttgcagagtgtctcggaacgatgatcatgatcatccttggagacggtgtctgctgtaatgtaaatcttaaaaaatcaggaatgaatggcggtggatccgttcagataatccttggatggggccttgcagttctgcttccggcttatacattcggagcagtttcaggatcacatttcaacccgacagttactatcggcgcattagtttcaagcattatgcacggtgatggaaaattcacagccagcatggcagccggctatatcgtagctcagttcatcggagctttccttgcagcctgcatcctgttcgtacttttccacgatcagttcaaagctacagacgacatggctacaaagcgcggcgttttctgcacagctccttcagttcgtaacgttggacttaacttcctttcagagtttgtatgcggcttccttcttgtcttcacacttgatggcatcggaaacacagttgcagctaagtcaggaatgaactggttccttgtatatgcagtaatcgtttcaatcggtggttctcttggcggtctgacaggatacgctatgaacggcgcaagagactttggaccgagacttgcttatgcacttcttccaataccaggcgagaaggatccggactggggatatgcatggatcccaatctttgctcctatcttaggaggaatagtagcagctgttctttacactgtaatcttcggctgatagcttattttcagtaaacttcatagaacgaggcagagagacatgaggcgccggaatagcatacagacgagtatgtcttatccggcgccttttctttttacatgatgcttcgcaattttaaataacttacagaaaagaggatacaacatgatttatgacgtgatcatcatcggcgcaggcgtcacgggctgtgcaatcgctcgtgaactctcccggtacaaagcagaggtctgtgtccttgagagagaagaagatgtatgctgcggtacttcaaaagccaattcagcaatcgtgcacgccggctatgactgtgtgcctggatctcttatggcaaagatgaatgtacgcggcaatgagaaaatggaccagatcgcagaggaactggatgtaccatttaagagaaatggttcactcgttgtctgcattcacgaggatacattagatggcctgcaggacctttacgacaggggaatcgctaacggcgtcaagggaatgaagcttttgaaccgtgaggagacacttgcgatggagccgaatctttccgacgatacccagggcgcactttttgcatccacagcaggaataataagcccgttccgtcttacgatcggatttgcagagaacgcaaacaagaacggtgtagatttccgcttcaatacagcagtagagaatttcaagaaggatgacgagggaatctggcacatccgcacgaacaacggtgagtacaagaccagatgcatagtcaatgctgccggagtttattcagataaattccacaacatggtttcagaggataagatccatatcacaccgagacgtggagattactatatcatggataaggagatgggcagcttcgtttcgaagaccattttcccacagcctacagcttacggcaaaggtatccttgtagctccgactatcgacggcaacctgcttgcaggtcctacagctatcgatctcgaggataaggaagctacagctacgactcaggatggactcgatcaggttcttgccggtgctggcgcacacgtcaagggacttcagatccagagaaagtgcatccgtgtattcgcaggcctacgtgcacatgaggatcaccacgaattcgttctcggcgaagtcaaggactgccctgatttcttcgatgcagcaggcatcgagtcgccaggactttcaagttcaccggctatcggcgagtacatggccggacttatcagcgataagtatggctttagaaagaatgagcactttgacccgatcagcaagggcgttctgaatccaaagaacctttctattgaagagagaaacgaactgatcaagaagaacccagcttacggcaacattgtctgccgttgcgagtctatctctgaaggtgagatcatggatgcgatcaaccgtccgctcggcgcaaggtcgctcgatggcatcaagagaagaacaagagccggaatgggcagatgccaggccggattctgcactcctcgtcagatggatatccttcacagagaactcggtcttccttatgagaagatcacgaagatgggcggagattcctacattgtacgtgagcgttcgaaaggcggcgaagacaaatgatgaattatgatatcgtaattgttggcggcggcccggcaggtctcgcagcagcagcttccgctagaaaagcgggaattgataaaatccttattctcgagcgtgacaaccgtctcggcggaatcctgaatcagtgtattcacaacggctttggtcttcatacattcaaggaagagctgactggtcctgaatacgcgcagcgttacattgatcaggtactcgaggacaaaattgaatataaattgaacactatggtcatggatatttccaaggaccgtattgttacagcaatgaaccgtactgatggtatgttccagatcaaggctggggcagtaatccttgcaatgggctgccgtgagcgtcctatcggagctctcggaacaccgggctatcgtccggccggtatcttctcagcaggtactgcacagagacttgtaaatatggaaggctacatgcctggtcgtgaagttgtaatcttaggatccggtgatatcggtcttatcatggcaagacgtatgactctcgagggagccaaggttaaggttgtagctgaggttatgccttactcaggcggcttaaagagaaatatcgttcagtgtcttgatgatttcggtattccgcttaaactttcacatactgtaatagatgttgaaggcaaggaacacatcagcgcagttactatcgctgaggttggaccggacagaaagcctatcccgggaactgaagagagatacacctgcgatacactgcttctctctgtaggtcttatcccggagaacgagctttcaaagggtgctggagttgagatcagccgtatcacaaacggaccagttgtaaatgagagtcttgagacttcgatcccaggtgtttttgcctgcggcaacgttctccatgtacacgatctggttgattatgtttcagaagaggctacgagagccggagagaatgcagctaagttcgtagaggctggatgcagggagactacgagtggagaggacatcaagcttatcgctacagatggcgtccgctacacagttccaagcacgataaatctcggccgtatggataagatgcttaccgttcgtttccgtgtaggtgctgtatacaagaacgcggcagtcagcgtatacttcaatgatgagcgtgttatgcacaacaagaagagaattatcgctccgggcgagatggagcaggtgatccttctcaaagacaaggtggctgcctataaggatctgaagaatatcacgatcaagatcgagcaggattaaggaggcagatcataatggaaactaaaaaagagttaacctgtatcggctgcccgatgggctgcagcataacagtgacaatggaagacggcgaggtaaagacggttaccggcaacacctgtggaattggtgacaaatatgcccgcaaggaagttacaaatcctgagaggaccgtctgcagcacagctattgtcagtggcggagatcttccgagagtatcatgcaagacaaagacagacatcccgaagagcaagatatttgaggtcatgaaggagatcaatgagattaaggtcgaagcacctgtaaatatcggcgacgttcttcttgacaatgtagcaggtactggcgttcctgttgttgctacgaaagacatcaagaaggtaagctgaaatccaataaccaattttttatgaaaggaggaactgtttatggcaatgaagaaattcattaacaaagttgaagatgtcgaggaggagatgaccgagggccttgcgaaggcatatcctgatcagcttgagaagctggattatggtacgatcatctgcagaaagaacaagaaagccaacgataaggtcgctcttgtcagcggcggcggcagcggccacgagccagcacatgcaggcttcgtaggtgaaggaatgctcgatgcagccgtagccggaactgtttacacatctccgacacctgatgctatcctcgaaggaatccacgcagtaaagactgatgccggtgttctgctggttgtaaagaactataccggtgatgtcatgaacttcgagttagccgaagagatggcaaacgacgagggcatcaagactgtacacgttgtcagcaatgatgatgtagctgttgagaacagttcatttactgttggaagaagaggcgttgcaggaacactcttcatccacaagtgtgcaggcgctaaggccgaggcaggcggaactctcgaagaggttcaggctgtagcccagaaggtaatcgacaatgtacgttcaatgggtgccgcaatcaagccatgcacagttcctgcagctggaaagccgggatttgaactggctgaggatgagatggaagtcggaatcggtatccacggtgagccgggagttcacagggaaaagattaagacagccaatgagactgccgatatccttcttgacaagatcctggcagacatcgattatacaggccatgaggttgctcttatggtcaacggttcaggtgccacacctctgatggagctctatatcatcaacaaccatgtacaggatgtacttaagagcaagggaatcaaggtttaccgcacatttgtaggcaactacatgacttcaatcgatatggcaggattctcactttcactgcttcgtctggacgatgaattgaagactctgctcgatgcaaaggctgatactccagcctggaaggaattcggctgctgattttttcagacggaaaagaggacatcatgacagatcagaaaaaagtactggaaattgttgaaaaaatcatcgcaaagatcgaggaggagaaggaatacctgactgagctcgatcagccaatcggtgattccgatcatggaatcaacatggcacgtggttttcaggaagttgagaaaaaaatgccttcacttgacggcaaagatatcggctctattctgaagactgtcggcatgacgctgatgagcaaagtcggcggtgcgtcaggccctctgtacggttcggcatttatgaaggccggacttaaaatggctggaaagaccgagatggacattaatgatttcctgacttgtctggatacggctatcgaggctatccagaagctcggcaaggcacaagtcggtgaagcgaccatgatagacgccatggttcctgcagacgaggctatgaaaaaagctgtagagagtggggcagatgataaagcagtactcgaagcaggaagcaaggcagcatgggctggagcagagcatacaaaggatcttgtcgctacgaagggacgtgcaagctatgtcggcgagcgcggtctcggtcatcaggatccgggtgccacatcattttcctatattcttgaagtcatcagtgaaaacgtgtaactgcggcagggaggaacgactatggtcggtatcgtaatcgtatcacacagtgaaaatctggcaaaaagcgtcgtggagcttacgacgatgatggcaaagggggtcccaatcgagccagccggcggacttgaagacggttcgttcggcaccagctacgaccggatccgtgacgcgatcgacaaggtgtattcagacgacggagtaattgtgctcatggatatgggcagttctgttctgacgacacagtctgtcatcgagatggaggaggacggaaagaaggttgagatggtggactgcccgcttgtagaaggagcagtttcagcctcattggattcctcactgggtgagtccatggaacagatcattgatgatctgaaaactgttgctacgacaccaaagatgtgaccgcaggacagacacactgagataaatctgaagttctgcaatcccgtatgagaaggggattgcaggactttttttaattggtcacaatttcactattgggacagtagggacggttctttttgtcccattatctgacatttctgtcaattcatctctttaagcccgaagcagcgccgcagatggtcggtctcgctccgtaggatttttctgttcgcgtgcgcgctcctatgtgccgccctcttgccaatgtatggttttcatacgtttatggtccaagcgggtggcaacccgggccgcagctagcgcgcatggagcggttgttatgctgtcgcgagtccaaaggacgaagcgagagcattataaaccgcccatgcgatagccgtccgcgactgacgagtccgtaggacgaagtcagagcggaaacggcgaaccgccgctcactacgaaaaatcctaaggtcgcaagactgttcatctgcggcgttgattcttgattaatggacgtacgtatctgcggagttgcttcttgactaatgggcgtccgcatctgcagagctgcttcttgactaatgggcgcccgtatccgcagtgctgctttttctgcgagaatgtctggttggccacgttttgagtatacccctttccggggtgaaatttatacaacggatttcttccagtctcaagatagatcggggaagaagtcaaattcttaaagagctttcaagcattctcaagatgtgtggaataatgctcgaaaatcttaaagagccttcaagcattctcaagatgtgtgtgataatggtaaaaaatcttaaagaacatatttcaaatttttatatacagccattgcttctgaatattctacaatgcatttaagattacaagctccgcaagagactatattgagagcgtacattcgaacgtttaagattttcaatgtttcgtgaatctatatcgagactgacttttttgtttttaagatttttagtttcatgtatatccatactgaaactgtaagaatggagcttgtatatttccagctccgcgaatgtcaatattgaaaatagttcttatatactgcggagccggaagaaactctcagtctgcgccaggtcgctttaagtgtccttaccccatttccctcccatgcgggggttctttgtcgcattgcacttccgaaaaaataagtcatagcagatacgaataactttaaccccagaagcagcgtcgcagatagaggcgggctcgcgactttaggatttttcgtagagagcggcggttcgccgtttccgctctgacttcgtcctgcggactcgcgatagcataacaaccgcttcatgtgtgctagctgcggcctgggtggccacccgcttaaaccataaacgcatgaaaaccatacattggccagaaggccgcaattaggcgcgcacacgcgaacagaaaaatcctactgagagagacctggccatctgcgacgctgctttgggctaaaaaaagcataattgtctgaataatctaaaaatgggacaaaaagaaccgtccctactgtcccattacatcccgaggaaatttacgagcatcacccaggccaggctgtagtaagtcacaacgccgacaagatcggtaactgttgtgataagcggaccggaagcgactgccggatctacaccgatcttatcgaagaacatcgggatgactgttcctacaaggcttgagatcatcatcgcaagaagcagggaaaggccgatgcagattgatatagcgatcgatgatacgaaaggcatgtggtgtgagaccatgatatagatacagacacctacgactgcaacgcagccggtcaggaaaccattcgcgaggcctgtcgtcatttccttgcggacaagtttcaatttcattttgccggtgatgcagcggtccatcaggacacggatagttacggcaagagactgggtgccgacgtttccggacatgtcgaggatcatcgactggaatgccattatgatcgtaagctttgcaactacgctttcgtacatgctgacgacggaagagacgatcatgccaaggaagagcaggagtatcagccacggaaaacgttttttgatactgagtttgatcggctcctgcagatcctcctctgcggacagaccaccgagttttgcgtaatcctcgcccaattcctcatcgaccagctgggtcaggttctgggaagtgatgacacctaaaatcttgttgtcgttgtcgagtacagggatcgagtcctcggaataatctttcaatcgatcgatacagtcgtcaatctcctcgtgaccatatacgtaagggaatgaggtgacgatcagatcgtcgagggatttatcctgtctcgctgtgatcagatcctttaagtcaatggcaccgtaaaattcactgtccttatctatagtgaaaatagtcgaaatgttgtcattttcaccggcctggcgaacgagttcgctcatagcctctttgactgtcagattctcgcggatgacgatgtagttcgtctccattcggcttccaatctcgtccttatcataggaagacatcagtgcaatgtcccgcttggactcggaatccatcagatcgattatatcagctctgcgctccttcggcgtagaccgaagaactgaaatagcatcgtcactgtccatctccgaaacaacggatgaggcgcgctggatgtccatctcgctgaggtacagagctgcttcggaatcctcagcgtactctaagatctcagccagaagctcaggacttaacatgcgatatatctttttacgctcattcggctgaagcttagggagagcatcagcaatatcgttctcatggtaatcttcgagcttctctttcagtacagtaggagaagagtttgaacggataagggagagaatctcaccctcatagtttggctgatctggtgctttgcaggtattttcgtcctgattttccactctgtatccacctcactttatagaaatgtcaggaaactgaaaattgatttctgatttcccgcgcctttagtatagcagtttattttaaaaaaacaagcaaaaatatgtaaagaaattcttgggttgaaattgcaggccgctcaggtataatctaatttataataaggtaatttccaaggagtttgatcccatgaaaacaaaaattttcggtgattccggtttcagaaaagagctgttttctctggcgcttccgatagcactgcagaacctgatgctcgccgctgttgctgcctgtgatgccataatgctggggcgggtatcacaaaatcagatgtctgctgtctcgctcgccggacagatccagttcgttcagaacatcctcctcggtgcttctacgggagcggccgcgattctcggtgcacagtactatggaaaaggcgacaggaagactatggacgacatattttctatctgcttgagactctgccttgtcgtttcaacgatattctgggtgggatgcatttttgcgccggaaatgctgatgcaaatatatacgaatgagcctgagcttgttgcgctgggcgccagatacctgcgtatcacaggatggtcctaccttctgacaggaatttcggagccgtatcttacactgatgaaggtcacagggcacgctggtgcgggggcaggagtcagctgtatggcggtaatactcaacatttttttcaatgcagtatttatatacggactgctgggctttccggcattaaacgtacggggagccgcagtggcaactcttgtttcaagaattattgaagttatagtggcttttgtcctgtcattaaggagcggatttacccggcttcactgggagcatctttttcatacgacaagtggaatcctgcctgattttctgaaatgtgggtttccactgcttgtctgcggagctctgtggggcattggattcagctcctatactgcgatactcgggcatatgggagccgacgcagctgccgcaaactctgtgtcttcagttgtacgcgatctgttctgctgtgccggcaatggacttgcgaacgggagcagcattctgctcggaagcctgtttggcgcaggaaagacagaagagggaaaacgcgacggcggctatattttaaggattggaattttgacagggatcgtgacctgccttcttgttctcgcagtcactccgttcgtcctctggttctatgtcctttcgcctgaagcgaaaaaacttctctcccagatcatggtgataatggcgttttatatgataggtcgtgttttaaatactatcgttatcaatggcattttttactcgggcggtgatataatgttcgacgccagatcgctcgttgtcacgatgtggggaattgcaatcccactggcacttctcggcgccttcgttttccactggccggtgccggccgtttttgcctgcacctgcgcagatgaggtcggaaagatcccgtgggtcatggtccactaccgcaaataccgctgggtcaggaatctgacgaaggaaagaccaggggtttgattttttatataaatgttgtataatgtgagaacgtgaattgaaaatttcataacggctaggggagcacctgctgagaatcgggaaaggcatgagtctttctctgaacgccctcattacttgaaccggacaataccggcgtaaggaagctgatgcctttacaggcttattctgcaacgatatagtaaaatattgtgccctcctgtcacaggagggctttttttgtaaggaaatgattgaaatgaatgaagacagttttgaggtctgccagatcgcagagtgccagccgatgatccacattaatggcaacaatgtgacgctgcatgaagtagtaagtgctgttctggctgttggcggaactgcgatcggctcgagctcatctgaagaggcaaaggagattacgaacctttcggatggacttgttttaaatatcggaacacctgatcttgatagaaaaaaagccatgctgctctccgggcagcaggccaataaaaagggcatcccggtagtgcttgatcctgtaggtgccggagcttcggaattccggaagagcattttaacggaacttcttcaaaatgtgcacttcgcctgcatcagaggcaataattccgaacttgcagcgatttacaaaatcgccttttcgacagacgattacgttagatcaggcggagttgaggatgccggttctgctatcctggatgagcagatgcaggagcttgcggcccgctacaatacggtgatcgcaacgagcgcagcagaagacagaatcgtatctgcagataatatttacaaatgcaccggcggcacgagaatgatgagaaagattaccggagcaggctgcatgcagagcggagttatagcagcaggcctggcggcttattggaaaaatcaggcagcaagccagcgtttggcggaatcggatgcatctgcaatccatacgataatgcagcgctacaaggacgatgccctgagggcttatcagacgatgcagcgggacaataaattcggcatcggctcatttttaaatgatcttctggaccagctttgtacctggtcttcagataaataattttttcataaggagcttgtatcatgcgaaaggaaaatattagaaaacttgttgtttcagctatgtttgtagctcttatcgttgtcctgtccggattttatattccggtcggcgcatcaaagtgcttccctgtacagcacatggtaaatgtactttcagccgtcattttaggaccgggctggggcgttgcgatcgcattctgcgcatcacttatcagaaatctgatgggtacaggcacactgctcgcctttccaggcagcatggtcggagcactctgctgcggtctgatgtaccactacacgaaaaagctgatcccgacctacatttctgaggtcgtaggaacaggcgtgctcggcggtatgctctgcttccctgttgcaaagtttataatgggaaatgcacaggcagccgtttttacctatgtagtgccattccttatcagtacagtcggcggcacggtaatagctgcgatccttgtcggaatactcgccaggacaaaggctttaaactacatgagatcccagcttggcgataacagataaaatcaccatattttaaaaggagatacaaatgagaacagcacttacaatcgcaggttctgattccagcggcggtgcaggaattcaggccgatatcaaaacaatgatggcaaatggcgtttttgccatgagcgccataacggcacttactgcacagaataccaccggagtttcggcaataatggatgcgacgccggaatttcttgaggcagaacttgacgaggtatttacggatatttttcctgacgctgtaaaaatcgggatggtttcagagagcagtctgatcgaatcgatcgcgaagaagctgcaccagtacaagccgaagcatatcgtggtagatcctgtaatggtggccacttcaggtgcgaagcttataagcgatgacgcagtcgctacccttaaaaaggagctccttcctgtcgcagaagtcatcacaccgaatattccggaatcggaagtcctctccggcatgaagatagagagtgagcaggatatggagacggcagcatctgccatcgtaaaaaaatacggctgcgcagttctgtgcaagggcggccacagcttaaacgattcgaatgacctgctcgtatccgctgacggctcaaagaagcactggttctatggcaggcgcatcgacaacccgaatacgcacggaaccggctgcacactctcatcggccatcgcttcaaatcttgcaaagggatacgaccttgagacatcgatcgcccgcgccaaggactatatcagcggcgcgctcgctgcaatgctcgacttaggccacggccatggcccgatgaaccacgcttttgaccagcatgggaaatttatggagagcaatatcgatgactaaaaaaatgacaaattttcagtcggcactggtttggtttggcgccggcgtatcaatttctgaaatactgactggaacctattttgcagtgcttggcttctcgagtgcgatagcggcgattcttatcgggcatgtgatcggctgtgtgctgatgtttcttgcgggcgtgatcggcggacagacaggcagaagctcgatggaaacgacaaagatgagcttcggcagaaagggcggactgctgtttgcggccctgaatgtacttcagctcgtcggctggaccgcgatcatgatctacgacggagccgtttcgataaagggcattttcaagggaattccttccgcagtctgggcactcgtgatcggagcacttatcattctctggatcgcagtaggccttacaaatctgggcgttataaataagatcgcgatggccgctctgctcgtccttacgataattctctgcgtagtaattttccgcggaggagtcccatcgcagacagtcaaaggctcacttacatttggtgccgcagttgaacttgcagcttcgatgccgctctcatggcttccgctgataagtgattacaccagagaggcagagaagcctgtgcaggccacgcttgtaagcgtagtaacttatggtatcgtctcatgctggatgtttttcatcggaatgggagcatccctctgcaccggtgagagcaatattgcggcgataatgatgcgtgttggattaggtgttgctgcgcttgtgatagtaatcctcgcaactgtcacaactacatttctcgatgcgtggtcagcaggaatttccgctgagtcgataagtaagaagctgaacggtaaagctatcgccctgatcgttaccgtagccggcacggtctgcgcaatgctttttaatatggataacatcaccagtttcctatacctcatcgactcggtcttctcgccgatgatcgcagtgcagattgcggattattttatcctgcatgacacaaaaggcaccgacaagagcttcgactggaccggacttatcgtctggctcgccggtttcatagtctacaggctgctgatgcaggtcgatatcccggtcggcaatacgctcccggacatcgtgatcacggtgatcattgccgttattgccaggaaagcagctgccagaaccgtctgacatcaggcactgtccgatttacgaagagtagatcgggcattttttttataaaaaaacagatactttcatgtgaccgcaaaggcaaaaaaagccatgatggacataataagcccagacgggtataataagcccgaaagacatttttactgatttaaaagatggagaaaaaaatggctacaatcagagatttgaagatcgggcaggctgctgaagtctttaccgttggcggagaaggcgccttaagacagcattttctcgatatgggagttataccaggagtcacggtgcagcttatcaaatacgcgccgatgggtgacccgatagagcttaaagttcagagctatgaacttactatccgtctggccgatgcagaaaaaataactgtaaggaatatccacgacccggaggatatcggcaggtcacttgtgggcatcagttcgatgcctgacaggagagatccgtttgaatcggaatttatcgaccatccaggccttggagaaggcggcagatttcatgacaagaagactgaacacccgctgcctgacgatacagtcctgacattcgcgctcgcaggaaaccagaactcgggaaagacgacgcttttcaatcagcttacgggtgcgaaccagcacgtgggaaattttccgggagttactgtcgacagaaaagacggcgtgatcagaaaccataagaacactttagttacagaccttccaggcatttactcgatgtctccgtacacgagtgaggaagttgtttcaaggcagtttatcctcgacgaaaagccgaagggcataataaatattgtcgatgcgacaaatattgagagaaatctttatctgacgcttcagcttctggagctgaatgttccgatggtcgtcgcactgaacatgatggatgaagttcagtcgaacggcggctctgtaaacgtaaataaaatggaaaagctccttggcgttccggtcgtacctatctcagctgcaaaaaatgaaggtattgacgagctcgtagatcatgccattcatgtggcaaaatatcaggaaaagccgggcagacaggatttctgcagcccgactgacaatggcggagccgtccacaggtcgattcatgcaataatgcaccttattcaggatcactctgaggagtcgggaattcctgtcagatttgcagccacgaagctgatcgaaggagacaagagtgttgaagaggcgctgaaactcgatcaaaatgagcaggagactctcgaacacatcgtaaagcagatggagaaggagagtgggctcgaccgcgctgctgcgatcgcgggtatgagatttgaattcatagaaaaagtgaccgcatcagccgttatcaaaccgaaaaggagcagagaagagaccagaagcaacaagatcgacaggatccttaccggcaaatatacggccattccaatgtttatcctgatcatggcggtaatcttctacctgacttttaatgtgataggtggaaatctgcagacgcttctcggtacaggaatctcggctctaagtgatacagcagagagtgctatgaaggccgccggtgtaaaccagtttttgatctcacttgtgataaaaggagtattcactggtgtgggctcggtgctttcgttcctgccgatcatagtgactctgtttttcttcctgtcattactcgaagattcaggctatatggcaagaatcgcatttgtaatggataagatcttaaggcggcttggactttcgggtcgaagcatagtaccgatgcttttaggctttggatgttctgtcccggctattatgtcaagccgtacactcccatcagaacgagacagaaagctcactgtcattatgatcccgtttatgagctgctcggcaaaactgccgatctactcgtattttatctcggcattcttcccgaaacagggagctttagtgatgcttctcctgtattttacaggaatagcagtcggaattttgacagcagtcatttccaagaataccagattcaaaggtgaagcagttccgttcgtaatggagcttccgacatacaggatgcctcgtgcaaaaaatgtaggacagctgctctgggagaagactaaagacttcatacagagagcatttacgattattttcatagcttcgatggtcatctggttcctcgagactttttcaccttcatttgcaatggtaagcgattcttcgaagagcattctcgccgtggtatcgggatttatagcaccagtctttgcgccgctcggattcggcgactggaggatggcgactgcgctgatctccggcttcctcgcaaaggaaaacgtcgtatcaactatcggaatactttttggcagcgtatccgcacttcaaaaagtgctcacacctgctacagctgcatcgtttctggtcttctgcctgctctatactccctgcattgcagcgatcgcctcggtaagacgtgagctcggccgcaaatgggcgttctggatagtcatattccagtgcacagttgcctgggtgtgcgcatttatcgtacatctggtgacacttgcatttgtttaacaaaaatatataataaaaggaatatatttttgcttaccgggtgggattatgttaactttactgagcagattttttataaaaaaagatgatacagaggagaggcagagaaccgcgtgggggaatctctgcggaatctgcgggatcttttttaacctgctgcttacactgtccaagcttgcagcaggcttttttacacattcgatctctatagtcgcagatgcgatgaacaatctgtccgacgtgctctcttcggtcgttacgatcgcaggtttcaagctctcggctcagaaggccgatcctgagcatccttacggtcacggcaggatagagtacgtttcgggttttattgtttcgactcttataataatcatggcctacgagctggtacgcgattcagtgctaaggatcgtacaccccgagaagaccacattttcgctggctgcgatcgcgattcttctgttttcaatctgcatcaaactttacatgatgttctacaacagctccatcggaaaaaagatcgggtcgctttcacttaaggcggtggctaaggattcgatgagcgactgcatttctactgcgatagttacggtggctcagatcgtctcagccagaacaggattcatctatctcgatggtatctgcggaatcgttgtcggacttttcgtagcttatgagggattgagctccgcaaaggatacgcttaatcctcttctcggagaggcgcctgatccgcattttacagacaaagtaagagagataatgctagagcaggatccgaggatttcgggaattcacgatctgatagtgcacgattacggtccgggaaagcgcatggtctccctccacgccgaagttccggctgatggaaatctcgtggagcttcatgaagtcatagatgcggcagaagatgctcttgaggagaaactgaattgcgaagcagtgatccatatggaccctatcgtgacagacgatccaaaggtcctctcattgaaaaacaaagtcctctcgatcatcgaagaggtaaacccgtccctttcgcttcacgactttagaattgtaaaagaatcgaaggcgggcatggacaggatgttttttgacattctggtaccatacgggtttgatatgagtgaatctgagcttaagtctcttataaaaaaactgataagcgaaaaaatcggaccttacgatgtcagtatccatgtggacactgactactcggtaagatccgtataaaaaagattattgatgcagggcttgattaattcagacgaatgatcagactaccatcttcggggcgtcccacagattcagtttctgtccgatgccctttttaactgcgtttcgatagaccatggttccccatgccacatcctctgtaggcatgccgccaaccgagtaaatggtgatctcgtctttatctctgtgaacaggtttctttccgagaaggatgtcaccaaggtcatcaatctggtcctttgacatttttccttcagcgataagatcttcaacacgaacggccggaataggaatcgttttgtaagcgtcaggcttcatctctgactcccaggcctcgtaaagcatgatattgtcagtaactgtccttgcacgatttatgataaaatcatcgtcaaatctgagtgcggcagtcgactcgaccagagcgccaggcttgatccagtcctctttgatgtaagggtaaagtaacgggtcgccggcaggagctgaggtggacaccgatacgatatccgagtcgcgtacagcctcttccatagtatctactggaactatgtcgatatccggatagagttcctgaacttccccgataaatctcataagagaagctttcccacggccttttaccttgaccttatctatagtcggacggacagctaatgcagcagcgagtgcggtcttgctcatgacaccagggccgactattccgagagttgtcgcatcttctctggcaaatttcttgaagccaacgccgggaacagcgcctgtacgatatgccgacaggatgtttgcagacataaaagctttcggagcacctgtatccttgtcatttaaaataagcatcagaatcgagcggggcaggccctttttacggttctcggcattgctgccgtaccacttgactccggccatatcgaactgtccaccaagatatgcaggcatcgccatgaatctgcggtcggcaccatctgtaggcatctcagggaacggcgacgtcttcgggaacatgaccatgctgccgtgtgaatttccattcgcgccgcccatgcggtaatcgccgaccttcatcagcttgaacatctcttccatggcctcaatgcagcccttcatatcacggacgccggccttgatcatgtcatcttcgttcagatacaaaaaatcaatctcaggataactcatctttcctcctttgcggttccgccgcacttgaatcttcagaataacaaaagaaaggcgcccggacagcctgctgctgtccgaacgcccttgttctttcaaatcatgttttcagtatagaactttattatagtaaaaaattgtaaaaaaacgaagacacagcaaatcataatgtaataaagatgttgacaaaaactaaatgacgtgatattatttctatagttgaaattaaaaatattacaccaaaagacgaaaggtgactcataaaacacttttgcatcaggaggtaaagatgactgcaagtaaatatcttgattatgtagtaaaagagatccacagaacaattgtagcgactgtggatgatgagggcttgcctgtgacggctgccatcgatatgatggacagtgacggagacagcctgtattttctcactgccagaggcaaaaatttctatgacagattaaaaaaacgaggctttctggcgctgactgccatgaaggatgacagcaccatgaccagcgtggcagtctcaatccgcggaaaggtaagggagcttggctttgaaaaaatactttttgtcatcgagcaggatcattgtctgcactgcggcaattgtcttagtgtctgccatcagggagcagtcgaaaaaatatctgactgaaaaaccagccggacatttggtgagtggaacaaagattggagatgaacgatatgacacaggaagaaagactggattatctggttgaggcatttaaggcagattccatagaatatagcgatattaagacgccggatgatacggacgggaagcgcaggctgttacgttctcttatgaatatccgtatgccaaagaaactcccggcagaggtacttgccattcaggatgagtatctccaggaaagagccagagaaaaaggaatagtagaaatcagcgatatacccgaggtctgcaagggcattgcaatctggcagggagacatcacaaggcttgcggccgatgcaattgtaaacgccgccaactcccagatgttaggctgctttgtgccgatgcatacgtgtatagataacgtgatacattctcaatcaggcattgaacttagagaatacatgcatcaacaaatggagaagatgaagcagaaatatggccgggactatgagcagccaaccgcagtacctatgctaagtccggcttttaatcttcctgcgaagcatgtgatccatgtcgtcggcccgatcgtctctccatacctgacacagacacataaggaccagctggcgcagtgttaccttgcctgccttgatctcgccgcatcaaatgagtgtgataacatagccttctgctgcatctccaccggagtattcatgttcccgccacagaaggcagcagagatcgcagtcgcaacagtaaagcagtggcttgacgagcatccggacagctgtatgaagaaagtgatcttcaatgtctttaaggacagcgacatggaaatctatgagaaactgctgggaacagcagacagggatgcgagaggatttaagagaataagataacaattatatgacagtaagcagctgtaattcggcaaaggaatattttgctggattgcagctgctttttattttttgtgtaaaaaattattaccagatacctgtgtgactgctattaaagcacttgctttggaaaacaaatcatgatattctttatttagggaagtaagaatattttacttttgaaaggagacggcttatggatatgttgaaagtttcatctaaaggacagatttctattcctgcaaaggcaagaaaagaaatgaacattaagtacggggacaggttggcatatgtggtgtttggcgatactttagttatcaagccggttaagatgccaagtgaggaagagtttgagaaaagtcttgatgaagcacaagaatgggctgcttctgtggggcttactgaagatgatatcaatgaggctataaaagatgttcgtaaaggaaaatgcggatgaaaatagtaattgacacaaacgtagtggcatcaggtgttttctttggcggggcaccaagacgggttttagaagcaatatcatcaggaaatgttaatgcatttgccacagacgaaatcttggaagagtatcacgaaacaatagacagacttatgaaaaaatatagcggtcgatttgactcgaatggtcttacaagatttaagatgatgataaatcttattgatactcaaacgaagatagaaatttgtcgtgatccggtgatcaaaacttatgcattaaaaaataaaccaagtgagaatctccctctatccgtgaaagggtgcctggcactaaaataacgaaacaggtgccaagaaatgatttggcattatggctggtgttttatttttatgctgttacagttcaaggcagcacgcgaactgtaacactatgtctatacatttgtgtatggcttcaaataagtgcttgtatttttccccatttcgggtataatgtaattgaaagagcccaccacgcataaggcggaaacgtactgcggaccacggttgggactttttttatggagaaaattatgactgcaagcataccacagcctttaaaaccggcacttacttacgagcagcaatgctcatgtacggtaaagaagcaagcaaccgaaaacaatagatagaccgccagcactacactattccgaaccaaagaccaaaagataagcattttgagaaaatctaaacttttggattttccgtaaatggtagataacccgtcaccttcaaaaaaaattcttgacgcgttactattaaactttgaccttcttcaggttccctaagtttcaaaaattccagccctttcgggctggtttattcttgcttattttttttttcggcagatctccggtattgattctgaccacggcatgagtttttcaagttcatcgcctggaaccttttctctcggatactgatcagttctgagatcaggtatctcatgtattcgtaaggcttcaggcgttcgcttttgctgtctctgctatgctgtagtagagtgcgcttgctaagctccattgactgagtctatgatgtgccagttgtgctttcctacgcagaacttccgatgctggttctgcatcgttgttgtcaagtggaacttccggatgatcaaggaaggtcttcaggtagtattcctgatcttggcatagttcaatgcagcggaagcttcgtactcgatatcgttttgctgtcaaatgtttttacccccgcaaagaagtcctctacgagtggctgatgttttcctgccggttctttagccttcctcatagaagattctttgaacttattgtcgaggtggtaaaactgatcgatccgctttactgcctcggcggctatctcttgtgccggtgtcagcttctcgccttttttgcagcctttacgatttctgcaaactttcgtctgacgtggctgtaacacccggctactgtgtatcattgctgtttttcatgatggtgtgatacggctgtatccgtccgttaccaggattcctttgtagccttcaaggtaatccgtattacctccccattcctcgctcccagatattcataaagatatatcggaggacctccgccttttccggagatgaagcaccccaatgtatgcttgacttctttggcattacgaatggtgtctcatcacagtggagcagcttcgatttcatcagctgcttcttcatcgtcagatgaacaggtttcagataatacctgtagactgatatgagcatccggcatgtcctgccggtcaagaatgacatcatccttctgatcttcagagaggcggttcagtgggatggcattcacataattcatgttgaagatcatggcaaaaagccctggagtgagtatgctgtgagacagaattcttgcaggatgactgcccttatcacactgtctcatcatggttcccaccgtatacctttacatgatgctcaaggatcttaaactttgctggtatgcattgcagctcactgtatacgtcttcggtgagctatgccatccgtgcggaaatgcagcatcaagctcttcttttgagcattgtgtatgactatctcccgctcgacaccccttagattttcctttctctttccctcttagggtatgctctttgactttgacaacttcatctatgtctttttcaggaggaaacccgttttcagtgagagattcaggctcgtttaaaatgttattaaagagatcggacatagacatctgtccttcaatctgattctctgtttcagactttctgccaaaacggttctgggtaaggatatcgatctgctcggtaagatcttcgatctgcttaacaagcttttcattctgtgcccgaatcttagtgtcatttgcgctcagctggcgataagcttcacgcagctgaaggaacagaaaaatgatcgtttcttgggagattattcagttgagtctgtgatctctggtccgttcatactatattttatcacaaaaagagcctgaagtcgcataaatacagcgcttcaggcaccttgatatgtatgttttcaggtgcataaatatagtaagatcctgttcagtaaatccctggaggagcatctgaaataacttttttctgatcgatattcagtccctccataagccactcgtactgtcgctgcgagatcacttttgcttcggctggagtacggggccattgcagctttccattagtaaaaccgttataacacatgagccagccgttgccttcataaagaagagcttcattcgtctgaacggcgaccacagaacaggaagatggaaccaggctctgccggatcaagtccgaaagtattggtgacagtttttatgaggccatcaatgcctttctcatgtcagtatagttgcagcagagatagatgtgcgtaaaacctttagcgtcactcagcatctttcaatactcaagtcagctatcagagacttaggagtagactcgtttatgcagatctcaggtttcctgttctgatgatcatctgagtattgaacttgccgcttaaatgatcagacttttttatgatatccggttcagagacggcagtggcctgtgattgaacctgaggcagctcacacagcctgagtcttcgatgactttcctcctgagtttgcgcagataatagtagtactgatctagtgtagccattctttttgcagaactcatcaatcgtcaaaccacttgatttcgctcctgattatgtttgaccaactttgggcaacctgttttacaacttcgtttggattaacatccatgcatgttacctcccgtgaaaatgtttgataacttgaaaaactgagaaaaggttttctgagtttttaaagttattctaacaaagagatccggaacaaggaaggtgacgggttatttaccatttacgattttcctacaatgccaactacggcggaatccctcccactccttatatctttctgtatacattgaatttgtatttagtaaaatgcagacaacaccacggatcggcttttggttggacaattccaaccaaacaccacagcagacagcagaaaacattctgaacgctaggaagccggtatgattgttacatataaggggaagaaaaatttcttttaggtacttgctttcctaaaactgatgtgatacaatgatttaatccagaaaaggagtaaaaaatatgcggcaaggtattcttaaataaaactataatcaaatagtgggaacaaaggattatgatagtcccttttgtaggggcttagttttttgtacccaatttaagaatacttttgccttatcaattttgacatatccccaaaaacagcaatcacaaacaggtgtatgctgtatatgtgtatgtccgcaacttataatccccagtggtaaaagtattttactgctggggatttttatgccctttggggctgtaaagggaggacaatcacatgaaaataatcaatattggaattcttgcccatgtagacgctggaaagacgaccttgacggagagcctgctatatgccagcggagccatttcagaaccggggagcgtcgaaaaagggacaacgaggacggacaccatgtttttggagcggcagcgtgggattaccattcaagcggcagtcacttccttccagtggcacagatgtaaagtcaacattgtggatacgcccggccacatggattttttggcggaggtgtaccgctctttggctgttttagatggggccatcttggtgatctccgctaaagatggcgtgcaggcccagacccgtattctgttccatgccctgcggaaaatgaacattcccaccgttatctttatcaacaagatcgaccaggctggcgttgatttgcagagcgtggttcagtctgttcgggataagctctccgccgatattatcatcaagcagacggtgtcgctgtccccggaaatagtcctggaggaaaataccgacatagaagcatgggatgcggtcatcgaaaataacgataaattattggaaaagtatatcgcaggagaaccaatcagccgggaaaaacttgtgcgggaggaacagcggcgggttcaagacgcctccctgttcccggtctattatggcagcgccaaaaagggccttggcattcaaccgttgatggatgcggtgacagggctgttccaaccgattggggaacaggggagcgccgccctatgcggcagcgttttcaaggtggagtatacagattgcggccagcggcgtgtctatctacggctatacagcggaacgctgcgcctgcgggatacggtggccctggccgggagagaaaagctgaaaatcacagagatgcgtattccatccaaaggggaaattgttcggacagacaccgcttatccgggtgaaattgttatccttcccagcgacagcgtgaggttaaacgatgtattaggggacccaacccggctccctcgtaaaaggtggcgtgaggaccccctccccatgctgcggacgtcgattgcgccgaaaacggcagcgcaaagagaacggctgctggacgctcttacgcaacttgcggatactgacccgcttttgcgctgcgaggtggattccatcacccatgagatcattctttcttttttgggccgggtgcagttggaggttgtttccgctttgctgtcggaaaaatacaagcttgaaacagtggtaaaggaacccaccgtcatttatatggagcggccgctcaaagcagccagccacaccatccatatcgaggtgccgcccaacccgttttgggcatccatcggactgtctgttacaccactcccgcttggctccggtgtacaatacgagagccgggtttcgctgggatacttgaaccagagttttcaaaacgctgtcagggatggtatccgttacgggctggagcagggcttgttcggctggaacgtaacggactgtaagatttgctttgaatacgggctttattacagtccggtcagcacgccggcggacttccgctcattggccccgattgtattggaacaggcattgaaggaatcagggacgcaactgctggaaccttatctctccttcaccctctatgcgccccgggaatatctttccagggcttatcatgatgcaccgaaatactgtgccaccatcgaaacggtccaggaaaaaaaggatgaagttgtctttactggcgagattcccgcccgctgtatacaggcataccgtactgatctggccttttacaccaacgggcggagcgtatgccttacagagctgaaaggatatcaggccgctgtcggcaagccagtcatccagccccgccgtccaaacagccgcctggacaaggtgcgccatatgtttcagaaggtaatgtaaagatacataatcgtcaagacgacaacaatcagaagttatggagggtaacaatggaatatagtaaggaagatttaatggaagcaaaaaagcaaatttggggagtgggagagaacatgggaacagaggaaagtaaaaaaatctgggaggagaacgcacaattttgggataatgcaatgggtgacgaatctaatgaatttcacagagaggtagtgcgtcccaaagtaacggaacttctatctcctaatcctgcggattacattttggatattgcgtgtggcaatggaaattattcttcgtatcttgcacaaagaggcgcttcggttgtcgcttttgattacagcaaaaaaatgatagaattggctaaaagacggcaatcacaatatgcaaaacaaattgaattttgtgtggcggatgcgaccgatagaaaaagtatattagaattaaaaagaaatcgagcctttacgaaagcagtttctaatatggcaattatggatattacggatattgaaccacttcttatggctgtttatgaactgttgcaggaaagcggaatttttgtctttgcaacgcaacacccttgttttgtcacgttgactgaaaaatatatgacaccgcacagttactatgatatagcgattgaagggcaaccgaaagagcagatttattatcatcgttccatacaagatatttttaacctttgttttagagctggatttgtcattgatggattttatgaagaatgttttaaaaccaacaaagaaattcctatggtaatgatagtaaggcttaagaaggtaaaacgtgatagcttaaaataaattcaagtttgtcgggtaaatagcaaacccagccgagccagtcaacggtcaagatgaacggcgcatatgcgcagccgttgacagccccgcccgcctttgctggtaggcaatcaaggggcgacagcaagaagtgccaccgccccgcactattattcagaaaggggaatttccatgaccgaccagatagcctatcaagaatatatccagcgcaggtacaacgccttttgcaagactgttatccgctgtgccgccttggacaagattttgaagcttaaacggcaatgggaacggcaagtttcccttgactatctgatgaacgagaagtttgtccagtttgccgcgtcggagccggacgaggaatacccatttaccgtctgcggtcagaccgtcctgctctgcaacgccgcccttgccgacgcgatctctgttttgccggagcagacgcgggaagaaatcctgcgctattactttctctgcgccagccgcacggcgtgatcggcgcgttgtattggccggtcacgcagcacagcggggcggcatatccaaaaacaacccactaattcgtaaggagaatgtaacttcatgttgctaaaaattcaaaggcatattctgtctacctgctgttccgatttgtcttttccctggcgctttctatgtccacagtgcctttccaacgtgtactacctgaaggtggtgcagctggatgctttccagcttgtcctggtagggacggttctggagacctcctgctttctgttcgagatgcccaccggtgtggtggcggatttgtatagccgtcggcgctcggtgctgattggaatgttcctctacggcctgggctttctgatggagggtgcgctaccgtggttcgcgccggttctgctggcccaggttgtctggggttgcggtgataccttcatcaccggcgctctggaggcgtggattgcctcggaggaagaggacaaacccatagacaaggtgttcctgcggggcagtcaaatggggcaaatcggcggcgttctgggcgtggtgctgggcacactgctgggaaacataaacctgcaaatgcctgtcatctttgggggcagtttgtgcttgttgttggggctggtgttggttcgcatcatgccagaaaccaacttctcccctgctattgaggaacggcagggcttgcttaaagactttgtctgcctgttcaagctcaacctgggctttgtgaaaggcgcacctgtgttgctggcgctcttagcaatcacactatgcgggggacttgccagtgaaggctttgaccggctctccaccgctcattttctggatgacacggtaatacccgttatcgggccgctgaacagcgtcacttggttcggtgttatcagtcttatcggcagaggcttaggtattctggcttctcagttgctcatcgcccgcatggagaaaaaagggactgtcagccgaaccagtgtggtcatgtccaccagcgccgggtatatcctgtgcctggttctcttcgcggtggggcggagcttttggttcatgttgttgatgttcctgctggcggggcttatgcgcaccatcaaggagcctgtgctggccgcctggatgaacgaccatgtggatgagaaaatgcgcgccacagtcttttccaccagcggacagctggactctttcgggcagatcatcggcgggcctattgtggggctggtagcccagcaggtgtccataccctgggggctggtctgtaccgctttcctgctgttgcccgcgctgttcttagtgccggtggcgggaaagaagcgggattgatatggcatagttaagtttactgacgagcgggagattacttccgctcgtcttcatttagtagcgcaaaatttgaggactctttatttccttattcggtatagcggaggcggctgtcaattcgacataattttcttgtgatactttaccgtacatgagcattgcgcccggattgtcgttgccgtaaccctccatgaggttaatggcaccccaaatgccaagacctgcgccaagcgcgataaccaaagtctgcaatacaccaactggcgtgttgaaaaactccatataaacctcgctttctgccgctgggcggctcaaaaaaagttgtgaaaatgaaaatgccgcgttattcctcggcggctgcgtcctcgtcggacaaatctatttcgtatatgtcaaaggcttcatcgggctttacgatgccggacgggtagacaataccgttccacgtcaaaagcgtttcttttgtcgaagtcggaaaggtatttgtagttcgggtgtttcgtgatgtcgtatttgtcgcttaaaaagggacgcacaccgcgtagctgcaaaatacatttcccaccgtccataactgctattcgtcccgtgtcatcagctcctttcctaatttttgataagtaagtccatgagaaacctgcgtgccgcgattttcggaagtcattgaaactgtcgatgtttcccgtcccaagttatccgaaatatcctttgcatttttcccacgtcctcccaaaaacaaggtgctgtcggcattatcaagtatgatttctgccgcgtccttgtaaatggcttttagttggctctgcgattgcagaatgatagaagcggacatttcctgctgcaatggtcgcaattaacttatcaaagcggggtatctgcccgatgttggcaaattcatcaagcaaaaaccggacatgaataggcaatttgccgttgtattcgtcgtccgctttatcacaaagcaaattgaaaagctgcgattgcagaatagcgataacaaaattaaaggtgtcgtcggtatcgctcattatgaggaaagcgcggttttcctgtcgcccaatgtatcagttccaattcatcataggacatgagttcccggagttcctcatatcaaaaggggcaagacgcgcaccgcaagaaataaggattgactttgccgttttgcccgccgccaatttgtattttttatattgcttcaccgcgaaatggtcggggctgcgttcttctaaatcggcaaaggcagatcaacggggctttggtattcctcgtcgtcctcgcgtgcttcgcttgcattgataagttcaagcagcgttgtaaagttcatttcctcggcgggggcttcgtaccagatgtagcccaccaacgcgcaatacaaaagccgttctgcctttacccaaaaatcctccgcgcttttttctccctcacctttggtattcgctatcaacgtatttaccagcttcaaatatctttctcgctgcggatatacacaaaggggttgtagtgcatagattttttgaagttaatcgtattcagtaccttaatgcggtagcccgcccgttgcagcagcttcccgcactcaatcaaaccgtacctttcgggtcggttaagacgtaagaggaatgaagctgcattagattaggtttgacaaaaaatcttgtttttccgctgccgctgccgccgatcacgacgacgttcttatttctcgcgtacttcggctgcttcgggcggctgttcatggtaagccgttccgtctgcgtcaaaatgatgttgttttggaaatccgggtctatgtagggctttatatcttcggcgtttccccatcgggcagagccgtactccgcgcccttgcggtatttcttcgcgtttttccctttgacatagactatcaagcggataatcaccgcaccgacaatgccgacaagcaaatccaacgggtaaacgctcggcaaggcgttttcaaaggctgcggaaaatccttgtgtgatattcagtctttgcagaaatatccgcgccggggaagccgcaccgcctgtccgactttatcaaagagatagacaaagaacacataggggatattcggaagtatcagctttttgtagttgatctgcttcatatctcgcgccccctgtccattttctttaccttgtcgcgggcggcgttaagctgcttcgccttgtcctttgcagcggaagggctttgcggatagagggctttttctcccggttcagcttctttgcggaaaactcttgaaacgctgcggtcataacgtccgcgtcccggcctttgaaaaacacaaggtaacgggtctgctcgcccttaaccttttttagcgaaaaatctatgttgtatttcttcgccgtactctcaaaggctttaatattgctgtcggtgatctcgatgttggaaacacccgcgttctgcttcataagctgccgcatggtctgtttcccatgcgcgggtttgcttttctgctccaaaaacttttggattgctttctgtaacgcctgttcggtaagccgcgccgcgccttttcccactttgacgtatagggcaatcgttttttgggttacttcctcctgcaaggtatcaactcctttcccggtaaagtgcggctatgctcattcgccgccgtataagtcgtgattgacaaggcgggtatagtagctgtcaatggtactcggcgcgttgaacagcaccgcttttagatactgcttgatgttgcgcactttggttgtgttctccctcatgcaatccaaaacaaactcaatatggctgctgttcagcttcaaaaacttggatttcaccaattcggcggggtagtcgtccccggcaatacggattgtctttcgggctgtgcagacggtttccagcataaggtcaacaatctcgtccaaacggtctttgtcaattttgcagttttgaatgagatggtcgtattcgatattgtccttgataatctccctgtaaatctctactgcgctattgcttttcgcttccgttctttcctttccggcggcgtagccgcttcgccatgcgcaaagggcaaggggtttagggaatggaaaggaatggaatcggtacttgataaatcagtaattgattgttctttacttaatatatctttatttaattgcgttggattttccaacgtaggtttttcctgcgtaggtttttccaacgttggattatccaatgttggattttccaatgtaggtaaatccaatataggcggctgtccgccgctggtagctgcttccggctctcgcggctgcggctgctcgtatatgacgtaatctgcgccccgcaagcgtcccttttcgtcgcgctcccggctgcgcacgatatatccggctttttcgagttcctttaccgcttcgcggattgcgtcgatcttctcccgtgtgatagggataagcccgcaagggtataatcccaatcttcgggcagcgaaagcatttgcgacaacaagccctttgcctttaaggacaattccttgtttcgcaagtggtggttgctcataacggtatatcccgtatttcgctccactctgaaaactgccatatttcctcacttcctctcttggtatgcgtggacaattagaaagccgttttcggctgttttggtattgcaatatgccctttgccgttttcgcgtctgcaaagccgcatggcacaagggcttttgcccgtctatttgtccatgctggcgtgcgttttccgcgtccttttgccggggcaatagggacactctttgaaaacgcaaaactcatatttccacccggggcggtagaaacggcaagtgccgcaatcttcatcatctccggcacaaccggattgatagcggtcaaatcccggcttctgctgcatgagcaattcaaacgcccgctgcttgccctttgtgaaatacattccggctgcacctcctttcctgcgggcataaaaaaacggcgttactttctcccccaaaggggttaaggtaacgccgtttgtgtgcgtattcagtttttaacacattccctgtctatccgctgtccgcaaaaccattgattttattagctttttgccgctatcgctatcacacctcattattccagcgccccggttttcaagccatgcttgcagacattgaggccgggaaagtgggtacggtcatcgtcaaggacatgagccggttagggcgaaactacttgcaggtagggttttacacggaaatgctgttccctcaaaagggagtgcgttttatcgctgtcaacgataatgtggacagcgcaaacggcggcatggacaacgttttacccctctgcgaaatctgttcaacgaatggctggtgagagatacgagcaagaaaatcaaagcagtaaaacgagcaaaaggcatgatggaaagcctgttaccagcaagccggtatatggctatctcatggacgaggacgagaactatctcgttgacgaggaaaccgcgccggttgtccagcagatatacagctttgccttgccgggaatggcccgaccaagattgcccgtatgcttacacacacgagcgagaaacgagcagacgcgagagagaagaaagcagagcgcgaagcgaggaggcagcagacagccgacgatgggcagcaaaccccacgccgggacgctggaataccgcaggacgggcagcacacgccgctaccacccggctatgagtgcaaatgggcgacgaacaccgtcgttcatatcctcgaaaaccgggagtacaccggctgtctggtaaacttcaagacggagaagccctcttacaaggtcaaacacagtgtagagaaccccgtggagaagcaggctgtttttgagaaccaccatgagcctatcatagaccgagaaacatgggagcgcgtgcaggagttacgcaagcagcgcaaacgcccgaaccgctatgatgaagtggggctgttctccggtatgctgttctgcgccgactgcggccatgtgatgtatcagcagcggtatcagaacaagaaccgcaagcaggactgttacatctgcggcagctacaagaagcgtacccgtgactgtacggcacacttatccgcaccgaccttttgacggcggggcgtgctttccaatctccggcaagtgacggaatacgccgccaggcatgagagccgctttgtaaagctgctcatccagcagaacgaaatcggcggcaagagaaagaccgccgcagccacgaagcagcttgaacaggcccagacacgcattgccgaagtgaaccgcattatcaagcggctgtatgaggacaatgtaagcggcaaaatcagcgacgagcgtttcatggagctgtcggcggactatgagcaggagcagcgggaactgaaagaccgggctgccgctttgcaggaggaactttccaagtcgcaggccgccaccgtcaacgccgagaaattcatggggattgtgagaaagcaccttgcttttgaagaattgacccccaccctcttgcgggaaatgattgagaaaatcgtcgtgcatgagtgcagctatgacgagaacggcacccgcaggcaggacattgagatttattacagctttgtcggcaagatagacttgccggaagcctaacgcctgacctatccgacacagccctaagtgtcggataggaacggcaaaattttttacacttctattacttctttatcgcacattagcaaaatagaccggcttaaaacagtacacaaattaacaatcttagatgaagctgctgctttacgtattcttgaaaaagtaaattactatcgtatcagtgcttatggcattggtttgaagaaagcgtcaaattccgaagaaagtgctgcacagcaaaaacttaccatttgtcaaacatcatcaggaagcatatggcggacattttcccatttgggcagctgttgaacttatgacatttggaaatattgcatctcttttgataaagcggatgcttcacagcaatgagcaatgggaatcttttctgaaagatatagaccaaatcattaagatcctacaaagagatcatcatttagtttccaaatgtaatagttttatcaaagcgtgacctgggaattcgattcttcatgatgatgtttgacaaatggtaagtttttgctgtgcagcactttcttcggaaaatttgacgctttcttcaaaccactgccataagcactgatacgatagtaatttactttttcaagaatacgtaaagcaggcagcttcatctaaggattgttaatttgtgtactgttttaagccggtctattttgctaatgtgcgataaagaagtaatagaagtgtaaaaaattttgccgttcctatccgacacttagggctgtgtcggataggtcaggcgttaggttccggcaagtctatcttgccgacaaagctgtaataaatctcaatgtcctgcctgcgggtgccgttctcgtcatagctgcactcatgcacgacgattttctcaatcatttcccgcaagagggtgggggtcaattttcaaaagcaaggtgctttctcacaatccccatgaatttctcggcgttgacggtggcggcctgcgacttggaaagttcctcctgcaaagcggcagcccggtcttcagttcccgctgctcctgctcatagtccgccgacagctccatgaaacgctcgtcgctgattttgcgcttacattgtcctcatcaagcgcttgataatgcggttcacttcggcaatgcgtgtctgggcctgttcaagctgcttcgtggctgcggcggtctttctcttgccgccgatttcgttctgctggatgagcagctttacaaagcggctctcatgcctggcggcgtattccgtcacttgccggagattggaaagcacgcccgccgtcaaaaggtcggtgcggataaagtgtgccgtacagtcacgggtacgcttcttgtagctgccgcagatgtaacagtcctgcttgcggttcttgttctgataccgctgctgatacatcacatggccgcagtcggcgcagaacagcataccggagaacagccccacttcatcatagcggttcgggcgtttgcgctgcttgcgtaactcctgcacgcgctcccatgtttctcggtctatgataggctcatggtggttctcaaaaacagcctgcttctccacggggttctctacactgtgtttgaccttgtaagagggcttctccgtcttgaagtttaccagacagccggtgtactcccggttttcgaggatatgaacgacggtgttcgtcgcccatttgcactcatagccggggtggtagcggcgtgtgctgcccgtcctgcggtattccagcgtccccggcgtggggatttgctgctccgtaagcatacgggcaatcttggtcgggccattcccggcaaggcaaagctggtatatctgctggacaaccggcgcggtttcctcgtcaacgagatagttctcgtcctcgtccatgagatagccatataccggcttgctggtaacaggctttccactcatgccttttgctcgttttactgctttgattttcttgctcgtatctctcaccagccattcgttgaacagatttcgcagaggggtaaaatcgttgtccatgccgccgtttgcgctgtccacattatcgttgacagcgataaaacgcactcccttttgagggaacagcatttccgtgtaaaaccctacctgcaagtagtttcgccctaaccggctcatgtccttgacgatgaccgtacccactttcccggcctcaatgtctgcaagcatggcttgaaaaccggggcgctggaataatgaggtgtgatagcgatagcggcaaaaagctaataaaatcaatggttttgcggacagcggatagacagggaatgtgttaaaaactgaatacgcacacaaacggcgttaccttaacccctttgggggagaaagtaacgccgtttttttatgcccgcaggaaaggaggtgcagccggaatgtatttcacaaagggcaagcagcgggcgtttgaattgctcatgcagcagaagccgggatttgaccgctatcaatccggttgtgccggagatgatgaagattgcggcacttgccgtttctaccgccccgggtggaaatatgagttttgcgttttcaaagagtgtccctattgccccggcaaaaggacgcggaaaacgcacgccagcatggacaaatagacgggcaaaagcccttgtgccatgcggctttgcagacgcgaaaacggcaaagggcatattgcaataccaaaacagccgaaaacggctttctaattgtccacgcataccaagagaggaagtgaggaaatatggcagttttcagagtggagcgaaatacgggatataccgttatgagcaaccaccacttgcgaaacaaggaattgtccttaaaggcaaagggcttgttgtcgcaaatgctttcgctgcccgaagattgggattatacccttgcgggcttatcccatatcaaccgggagaagatcgacgcaatccgcgaagcggtaaaggaactcgaaaaagccggatatatcgtgcgcagccgggagcgcgacgaaaagggacgcttgcggggcgcagattacgtcatatacgagcagccgcagccgcgagagccggaagcagctaccagcggcggacagccgcctatattggatttacctacattggaaaatccaacattggataatccaacgttggaaaaacctacgcaggaaaaacctacgttggaaaatccaacgcaattaaataaagatatattaagtaaagaacaatcaattactgatttatcaagtaccgattccattcctttccattccctaaaccccttgccctttgcgcatggcgaagcggctacgccgccggaaaggaaaagaacggaagcgaaaagcaatagcgcagtagagatttacagggagattatcaaggacaatatcgaatacgaccatctcattcaaaactgcaaaattgacaaagaccgtttggacgagattgttgaccttatgctggaaaccgtctgcacagcccgaaagacaatccgtattgccggggacgactaccccgccgaattggtgaaatccaagtttttgaagctgaacagcagccatattgagtttgttttggattgcatgagggagaacacaaccaaagtgcgcaacatcaagcagtatctaaaagcggtgctgttcaacgcgccgagtaccattgacagctactataccgcccttgtcaatcacgacttatacggcggcgaatgagcatagccgcactttaccgggaaaggagttgataccttgcaggaggaagtaacccaaaaaacgattgccctatacgtcaaagtgggaaaaggcgcggcgcggcttaccgaacaggcgttacagaaagcaatccaaaagtttttggagcagaaaagcaaacccgcgcatgggaaacagaccatgcggcagcttatgaagcagaacgcgggtgtttccaacatcgagatcaccgacagcaatattaaagcctttgagagtacggcgaagaaatacaacatagatttttcgctaaaaaaggttaagggcgagcagacccgttaccttgtgtttttcaaaggccgggacgcggacgttatgaccgcagcgtttcaagagttttccgcaaagaagctgaaccgggagaaaaagccctctatccgcaaagcccttgccgctgcaaaggacaaggcgaagcagcttaacgccgcccgcgacaaggtaaagaaaatggacagggggcgcgagatatgaagcagatcaactacaaaaagctgatacttccgaatatcccctatgtgttctttgtctatctctttgataaagtcggacaggcggtgcggcttgccccggcgcggatatttctgcaaagatactgaatatcacacaaggattttccgcagcctttgaaaacgccttgccgagcgtttacccgttggatttgcttgtcggcattgtcggtgcggtgattatccgcttgatagtctatgtcaaagggaaaaacgcgaagaaataccgcaagggcgcggagtacggctctgcccgatggggaaacgccgaagatataaagccctacatagacccggatttccaaaacaacatcattttgacgcagacggaacggcttaccatgaacagccgcccgaagcagccgaagtacgcgagaaataagaacgtcgtcgtgatcggcggcagcggcagcggaaaaacaagattttttgtcaaacctaatctaatgcagcttcattcctcttacgtcttaaccgacccgaaaggtacggttttgattgagtgcgggaagctgctgcaacgggcgggctaccgcattaaggtactgaatacgattaacttcaaaaaatctatgcactacaacccctttgtgtatatccgcagcgagaaagatattttgaagctggtaaatacgttgatagcgaataccaaaggtgagggagaaaaaagcgcggaggatttttgggtaaaggcagaacggcttttgtattgcgcgttggtgggctacatctggtacgaagcccccgccgaggaaatgaactttacaacgctgcttgaacttatcaatgcaagcgaagcacgcgaggacgacgaggaataccaaagccccgttgatctgctctttgccgatttagaagaacgcagccccgaccatttcgcggtgaagcaatataaaaaatacaaattggcggcgggcaaaacggcaaagtcaatccttatttcttgcggtgcgcgtcttgccccttttgatatagaggaactccgggaactcatgtcctatgatgaattggaacttgatacattgggcgacaggaaaaccgcgcttttcctcataatgagcgataccgacgacacctttaattttgttatcgctattctgcaatcgcagcttttcaatttgctttgtgataaagcggacgacgaatacaacggcaaattgcctattcatgtccggtttttgcttgatgaatttgccaacatcgggcagataccccgctttgataagttaattgcgaccattcgcagcagggaaatgtccgcttctatcattctgcaatcgcagagccaactaaaagccatttacaaggacgcggcagaaatcatacttgataatgccgacagcaccttgtttttgggaggacgtgggaaaaatgcaaaggatatttcggataacttgggacgggaaacaatcgacagtttcaatacttccgaaaatcgcggcacgcaggtttctcatggacttacttatcaaaaattaggaaaggagctgatgacacaggacgaaatagcagttatggacggtgggaaatgtattttgcagctacgcggtgtgcgtccctttttaagcgacaaatacgacatcacgaaacacccgaactacaaatacctttccgacttcgacaaaagaaacgcttttgacgtggaacggtatatgtctacccgtccggcaatcgtaaagcccgatgaagcctttgacatatacgaaatagatttgtccgacgaggacgcagccgccgaggaataacggcggcattttcattttcaacaactttttttgagccgcacagcggcagaaagcgaggtttatatggagtttttcaacagcgcagttggtgtattgcagactttggttatcgcgcttggcgcaggtcttggcatttggggtgccattaacctcatggagggttacggcaacgacaatccgggcgcaaatgctcatgtacggtaaagtatcacaagaaaattatgtcgaattgacagccgcctccgctataccgaataaggaaataaagagtcctcaaattttgcgctactaaatgaagacgagcggaagtaatctacccgctcgtcagtaaacttaactatccatatcaatcccgcttctttcccgccaccggcactaagaacacggcgggcaacagcaggaaaggggtacagaccacccccagggtatggacacctgctggctaccagccccacaataggcccgccgatgatctgcccgaaagagtccagctgtccgctggtggaaaaagactgtggcgcgcattttctcatccacatggtcgttcatccaggcggcgccacaggctccttgatggtgcgcataagccccgccacaggaacacaacaacatgaaccaaaagctccccccaccgcgaagagaaccaggcacaggattacccggcgctggtggactgacacactggttcggctgacagtcccttttttctccatgcgggcgatgagcaactgagagccaagatacctaagcctctgccgataagactgataacaccgaaccaatgacgctgtcagcggcccgataacgggtattaccgtgtcatccagaaaatgagcggtggagagccggtcaaagccttcactggcaagtcccccgcatagtgtgattgctaagagcgccagcaacacagtgcgccttcacaaagcccaggttgagcttgaacggcagacaaagtctttaagcaagccctgccgttcctcaatagcaggggagaagttggtttctggcatgatcgaaccaacaccagccccaacaacaagcacaaactgcccccaaagatgacaggcatttgcaggtttatgtttcccagcagtgtgcccagcaccacgcccagaacgccgccgatttgccccatttgactgccccgcaggaacaccttgtctatggtttgtcctcttcctccgaggcaatccacgccctccagagcgccggtgataaggtatcaccgcaaccccagacaacctgggccagcagaaccggcgcgaaccacggtagcgcaccctccatcaaaagcccaggccgtagaggaacattccaatcagcaccgagcgccgacggctatacaatccgccaccacaccggtgggcatctcgaacaaagcaggaggtctccagaaccgtccctaccaggacaagctggaaagcatccagctgcaccaccttcaggtagtcacgttgaaagcactgtggacatagaaagcgccagggaaaagacaatcggaacagcaggtagacaaatatgcctttgaatttttgcaaacatgaagttacattctcctttacgaattagtgggttgtttttggatagcgcgcccctgtgctgcgtgaccggccaatacacgcgccgatcacgcgctgcggctggcgcagaataaatagccaggatttcttcccgcgtctgctccggcaaaacagagatcgcgggcaagggcggcgttgcagagcaggacggtctgaccgcagacggtaaatgggtattcctcgtccggctccgacgcggcaaactggacaaacttctcgttcatcagatagtcaagggaaacttgccgttcccattgccgtttaagcttcaaaatcttgtccaaggcggcacagcggataacagtcttgcaaaaggcgttgtacctgcgctggatatattcttgataggctatcggtcggtcatggaaattcccctttctgaataatagtgcggggcggtggcacttcttgctgtcgccccttgattgcctaccagcaaaggcgggcggggctgtcaacggctgcgcatatgcgccgttcatcttgaccgttgactggctcggctgggttgctatttacccgacaaacttgaatttattttaagctatcacgttttaccttctaagccttactatcattaccataggaattcttcttgttggttttaaaacattcttcataaaatccatcaatacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcagacaaaaattccgctttcctgcaacagttcataaacagccataagaagtggttcaatatccgtatatccataattgccatattagaaactgctttcgtaaggctcgatttctttttattcaatatactttttctatcggtcgcatccgccacacaaaattcaatttgttttgcatattgtgattgccgtcttttagccaattctatcattttttgctgtaatcaaaagcgacaaccgaagcgcctctttgtgcaagatacgagaatagaataatttcaattgccacacgcaatatccaaaatgtaatccgcaggattaggagatagaagtttccggtactttgggacgcactacctctctggaaattcattagattcgtcaccttgcattatcccaaacttgtgcgtgtctctcccagatttttttactttctcgttcccaggttcctcccactccccaaatttgcttttttgccttccataaatcttcttactattccattgttaccctccataacttctgattggtgtcgtcttgacggattatggattctttacattacttctgaaaccatatggcgcaccttgtccaggcggctgtgtggcggcggggatggatgactggcttgccgacagcggcatgatatccttcagctcgtaaggcatacgctccgcccgttgagtgttaaaaagccagattcagtacggtatgcctgtatacagcgggcgggaatctcgccagtaaagacaacttcatccttttttctggaccgttcgatggtggcacagtatttcggtgcacattgataagcctggaaagattattccggggcgcataggggtgaaggagaagataaggttcagcagttgagtcctgattcctcaatgcctgttccaatacaatcggggccaatgagcggtcgtaagtccgccggcgtgctgacaggactgataataaagcccgtattcaaagcaaatcttacgtcccgttacggttccgcgaacagccctgctcagcccgtaacggattacccatccctgacagcgcttttgaaactctggtgtcagtatcccagcgaaacccgggctctgtatgtgtaacaccggaagccaaggggagtgggtaacagacagtccgatggatgcccaaaacggttgggcggcacctcgaatggatggtgtggcgtggctgcttctgggtcggccgctccatataaagtgacggtgggttccttaccacttgtttcaagttgtatttttccgacagcaaagcgggaaacacctcacaactcctgcacccggcccaaaaagaaagaatgatctcatgggtgtggaatccacctcgcagcgcaaaagcgggtcagtatcgcaagttgcgtaagagcgtccagcagccgtttctctttgcgctgccgtttttcggcgcaatcgacgtccgcagcatggggaggggtcctcacgccaacctttacaggggagccgcgggttgggtcccctaatatacatcgttaataacaaaatcaacgctgtcgcttggaaggatacaatttccacccggataagcggtgtctgtcccgaacaatttcaccatttggatggaatacgcatctctgtggattttcagcttttactctcccggccagggccaacctgtatcccgcaggcgcagcgttccccgctggtatagccgtagatagaccgccgctggccgcaatctgtatactcacttgaaaaacgctgcagcatagggcggcgctcccggttccccaatcggttggaacagcccctgtcaccgatccatcaacggttgaatgccagtgccctttttggcgctgccataatagaccgggaaacagggagggcgtcttgaaccccgcgctgtttccgcccgcacagtttttcccggctgattggttctccgcgtgatacttttcataatttatcgtttttcgtattgaccggacatccatgctgttaatgtcggtattttctccaggactatttccggggacaagcgacaccgtctgcttgatgataatatcggcggagagcttttcccgaacgatgaaaacacgctctgcaaatcaaacgccagcctggtcgatctgttgataagataacggtgggaatgttcatttccgcagggcatggaacagaatacgggtctcggggcctgcacgccatctttagagcggagatcaccaaatggccgccatctaaacagccaaagagcggtacacctccgccaaaaatcccatgtggccgggcgtatccacaatgttgactttacattgtgccaactggaaaggaagtgactggccgcttgaatggatcccacgctgcccgctccaataaaacatggtgtccgtcctcgttgtccctttttcgacgctcctcccggtttctggaaatggctccgctggcatatagcaggctctccgttcaaggtcgtctttccagcgctacatggggcaaagaattccaatatgattattttcatgtgatttcctccctttcaagcccaaagggcataaaatccccagcagtaaaatactttaccactggggattataagttcggaacaacctatgacagcctacacctggtttggattgactgttcttggggatatgttcaaaattgtataaggcaaaagtattcgttaataagggtacaaaaactagacccctcaaagggactagcataatcctttttcccactatttgattagttttatttaagaactacttgccgcatattttttctactccttttctggattaaatcattgtatcacatcagttttaaggaaagcaatcctaaaagaatttctttctccccttatatgtaaccaatcataccggattcctagcgttcagaatgttttctgctgtctgactgtggtgtgttgggttggaattgtccaccaaaagccatccgtggtgttgtctgcatttttactaaatacaaattcatgtatacaggaagaatataagacgtggaggattccgccgtaatggcttgtagtgaaaatcgtaagtggtaaaataaacccgtccacctttccttgttcccgtgaaaatctctatgttagaaaaatttgaaaaactgagaaaattttctagtttttaagttactcaaacatccgggacaaaggaaggtgacgggttatttaccatttacgattttcctacaatgccaactacggcggaaaccctcccactccttatacttttgtatacattgaatttgtatttagtaaaatgcagacaacaccacggatcggcttttggttggacaattccaaccaaacaccacagcagacagcagaaaacattctgaacgctaggagccggtatgattgttacatataagggaagaaaaatttcttttaggtactgctttcctaaaactgatgtgatacaatgatttaatccagaaaaggagtaaaaaatatgcggcaaggtattcttaaataaaactataatcaaatagtgggaacaaaggattatgatagtccctttgtaggggcttagttttttgtacccaatttaagaatactttgccttatcaattttgacatatccccaaaaacagcaatcacaaaacaggtgtatgctgtatatgtgtatgtccgcaacttataatccccagtggtaaaagtattttactgctggggatttttatgcccttttgggctgtaaaggagggacaatcacatgaaaatatcaatattggaattcttgcccatgtagacgctggaaagacgaccttgacgggagcctgctatatgccagcggagccatttcagaaccggggagcgtcgaaaaagggacaacgaggacggacaccatgtttttggagcggcagcgtgggattaccattcaagcggcagtcacttccttccagtggcacagatgtaaagtcaacattgtggatacgcccggccacatggattttttggcggaggtgaccgctctttggctgttttagatggggccatcttggtgatctccgctaaagatggcgtgcaggcccagacccgtattctgttccatgccctgcggaaaatgaacattcccaccgttatcttataaacaagatcgaccaggctggcggtgatttgcagagcgtggttcagtctgttcgggataagctctccgccgatattatcatcaagcagacggtgtcgctgtccccggaaatagtcctggaggaaaataccgacatagaagcatgggatgcggtcatcgaaaatacgaaaattattggaaaagtatatcgcaggagaaccaatcagccgggaaaaacttgtgcgggaggaacagcggcgggttcaagacgcctcctgttcccggtctattatggcagcgccaaaaagggccttggcattcaaccgttgatggatgcggtgacagggctgttccaaccgattggggaacaggggagcgccgccctagcggcagcgttttcaaggtggagtatacagattgcggccagcggcgtgtctattacggctatacagcggaacgctgcgcctgcgggatacggtggccctggccgggagagaaaagctgaaaatcacagagatgcgtattccatccaaaggggaaattgttcggacagacacctatccgggtgaaattgttatccttcccagcgacagcgtgaggttaaacgatgttgataggggacccaacccggctccctcgtaaaaggtggcgtgaggaccccctccccatgctgcggacgtcgattgcgccgaaaacggcacgcgcaaagagaacggctgcggacgctcttacgcaacttgcggatactgacccgcttttgcgctgcgaggtggatccatcacccatgagatcattcttttttttgggccgggtgcagttggaggttgttttcgctttgctgtcggaaaaataacagcttgaaacagtggtaaaggaacccaccgtcatttatatggagcggccgctcaaagcagccagccccaccatccatatcgaggtgccgcccaacccgttttgggcatccatcggactgtctgttacaccactcccgcttggctccggtgtacaatacgagagccgggtttcgctgggatacttgaaccagagttttcaaaacgctgtcagggatggtaccgttacgggctggagcagggcttgttcggctggaacgtaacggactgtaagatttgctttgaatacgggctttattacagtccggtcagcaccgcggcggacttccgctcattggccccgattgtattggaacaggcattgaaggaatcagggacgcaactgctggaaaccttatctctccttacccctatgcgccccgggaatctttccagggctatcatgagcaccgaaatactgtgccaccatcgaaacggtccaggaaaaaaggatgaagttgtctttactggcgagattcccgccgctgtatacaggcataccgtactgatctggccttttacaccaacgggcggagcgtatgccttacagagctgaaaggatatcaggccgctgtcggcaagccagtcatccagccccgccgtacaacagccgcctggacaaggtgcgccatttgttcagaaggtaatgtaaaaatacataatcgtcaagacgacaacaatcagaagtatggagggtaacaatggaatatagtaaggaagatttaatggaagcaaaaaagaaaattggggagtgggagagaacatgggaacagaggaaagtaaaaaaatctgggaggagaacgcacaattttgggataatgcaatgggtgacgaatctaatgaatttcacagagaggtagttcgtcccaaagtaacggaacttctatctcaatcctgcggattacattttggatattgcgtgtggcaatggaattattcttgtatcttgcacaaagaggcgcttcggttgtcgcttttgattacagcaaaaaaatgatagaattggctaaaagacggcaatcacaatatgcaaaacaaattgaattttgtgtggcggatgcgaccgatagaaaagtatattagaattaaaagaaatcgagcctttacgaaagcagtttctaataggcaattatggatattacggatattgaaccacttcttatggcgtgtatgaactgttgcaggaaagcggaatttttgtctttgcaacgcaacacccttgtttgtcacgttgactgaaaaatatatgacaccgcacagttactatgaatagcgattgaagggcaaccgaaagagcagatttattatcatcgttccaacaagatattttaacctttgtttagagctggatttgtcattgatggattttatgaagaatgttttaaaaccaacaaagaaattcctatggtaatgatagtaaggcttaagaaggtaaaacgtgatagctaaaaaaaaattcaagtttgtcgggtaaatagcaaacccagccgagccagtcaacggtcaagagaacggcgcatatgcgcagccgttgacagcccgccccgcctttgctggtaggcaatcaaggggcgacagcaagaagggccaccgccccgcactattattcagaaaggggaatttccatgaccgaccagaagcctatcaagaatatatccagcgcaggtacaacgccttttgcaagagttatccgctgtgccgccttggacaagattttgaagcttaaacggcaatgggaacggcaagtttcccttgacttattgatgaacgagaagtttgtccagtttgccgcgtcgggacggacgaggaatacccatttaccgtctgcggtcagaccgtcctgctctgcaaagccgcccttgccgacgcgatctctgttttgccggagcagacgcgggaagaaatcctgcgcattactttcgcgcccgccgcagcgcgtgatcggcgcgtgtattgcggtcacgcagcacagcggggcggcatatccaaaaacaacccactaattcgtaaaggagaatgtaaatcatgttgctaaaaaattcaaaggcatattctgtctacctgctgttccgatttgtcttttccctggcgctttctatgtccacagtgctttccaacgtgtactacctgaggtggtgcagctggatgctttccagcttgtctggtagggacggttctggagaccctgctttctgttcgagtgcccaccggttgtggtggcggatttgtatgccgtcggcgctcggtgctgattggaatgttcctctacggcctgggctttctgatggagggtgcgctaccgtggttcgcgccggttctgctggcccaggttgtctggggttgcggtgataccttcatcaccggcgctctggagcgtggattgcctcggaggaagaggacaaacccagacaaggtgttctgcggggcagtcaaatggggcaaatcggcggcgttctgggcgtggtgctgggcacactgctgggaaacataaacctgcaaatgctgtcatctttgggggcagtttgtgcttgttgttggggtggtgttggttcgcatcatgccagaaaccaacttctcccctgtattgaggacggcagggcttgcttaaagactttgtctgctgttcaagctcaactgggctttgtgaaaggcgcacctgtgttgctggcgctcttagcaatcacactatgcggggacttgccagtgaaggctttgaccggctctccaccgctcattttctggatgacacggtatacccgttatcgggccgctgaacagcgtcacttggttcggtgttatcagtcttatcggcagaggcttggtatctggcttctcagttgtcatcgcccgcatggagaaaaagaggactgtcagccgaaccagtgtggtcatgtccaccagcgccgggtatatcctgtgcctggttctcttcgcggtggggcggagcttttggttcatgttgttgatgttcctgctggcggggcttattcgcaccatcaaggagcctgtgcggccgcctggatgaaacgaccatgtggatgagaaaatgcgcgccacagtcttttccaccagcggacagctggatctttcgggcagatcatcggcgggcctattgtggggctggtagcccagcaggtgtccataccctgggggctggtctgtaccgctttcctgctgttgcccgcgctgttcttagtgccggtggcgggaaagaagcgggattgaatggcatagttaagtttactgacgagcgggagattacttccgctcgtcttcatttagtagcgcaaaatttgaggactctttatttccttattcggtatagcggaggcggctgtcaattcgacataatttcttgtgatactttaccgtacatagcatttgcgcccggattgtcgttgccgtcacctccatgaggttaatggcaccccaaatgccaagacctgcgccaagcgcgataaccaaagtctgcaatacaccaaactgcgctgttgaaaaaaatccatataaacctcgctttctgcgctgtgcggctcaaaaaaagttgttgaaaatgaaaatgccgccgttattcctcggcggctgcgtcctcgtcggacaatctatttcgtatatgtcaaaggcttcatcgggctttacgattgccggacgggtagacatataccgttccacgtcaaaagcgtttcttttgtcgagtcggaaaggtatttgtagttcgggtgtttcgtgatgtcgtatttgtcgcttaaaaagggacgcacaccgcgtagctgcaaaataacattcccaccgtcataactgctatttcgtcctgtgtcatcagctcctttcctaatttttgataagtaagtccatgagaaaccgcgtgccgcgatttcggaagtattgaaactgtcgattgtttcccgtcccaagttatccgaaatatccttgcatttttcccacgtcctcccaaaaacaaggtgctgtcggcatattcaagtatgatttctgccgcgtccttgtaaatggcttttagtttgctctgcgatgcgagaatgatagaagcggacatttccctgctgcgaatggtcgcaattaacttatcaaagcggggtatctgcccgatgttggcaaattcatcaagcaaaaaccggacatgaataggcaatttgccgttgtattcgtcgtccgctttatcacaaagcaaattgaaacgtgcgattgcagaatagcgataacaaaattaaaggtgtcgtcggatcgctcattatgaggaaaagcgcggttttcctgtcgcccaatgtatcaagttccaattcatcataggacatgagttcccggagttcctctatatcaaaaggggcaagacgcgcaccgcaagaaataaggattgactttgccgttttgcccgccgccaatttgtattttttatattgcttcaccgcgaaatggtcggggctgcgttcttctaaatcggcaaagagcagatcaacggggctttggtattcctcgtcgtcctcgcgtgctcgcttgcattgataagttcaagcagcgttgtaaagttcatttcctcgggggggcttcgtaccagatggagcccaccaacgcgcaatacaaaagccgttctgcctttacccaaaatctccgcgcttttctccctcacctttggtattcgcttcaacgtatttaccagcttcaaaatatctttctcgctgcggatatacacaaaggggttgtagtgcatagttttttgaagttaatcgtattcagtaccttaatgcggtagcccgcccgttgcagcagcttcccgcactcaatcaaaaccgtacctttcgggtcggttaagacgtaagaggaatgaagctgcattagattggtttgacaaaaaatcttgtttttccgctgccgctgccgccgatcccgacgaacgttcttatttctcgcgtacttcggctgttcgggcggtgttcattgtaagccgttccgtctgcgtcaaaatgatgttgttttggaaatccgggtctatgtagggctttatatcttcggcgtttccccatcgggcagagccgtactccgcgcccttgcggtatttcttcgcgtttttccctttgacatagactatcaagcggataatcaccgcaccgacaatgccgacaagcaaatccaacgggtaaacgctcgcaaggcgttttcaaaggctgcggaaaatcctgtgtgatattcagtattttgcagaaaatatccgcgccggggcaagccgcaccgctgtccgactttatcaaagagatagacaaagaacacataggggatattcggaagtatcagtttttgtagttgatctgcttcatatctcgcgccccctgtccattttctttccttgtcgcgggcggcgttaagctgctcgccttgtcctttgcagcggcaagggctttgcggatagagggctttttctcccggttcagcttctttgcggaaaactcttgaaacgctgcggtcataacgtccgcgtccggcctttgaaaaacacaaggtaacgggtctgctcgccctaaccttttttagcgaaaaatctatgtgtatttcttcgccgtactctcaaaggctttaatattgctgtcggtgatctcgatgttggaaacacccgcgttctgcttcataagctgccgcatggtctgtttcccatgcgcggtttgcttttctgctccaaaaacttttggattgctttctgtaacgctgttcggtaagccgcgccgcgccttttcccactttgacgtatagggcaatcgttttttgggttacttcctcctgcaaggtatcaactcctttccggtaaagtgcggctatgctcattcgccgccgtataagtcgtgattgacaagggcggtatagtagctgtcaatggtactcggcgcgttgaacagcaccgcttttagatactgcttgatgtgcgcactttggttgtgttctccctcatgcaatccaaaacaaactcaatatggctgctgttcagcttcaaaaacttggatttcaccaattcggcggggtagtcgtccccggcaatacggattgtctttcgggctgtgcagacggtttccagcataaggtcaacaatctcgtccaaacggtctttgtcaattttgcagttttgaatgagatggtcgtattcgatattgtccttgataatctccctgtaatctctactgcgctattgcttttcgcttccgttcttttcttccggcggcgtagccgcttcgccatgcgcaaagggcaaggggtttagggaaggaaaggaatggaatcggtacttgataaatcagtattgatgttctttacttaatatatctttattaattgcgttggattttccaacgtaggttttcctgcgtaggtttttccaacgttgattatccaatgttggattttccaatgtaggtaaatccaaataggcggctgtccgccgctggtagctgcttccggctctcgcggctgcggctgctcgtatatgacgtaattcgcgccccgcaagcgtccctttgtcgcgctcccggctgcgacgatatatccggctttttcgagttcctttaccgcttcgcggattgcgtcgatcttcccggttgatatgggataagccgcaagggtataatcccaatcttcgggcagcgaaagcatttgcgacaacaagccctttgcctttaaggacaattcctgtgtcgcaagtggtgggtgctcataacggtatatcccgtatttcgctccactctgaaaactgccatatttcctcacttcctctcttggtatgcgtggacaattagaaagccgttttcggctgttttggtattgcaatatgccctttgccgttttgcgtctgcaaagccgcatggcacaagggcttttgcccgtctatttgtccatgctggcgtgcgttttccgcgtccttttgccggggcaatagggacactctttgaaaa

SEQ ID NO: 3 - DNA, 104208 bp, Unknown
  Metagenome-assembled genome
ggcatcggaagtgatcatcatgaaccgcacaggccgcgctttttcagcccggtcaggaagtctttccatgtctcccgagactcattccgataggccgagaaaccaaggatttcgcgccttccatcgtcattggtgcctaggcaatcatcagcgctttcgagacaacccggccgttctcacgtaccttgaaatacgtagcatcgactgtgaggaacgggtaattaccttcgatcggccggttgcgaaggcctcgacttcctgatcgagatccttacagacatcggaaactgcggatttggagattgatgtaccgcagagcgtctctactacccttgcaactttcctggtggatacaccgctcacaccattccgccatggttgtaaccagagcggcttcgctgcgggagtagttctcaaaaccatcgtataaatggctgtttcctgtgcctcgtacattcaacgttcgttccgatccgcgttttgagatctctggttcggaaaccgtttctcgagtctgtacgccttctaggcgctcatatggcgctgcctggagctgttcctgggattcggctttaagaaccgaattcaggctttcctgaagaagagttcggaaagcgtcctcccggtcagcaaagtaactgtagaatttcgtcctgattcaatgtaatattgagttgagccattggttttcctttcggtactatgttgaatgtcgtgattctcattataccttaaggctgagccattggcttttgaattattgaatttacaccattatacggactctatcgtaagcttctttgcattgacaggtttatacttcttcttagtcttcttttttgacttcttcgcagtctttttctttgaagtgctcttcgcttttgacttggtggactttttctttgaagtgctcttcgcttttgactttgtggtcttcctagatgattcctttgtagtcttctttgtagtacttttattcttcttagaaatatcagtggctttgttcgagctgttcccctgatcagaaggtgctgcaggtgtagcaggattcgtggcaggcgtagtcgtagatgacgcggctgcgttattgtcagtattctgcactgtctggttatcagctggctgttcaacacttacagcagatgtcggctgggcttcttcagccgctgccgtaatcggcggagccaaagtaagagcaatagtcactgcaagagccaggtatagcttctttctcatataacctcctggttgcatttatgtttcaacatgttatattatgacacaattttgtaacatttgcaagcgattgttaacattttagaaatgggtattccctttaatacaagagttttattgattttttccccggctgcttttagaataagagggttgctgcaatcttacaaaatagaggtttttatatatggaaaagtcgtctgagaataaaaatcagattgtaaacggagtcatctggaagcagatccttatcttcttctttcctatattagtcggcgctgtgttccagactctctacaacactgtagatgctgtggttgtcggccgtttttccggtaaaactgcgctcgcgagcgtcggaggatcatcgggacagattgtaaatttcatcttctcattttttatgggcctctcatccggtgccactgtagtcatcgcacaggcttacggtgccgaggaccacaagagagttgacgaagcccttcatactgcctactctttcgcactgacaggcggaattgtcttaggagttttaggcgtgatcttttcagatccgctgctgatgcttcttcagacgccaaaagaccttttcgtgcagtcagagatctatgtaaggctccttctcggaggccttgtctttacgcttatttacaacgtcggttctgcgatccttcgcgcgatcggtgactcaaggcgccccctctacattcttatcgtctgctgcgtcttaaatatagtgctcgacctgctgtttgtcgcagttttccaccttggcgttttcggtgccgggtttgcaacagtaatctcgcagaccgtttcagccatccttatcacctggcttcttatgaaaaaaactccgggaatggccctgtctctgcgcaggcttcatatgaataagtcgattcttaaaaaaatcctgcagatcggccttccaactgcaataagcggctcgatgttttctatatcaaacatgatacttcagacagcgataaaccacatgggttcaaatacagtcgccgcctggaccgcttatggcaggatcgacgcgttctggtggatgatagaccaggcattctgcatctctatcactacatttgtcgggcagaattacggtgccgataaaccagaccggataaaaaagggaatcgcagaagttatcgtaatggaggcagtgctggccgttgctatcggaatcctggtagtaaatgcagctccgattcttctgtcattttttacaaagtccaagtcagtaatcgagattggtgcgacgatttctcacgagatcgccccgttttactggacttttatcgtatcggagatactatcttcgtcccttcgggccgagaactatgtaatggtaacgacaatcacaaacctgctcggtatctgcctcttccgaattatctgggtacactttatggcatccaccggagccgcccatctgctctactgctacccgataagctatgtgataacttctgtctttgtactcatctacttcgcttaccgccagcctaagatctttaaaaaaatggccagaaaagccgcctgatttttttataaaaacaaaaaaacagtccgtggaaaaattccacgaactgctttttgctttaaaagtaaaattaaattactttgcagtctctgctgccttctcagcttctgctgcttcatcagcctcaagaacagcctctgctgctgcgtccatatgctggtgctcagcgatatgaagaactgaagaatcgagaggtgtagtaacttcgatgtcgttattcttagcgatatcgaggtcagcaaccttgatctctgttccgataggaagctttgcaacatcgatctcgatcttatcgatgatatccttaggatatgccttgtactcaaccgtgcttacatctcttgtaatgaagccgtttgtacggtcctcgttcagaaggatgatttctgcagcacccttaaccttctcatctgcgagcaggtgctggaatgtcatgtcgagatagtgagtattaaggtgatccttatctgctgacttgatcatcgtgtcgtactctttgccatctactacgagagtggcctcagaaccaacgtgatgattcttcatgaactgtgtagcttcgtttgcgtcgatgacaagtgaaagtgactctggaagatccttaccacacatagaagcggtaataagtccctcacggcgaagtgccttagccttctttgacatgtcacgtgttttagcattaagtgatgccattgtaaaaactcctttctgcgggccgttttgaccccaggcaagacccgatttgaatctgcctacaaaaattacgccaaatgttattctaccacgacaagtggtttaattgcaagcactttatttttgtgctgctgtatttttctgatcggcctttgcaaatctctctgtaatctcttccctgtagacctttttatagaaggtaagcgagagaacaaacgaaacgccctctgcgataaggaagctccaccagacattgtttacattgccggtctgtgctaaaagccaggctgcagggataaggattataagctgtcttccaagagatacgaggagcgaatagatacttctcgaaaatgcctggaaagtagagcccataactattcccatcgcagctaccgggaaatgtatagctattgtgcgaagagccggaacgcccatccgaagcatctctttagaaggtgagaaaagtgagagaagctgatttggaaaaagctcaaacactgctgtaccacagagcatgatacagatagcaagcttcatcgcaaattttaaagactcatctatcctctccttcttttctgctccgaggttgtaggcaagtaccgggatcattccgttgttaagtccgaacacaggcataaagaaaaatgactgaagcttgaaataagctccgaatacagctatagctgtcgatgaaaacgctttaaggatcaggttcatgcagtatgtcatgacagaaccaatagccatcatgattatcgtagggataccgactgcgtagatacggcctaccactttaagatgagggtgcagcatttttttcagagaaaaatgtatctccttattaaaccgcaggttcataaatagtccaaggcaggcgccgatgcactgtcccataactgtggcgtaagctgctcctgctactcccatcttcgggaacggtccgataccaaagatgagtatcgggtcaaaaactatatttataatagctcctgtaagctgcgataccatcgaaagaagcgtgcgtcccgtggactgcagaagtctttcgaaagtaatctgcatgaaaattccgatgctgatgacagtaacgatactgacataagagtagtccagctgccttatctcagggtcagctgtctggctgtttacatacggagctgtgcaggtcagtcctatgataagaaataccgctgcacttataagtgcaaggagcacaccggtattggccgcttcgtcggacttctcatattccttctcaccaagcgcacgcgaaagcagcgcattgatacctactccagtacctgatgctatagaaatcatcagatcctgcataggaaacgcaatcgtaactgcagtcagggcgttctccgagatcatagatacgaagatcgaatcgactacattgtaaagtgcctggaccatcatagagatcatcatcggcacggacatattgacaattagtttttttacgggcatgacgcccattttgttttcctgcatcattgctcctttccttatctgagtgcaacagaacctttttattttaccagtttattttagaaaaatcaaacagatttttgcacaaaaaaatgccccaaaaagtccgatttatggtacaataaacataaatagtagtcgccggaagttccggcgcggcattaatagaaacgggggtttcaccatgactaagatgaaggaattaatggatcacgtcagaaagaaaggttacggaactgtcccatatgagaacgtgaacggagattttgtttacctttcacgcggtatcagggcagagtttatggagggcgacgacgatatgcaaaagatcatcgatgccgtcggacgctttcagcacggagattatggaaatgctgctgagcatggcaaaaccccgagagaaggtcacgaatacggccgctatgagatcacccatctgaagggcgatgattcatccgaagatccagcagtatggattcacagagctgacgattcgctgatcgtatattttaaattcgaaagataagatactgctaaggagccgggttattcccggcttcttttttctttaaaaattcctttaattttcaaaaagtaattgacagaacttataaaacagagtattatacaaatatgatttgaatgattgttcaaatgttcattttttcgaatcaaatttatacgaaagctggattatctaatatggcagacgaggagttaaaaatgaaagaaaacacaaagcctaaaggcgaagagggaaacgatgacgatgatgacgacgagatgccgccgaaacagaagctgatacagatccttatctcgacaggatttcttatcgcagcatattttattgtaagagctgatccatcccttaaagaatggcagaagcttcttatctatctgatcccgtatttttcagcaggatttgatgtgttaaaggaagctttagaagctgtcgttcacggcgaagccttaaacgaagatttcctgatgacagtctctactatcggtgccctgctgatcggattcgtgccaggtggttcttcgatgtatcctgaagcagtatttgtaatgctcttctttcaggtcggagaattttttgagggagtcgcagagggaaattcgtcccgcgccatctcccatctcttagacataaggccagacaccgcgaacgtcgagcgcgacggaaaagtcactacggtttctcccgaggaagtcgcagtcggcgagatcatcgtcgtaaaaccgggcgagaaggtcccgatggacggcacgataatcgaaggttccacaagcctcgacacagtggctctgaccggtgaatccactccgagaagtgtgacggtcggagatcagatcttatccggctgcgtaaaccagtccggagtcgttcgcgtaagagtcggaaaagccttcggcgaatccacagcatcgaagatcttagaactcgttgaacactcgagcgacgccaagtcaaagagcgagaaattcatcacaaaatttgccagagtctatactcctgtcgtagtgttagctgccgtagtcttatccttcgttccgcctgccataataggtgccgtcactggtgtcggctttaccgcagtttttgcagactggcttttaagggcactgacatttcttatcgtatcctgcccatgcgcactcgttgtttcagtgccgctcgcatttttcggaggaatcggtgccgcttcaaagaacggaattcttgtaaaaggatccgcctttatggattccctctctaaggcagatacagtagtctttgataagacaggaactcttacgaaaggagtttttgaagtcacaagtcttcaccctgactgcatcaacgcgaaggaactccttcatctcgcagcccatgtcgagcgctactccactcacccgatcgccgcttcgataaaggcggctttcggagatgaaaacgacggctgcgttgtcgaaagcgccgaggaagtcgccgggcagggtgtaaaagccatagtaaatggcagaactgtctgcgtcggaaatactaagcttatggactccgtcggagcaaagtacaggacctgcgacgatccgggcacagtcctccatgtcgcagtcgatggaaactacgtcggacacatccacatctcagatgtcgagaagcccgattcaaaacaggctgtatcagacttaaaggcctgcggtgtcagaaaaactgtaatgcttacaggtgacagggagtcagaagccaaacgagttgcaaaagatttaggtctcgacgagtacagcgcagagcttctcccagctgataaagtttcaaaggtcgaaagtctcttaagtgaaaagccagccgatggaactcttgtctttgcaggagacggaattaacgatgctcctgttctcgcgagagccgatgtcggcatagcgatgggagctataggaagcgatgcagcgatcgaagccgcagacgtagtccttatggacgacaagccgtctaagattgcgaaagtcataaatatttcaaaacacactctctcaatcgcaaaacaaaacatcgttatcgcgataactataaagctggccatactaatactcgcagcattaggcctcgccccgatgtggcttgcagttttcggagacaccggcgtacttataatctgcatagcaaattcagcaaggacactcagatacaaaaatgaaaaataaatgcgttcttccagatgaaaatgaaatggccgatctcgccgaacttttcaaagtgttcggcgattcgaccagaataagaatcctcttctgtctctacgacgaggagcgaagtgtaagcgacatcgcagaggctctcagcatgacgacctccgccgtctctcatcagcttaaaattttaaagaccaataaacttatcgactcccgccgcgacgggaagcagatcttctacttcctggccgacgagcatgtccactcaatacttggcgtcggcagagatcatatcgaagaaaaataatcgccggagcagctgcggctgctccggcacaactactattactctacccttgtaaaaggccttaacctgtctcttaatacaggcccgaaaataccagcgatcacgatcttcgcgaagtcctcaattacgaaaggaagcacgccggcggcaagtgcagcctgaaaagtcattccggctgaagtcttaagccatatcgtaccaaagagataagcaacccaggtcgctgcctccataacaataatagatagaactctcttcttatagaatctctttatcacaggaccgataataagtatcataggaataaagccgatcaggtaaccacctgtagggcctacgagcttctgcggtccgccctgaaatcctgagaaaaccggcaggccaatgagtccgatcagaagatacacgatataagctgtaactccacgcttagtatcaagtatatacattgtaaaatagagtgccagatttgtaagtgaaatcggcactggcccgataggaagtgacaaaggtccaagaatgcagatgactgcagtcataagagccgtggtcgttaagaatcttactttggaatctgtgttgtttgggttcattctgttaatagtgctgtctgacataaattatactgcctcttctctgtatttatatttgtagtcccatctatcctcttcaggcctctcccagtccggagtcgtatctcttccgagctccgcaagcatctctttgtcctgcttaatcgtagaacctgaagtcgtaagcatatttccagtgatgcttgcgctcgcgccagatgagaatgtacatcttccgttgtccgccatcagggctcttccgccggcgagtctgatatcagcttcaggattaataaaccgaaagatcgcaatcgtacgcaggatatcgtcctcagtaagtctcgggcgatcctcgagcggtgttccctttataggcataaggctgtttacagggattgatctgatgccaagctcatttaaggtaatggccatgtcgatcctgtcgtcccagtcctctcccataccgatgattccaccggagcagaccgcaagtccctcgttctgggcacgcttgatatttgcgatcttgtcgtcaaatgtgtgcgtagtgcagatatgagggaaaaacctcctcgaagtctcgatgttgttgtgaattccggtaactccagccatgtgaagcctgtggaactgttcactcgtcataaatccgagcgagcagcagagctcgatctttagctccttatgcattctctctatcacatggatgatcttctcaaagtccgcatccgaagggccataaccggaatctacgatagcaaatctgtcgacgccctcttcctgattcgacttcgcttcctctatgatctcgttctcatctctgaactcaaattcgtcacagtgagtgtgattgtgcgccgactgcgcacaaaatttgcagttctctccacaccttccgccacgtccacttataatagtgcaaaggtccactttgtcaccgcagagagcttttctgatcctgtcggcgccatcgcgcatctggtctaaatctgcagtgataagaaaagacagatcgtcccctcttttaagtctcttcccagcgatgatctcgtctgcaagtttctcgatatccatcagcttattactccttatttttaaaatacacaacaatagaaattctaagccaatttgtcacaattgtcaacataattttaatttatgcgtgacatttatgcttgtaaaatatgttcaaaaagctataataatgtagtgacaattaacattttaaggtgacaaatatgactactatagaaaaagtactggatcatctcgagaggaacaagggagtctggttctccggcgccgagctcgcgtcaaaccttagcatctcaagaaacgcggtctggcgggctgtaaaccagcttcgggagaagggctacgacatacaggccgccacacacaagggctactgcctctctgaaaagtcggacaagctctcgaaggaggggctgatcccttttcttgaaaaatatgatgacaagtcaatagtaaatatcgacgatgttttcgtctttgactctatagattcgacaaataaggaagcgcttcggcgtataacgaccggcgcctctcacggcaccgtaataacagcagagtcacagaccggtggaaaaggtcacaccggacacgcctttgcctctcccgatggcgggatctatctgagcgtcataatgctccctgataagatgaagctcaaggacccgaagaagctcacctcttccgtcgccaaatgcattgttgacacaataaataccctctgtaaaaaacctgcagaattttcaaagcccaattcctgtattttgaacgggaaaaaaatctgtgggattcttaccgaagcaggtttcgacgtagatctcggcaaaccactctggtacataacaggtatcgggataaatttcaacacgaaatcgaccgacttctcagccgagataagggataaggccggaagtattttttctgatgacgagactccagtagtcagccgtaacgaattcattgctgggcttttagtaaaaatcctctcactgtaaatgtataaatttgtgcataaaaaaagcaggccgcttaggcggcctgctctttttatgaaataagaagttatttatgcttatgctgccacggtatcggcaccggatgaagatatagctttcgctctcttcacgccaccatgaatggtaataccatcatagaatacggtccaaacaagggctacagtgtatgctgccacccacggaaggttaagtccgatctgtgcgtgtgcaatgaatgcgcaggttacaaatgagtagaatgtaccggcgatcattggcatccaggcgaacctagccttgttgttctcgaacatgtagatcgtgatacctgcaagggcgaacagtgagatcatctggtttgaccatgcgaagtatctccagaggatgttgaatccatttgcatcgagcttagcccaaacgaggattacatatacgagggcgaagataggtgctgcaaggagaagacgctgtgagttcttttcctgcttcaggtggaatgtatcagtaagagtaagtcttaatgatcttaaagctgtatcacctgaagtaataggaagtacgatgacaccgatgatagagatcataccacctacaggtccaagtgcgttcttgcagaggataccaacgactgatgtagcacttacggctgccatcttgccatttactaatgcgttgaatgtccatgcctttgtagtctgatcaaagagcattgtaacaccgccggccttagctccaaggttgatcatagccatagtaccagctgcccagcacatagcgatgaagccctctgttaccatcatatcgtagaatacgaaacgtccttttctctcgctcttaatagtacgtgatacaagggcggtctgtgtcgtatggaatcctgaaaggataccgcaggcaactgttacgaagaatataggaaggaagtgtccgccaattcctttggctccgtctgcgaatggacctgcaccgaagtatgcgccatagttgaagccgctgttggcaccgttagctccaactgtattccagcttgcccagatatctgtaagaggatatcctttagcaaagattgcaacaaagatacctactgctgagataagaagtatggcaccgaagataggataaatacgtccgatgatcttatcgatagggaatactgttgcaatcaggtagtaaacaaagataactgtgtaaataacccatgtaacaggatctgaaggagctccagaacgaccaaggatctgagtgttgaagatatctcctggtgtgtagatgaatacggctcctacaagtaaaagcaggatacagatgaaaacatcgtacagatagtagatacctctgtttgtgtacttctctacgaactgaggcatctgcataccgccttcacgagtacagatcataccagcgaagtagtcatgcattgaacctccgataacgtttccgatcgggatagcgaggaatgcgacaggtccgaaaagaataccctgaataggtccaaggataggtcctgttcctgcgatatttaaaagattgataagtgcgttcctccatgtagccatcggaacgtaatccacaccatcctgcttagcgtaagcaggtgtctctctgtcatccggttcgaaaactctctcacagaagtgtccgtaaagagcgccaccaccgattaagatgacaaggccgataataaaagttgccatgtttgttttcccttctttctacttttcccagacctcctgaataaaacggcaacagatagacaggagctcctttactttgttaattgaatatattttaatgctattgtgaataaaattcaacggcaaaagtaaagatatctgtacaaaaaaccggtcaaagtaaggtgcggcgcatcatattcacttttaagatgaattattttcacttataattcaatttttcgataactgcctttatcgtgtttggaatgtcaaatttttcctcgtctatagtgatatctgcgtatttttcccgatcagtattatattgtccctcatgttctttcaatcctggtctgaagcattgtcccgacagcgtctgcaaacatatcaagctgtcttatcctcgcaaaatccgatccgtagatcttgtgaacgttcggaagggatttgtcatttcctgtaaagacgcagagcacgtttatgcccttcatcctggccgagtgtacctcggctgctgtatccaaaacgccaacctctgcggcatagtctctgtaccgtccgtcgcctgtccgcacctttatcatgtcgtttggcgtgcagtctgataagacgataagcagtttgtggtcagcgtgattttcctcgaaaattgagtgtttcgtctcagacatcagcccggctgcgatcctaatagccatcccgtctctattggccccggtcgtagcataccggaatatctccctgttcctgtccttctcgctgtagtcacggtataggttaattactgtatatcccgtcatcgagcagaatgaatagactctgaccgggatattgcatttcgtcagcgcttctgcgatcatatagccctgagcggctacgatctcctgcctgtgtatctcggaagtcgaagcgtcgagaagcagatcaacggagatatttccattgtcacccggtattgtttttttgaaaatcctgtcgtcatcgagatacagagctctccataccttagccgggacaatttttccggacttggaccttatcgtctgatcctccatcctgactaagaccgagtttctgatcttttcagtcagcttctcgatctggacgcggtgaatgacttcgttgtctttataggctctctcgttgtcctttgcctgatctatcgcctgtttatgcatcttaccagcaaaaccggcatcaagcatcttctcgtcgtagtcgcctcttgtaaagtgaagcttaacatcggtgtgatttccgtagcagtactctttttgaagcctctttgtctcgttttcgctgcagactgaatttccgaaataatttgaaatatatttctttaagccttcgtccgtctgagctgtgtactttgcgaaggaaaccgtcaggtggctctggtctacgacgcttccgccgtactcgttcgtatgctctccgtacccgaatgacatgtgccttacaggcccgctctcctgctttgagagtttcacctttcttctgataagagcgatgggtgaagagagatgaatgtgaaaattgtctagaaatgtttttttatgtgcgcccgatgtatatggaaaataagtctttaaggccctatctatccgctctatcgcaccgtcggtatcaaggtcgccagggatttcaattgcatctaagagttttctgtcgactatgtccgggatctgggcatcttctccgaggcaatggtgcaggtgcccgtgtgttactgcgataagcctctcacctgcagagtcctcaaaattgacattgttcctcgtctcttccaaggcccttgcggcatactcctttctcaggttagaaagtgcatacctcttatccacttctttttgaaaagccccgttctccattgctatccagaacaggctctcatagacgccctggtttatcttctcatgaaatgagttatagtaagtaaggagtttttcccagtcgtatcttctgtggatcacgccaaccatcgtgttccagtatatgtcagcatgtccgtcctcatcatagactcgaaatcctgtctctatcgaatagtcgtgagctccgttccatatcagatttgaagcgcgttttttttcaaaatctgttatttccattaattcttaaaaatactttccctgtccaaagtcttagggaatctgacagtcacaatatcgtttacaagctgcctctcgtattcgtcaaagcacttgttaacaacgccaagtttaagggcatcgtttacgccgagtcccttgtctatcataccgatcgatgacatcaggcctcgaaggtcgagtgccttcgaagaaatctcaccgccctcgcatttctttctgatctctgaaaaaagttctgcaaactgcgtcacaaaatcgtctttaaggtccggataatttgctgagataagcttcttcaagttatcctctgcgatgacaggcatctggattatcataaagcgcgacgccaaagcctcatttaattcacgggtaccggcatagccatagttcattgtaccaatgaaacgggtggcctcgttcagatgaatcctctcgtatccaggcacatctataacacgcctgaaatcaagagtcgcatgcaaaactgcaagtgactcattctttgccatatttacttcgtctaatacgccaaaaccaccgttttctgcgcattggaggataggtccttttcgaagcgatacttctccgtctttaaatgtatctgtaccgatgagcgaagccgcatccgtattaatatagagtgaaatatcccactgcggacgggagaacgcaagtgccaggccctcggccaggacatttttaccagtggctttcggtcctacgagaagcaggttctgtccggcagcaagagtagaaagcgcctgttcccagacctgtgtgccatagtagttgtactgcggctccggaatcctgtccgaaaggtcggggtcaactttgtagtagttcctgaagtttaccacatcttttaaaatgcggtccgatactccctctttttttaaaaattcgataatgtctttcataaaatttccttaaaaaacagcaggccaccgctcaggaaaacccccgcgcagtgacctgcttttctaaactaaattactaaaaatcagctaatccatctcaggctgccactgtctgtcctgatggtgctgtatttgctctcttttttccggcgtgaatcgtgataaacagatagaagatcgtccagacgatcgcaatgatatacgaaacgttccaaggaagattgaatccgatctgctggctcatgatgaatgcgcaggttacgaatgaatagaaggatgcgatcatcattggcatccaggcgaagcggcctttgccgtgagcgtacaggtagatgcaaaccgatgccagagcgaacagtgtcatcatctggttggaccagccgaagtatctccagagagtattgaatccgttggcatccatcttagcccagataaggataacatatacgactgcaaagataggagctgcaagtccaagacgttttgcgttcgaattctgcttcagatggaaggtatctgtgatagtaagtcttacagatctgagtgctgtatcacctgatgtaataggaagtacgataacaccgatgatagcgatcataccgcctataggtccaagtgcgttcttgcagaggacacctacaacagtcgtagcgttgacctgtacaagctttccagcctgcatagcctggaagaggccatcctttgtcatcgtaacgccaccagccttggctccaagattgatcatagccattgtaccggctgcccagcacatagcgatgaagccttctgtgagcatcatatcgtagaatacgaaacggccgctcttctcactctttatagtacgtgatacgatagaagtctgtgtagaatggaatcctgaaaggataccgcaggctactgtaacgaagaatacaggaatgaagtggtgaccattcgctgcgaatggactcgatccaaagtaagcgccatagttaaaaccgccatcggatgcaaacttgccaactgtatcccagctgccccatacattcgtaagaggatatcccttggcaaagatggcaatgaagataccaactgctgagataagaagaatagcaccgaagataggatagatacgtccgatgatcttatcaatagggaataccgtagcgatcaggtagtaaatgaagatgcaggtgtaaacgatccatgtaacgtaatctgtagctgcacctgagcgtccgaggatctgggtatcaaagatatcaccaggagtgtagataaacactgttccacagagaatcagaagaatacagatgaatacgttgtagaggtagtagatacctttgttcgtgtactttccaacgaactgtggcatctgttctccaccttcacgggtgcagatcataccacagaagtaatcgtgcatcgaaccgcctaaaacacatccgagaggcattgcgataaatgccagaggtccgaacaggataccctgaataggtccaaggataggtcccgttcctgcgatattaagcaggttaataagtgcgttcctccatgtcgccatcgggacatagtcgacaccatcctgctttgaataagccggtgtctctctgtcgtctggttcgaagacacgctctacaaagtgtccgtagagatagcctccgccaaccagaatacacaaaccaattataaaagttgccatattacatttcccttctttctactctataacccggaccccctgcgtaatcgtggcaacatctatacaggagacccaacctttttacacaaatacattttaatgctacatttagttaaattcaacaaatttggtcacaaaaaatgtacaaaatacggcacaatgtctaatcgcatggttatttttcaattattttttgtgcaaaattcacatataattagcaactgtaaacatcggttttaccgtaacaatctcctgatactcttccctgctcactactttcgtgctgtcgcaggccttcaggtcctcctttaagacttcaagggcctcgtcaattgtctctgccctctcctctcttataatgcgctttaacatctcaataacaacaggatggctgtatctggccggcaggtggtagctttcaaagccgccgagaaaatgctccatatcgtggagtgccctgttgtaatccctgtccacattccttttgttctttacaggaccaggcaaaaccttcgagtttatcataaggattataagcatagcgcacacaagcattgtgattaccgcaggacccgatgccataaggcccatcaggcgaaggacaagggacactgcaaatccaacgattcccgcaagaagcaggataaaagcgattgccttatactggggctttataaggtcaagcttacgctttatctttgccatgccggagagattctcatagagaccagggctctttttaaggcagacttcatcgcgctgcagtgcgcggatcgccttctgcgccttctcagagagctccttcgattccatcttcttcctgagctcttcctctcttttctccttctcgactcctgcagggctcatcgtatagatattcggagcagcctctgagatgtcctttaacatcctgtcggcctcattcatatttttaaaaatatactgccactccctgccatcgtcgtatcttattaccatgtagagcaccggcgcaagcattcccctgccatctgcattgctgtaggcgactcgtttaaaaacgtgtgtaacagcggagaacggaatgtagcggactctgtttctgatctttccaggtacaaatatcgccttgtttccgacaccgcagacactgtacttcctgcagtgctttctgtcttcaatcacttcatcttcatctaaagactgactgcttattgatcttaactttgccattttaaaaaaaattccttatcctagattttcgctttaagctaaaaacattatagcactaaagcccattgcaaattgtgtgcaaaagtgtacaataaatttaaaacgagatgtgaatttatgaagaaaaagacctggccagctggccaggtcttatgtttactcaaatctctcatcaataacacgtttggtcttctttgtgcttctaggcagaagtccattctcgactacttttacgataggcgtaaatccgatcctgctctttaccttctcggcaactttaaggccaagtccctcgaaatcgacctttcctgaaactgcctcgatatagagacgcatagtgtcttttccgtcgagatgcgagatcctgatctggtactcgcttgtcgtctcgtcgaactctccaaggatctcttcgatctgggccgggaagacgtttactccgtggatcttcatcatatcatctgtcctgccctggataatatctatcctcggatacttgagtccgcagctgcaaggttccggaattatccttgatatatcgtgagtcctgtatctgataagaggggcgccctcttttttgagggtggtaataactatctcaccccactcgccatccggaagcgtctctcctgtcttggaatttattatctcaagatagatgtagtcatcccagtagtgcataccggactcttctttacagcttatgccgattcccggaccgtagatctcggtcaggccgtatatatcgtagagctcaattccaaggatcgccttgatcttgtttctcatcttatcgctccagcgctcggagccaataaggcccttcttcagatgaacctgatcctcaaggccacgcttttcgacttcctctgcaaggaggagggcatagcttgaagtagcgcagaggactgtagaatttagggcgatcatcatatcgatctgcttatttgtatttcccggtcccataggaatagccatggctccaagcttttcgcatccggcctgaaatccgattcctgcggtccagaggccgtatcctggtgtgatctgcaccctgtctttatttgtgacacctgcgacctcgtagcatcttgcaaacatcgtggcccagtcatcgacatccttctgggtgtagggaatgattacaggttttcctgtcgttcctgaagatgagtggattcgaacgatcttttcctcaggggctgtcataagtccgagcggataggcgtccctcaaatccttcttctcagagaacggaagctttttaaaatcgtccgccgaatgtacttcgtggatcccagcttcttcgagcttttttccataaaaactgtctgccttctccagatcgtgaattctctcatttacgagttcaagctgttctgcactgatctccattttatgcctcctgtttaagcaatccgttaacgtaatccactgccttgaaattcatctcgtgagtcttttccggaagctgctttctgatggcacatttaagcccttcaactgttatcccgagttctcccgaggcggctgcgcccgcgagaagagcgatatttaagactttatccgagccgcatttttcacagatcagatcaccgtcaataagactcacatgtgaaaaattatcctgtaaatattttatcgcatcggatccgtcgtagtcagaaccgctgaggcttgcagtaacaggctttactgccttgttatttacaattacgactccgtcgtctttcagataatctatacaccttacggcctctccaggctcgaaagcaataagcacatcggcggtatgcttcgggatcattggagatgcgatcggactgtctgaaatcctgacatggcttactaccgagccgcctctctgggccattccaatggtctcagctgttcttgcgtaaagccctgcctccataccggagagtgcaatgatccttgaagccttaactgttccctggcctccgactccgcataggagaatactcttagtcatctgctcctcctttcactccgatagcgcctacagggcagatcgtctcacagaggctgcatccatagcagagcgacttctcgatctctgccttaccttcgttcatggaaatagccgggcagccaatctctgtgatgcacttcctgcatccgatacatttatctgtatcgactgaatatgccctcttaggcttctcaagcgcgatgcagggcgctttgaaaataactgcctttacccccggctcacaggcagctttcttaactgtatctattgccttcttctggtcaaacgggtcgactgtctcaacgaaggagagcccgatcccgcggagaatgttctcaatagagactgcattcgcgatatcctcgcgaatcccctgttttctcttctcaaaaaagtccatcatcgtaatcccggtgcccggatgcggctgatggcccgtcattgcggtcgtcgaattgtcaaggactataagcactatatcattgtgattatagaccgcatttatcacacctgtaattcccgatgcaaagaatgtagaatctccaatgaatgaaaaagcagtagtgtctttatcaattgccctgatgccctgagcgatcgttacatcagctcccatacaaagacaggtatctaccatatcaagcggcatggcgtttcccaaagtgtagcagccgatatctccgcaaaaaactgcctttctgcccttcatagcctgctttaccgcataaaacgatgcgcggtgcggacagcctgcacagagaacaggcggacgcactggagtctttggcttttccggaagctctcccgctttaaggttttctattcccaaaaatgaagagacatacctgatcacggactccggtgaattttcaccggctgcggcagtagtcccgtcgagctttccgtaaattttcgtcttcaggtgatattttcctgctgtaaaaataagcgccctctctatcaccgggtcgagttcctcaaggcagaggacttcgtcgagcccgtctaagaatttaagagctgccttctctggaaatgggaacggagttgcgaccctgaaaagcgaagtgtcattaaacttatcgtccccaagctgtgagacggcctcattgagatatgcccatgaaacaccgcctgaagctatacccttttttccattccgctttactacggaattaaatttatagtcagagagctcctctcccagtgccggatttctcttctcaatcttttcgtgatttaaaaatgaagtgcgggggaaaatgacccatcgcatcgtatcctttacgaacccttccgggacatttttcttatatgagtctgcgacatcgattgaggcacacccgtggcagactcttgtcgtcggcctgaaaagcactggacttcctatcttttcagagagctcgaacgcatcctttatcatatcgtaggcctcctgcgggtctgacgggtcaaagaccgggatctttgaaaacatcgcaaaagtcctcgtatcctgctctgtctgcgacgagatagggcccgggtcatcagccgatacgattacgaggcctcccttaacgcccacatatgcgaggctcatcagcgggtcagtcgccacgtttaatccgacctgcttcatagtaacgagtgccctcgctccagagtacgctgcaccggcagcgacctccattgccgctttctcatttacagaccactcgacatggatcgagccgtcgttgttttttgctacagtctcgaggatttctgtcgaaggagtccccggataaccagccacgagatttacaccggcgtggattgcgccaagtcccatggcctcatttcccattaaaaatcttttcacttttaccttccactaataattattcaacgcatatcagaaaatataaacactttattattataagtgagcttaagtataaattcaacagcacttttacattacaattctgaaaaaaagcaaatcaatttttcacaaaatagacacagttttttcacaaataccatgtagaataattaacgtaatagcagaaatgctattcgaatttttttcatactctcccctttttgccacggattttttccgtggcttttattttgcagattttgcacctataataaaacattaagtgtcattttagtttgttgtagtaattctattgtgtggtaaaatatagaagttaaaattctttaaaaggaaaaatactatggatctgatgcagacattagatgtcaccaattttctgctgattctccagatgatcccgatgatcgttatgttgtggatcggagtcatcgcagcctggggacttataaagcacaagcgtaaaaaagccggctacataaaaaaagatcagaataacttcggcatcatcgtatgcgcccgcaacgaagagacctctatttcgcatcttttcgacagtataaagggatcagactacccttctgacaaaatacacgtatttcttatcgcagatcactgcaccgacagaactgccgacatagggcgttcatacccttttgtgactgtcctggagcgtcaggacggcccgcagaacggaaagggcgacgtcttaaagtgggcgcttccacgcatttttgaaatagataaagacaaaaagctcgatgcttttgcagtctttgacgcagataatgttctaaagcctgattttcttgagaagatagacgacaagctccgccgcggaaaccgcatagtgcagggaaaccgtctcggcggacagccttaccgctcaatagtcaccaaatggtacacactctactgggcatgctacacgatatttttctcatatgcccgtgaaaaggtcggtctgtcggccttccttaccggaaccggcttcgcagtggacggcgaccttttaagggaagtcggatggaatactactacgatcacagaggatgtcgagttctctcttgacaacgtcctccgcggacagcgggtatcattctgcatcaaggcagtatgttacgacgagcagcctcatcagctgggtgtgatgtttaaacagctgagcagatggtgcaccggaggctatgaagtcctgaaaaaggatttcaaatcattcgtattcgatcactcaaggccagtcaggaagatgcagagagtagatgccatcatgcttcttttgatgggtccgtgttcctggatttccgcgataatttcctatatcaataacatcatcatctggtacaagctgccgcttctctacttcctgccatcggcaggatttgcggcattttcacttatcgctatgtttgtaggagtatttttagtggcaaagtacaaccatatcccgatgcgaaagatcgggatcttagcacttcttacattcccgctgtttttattcttctatatgctctgctcgataaaaacatgcttcatacctacccgcaaatggacgcggatagagcacgaagcactggactcttctcaagactgatttttaattactggcactttttcgtctgtcatgtctcatgtagtaggcggcttttcgcttgtacatcatctgctcggcgataagctgcgcacgctctctcgtcgccgagttatctgtccagctccaccctattgaaatgcttatcatgctcttatctacttcctcgagcttttccttcatcatttcataaaaatggggctcatcgtcgtctaaaaacgtaacgataaactcgtctccgcctatcctgtagagagtaccggtactgtacgtttcctccagaagttccacagccctgattataagctcatcgcccttagaatggccataggaatcatttgttactttaagaccattcagatcggcaaagatcattccaagcggaacgtgcttcctctcgatcgcgatcatatcttcctcgtaggcatttctgttgtagcatccggcgagctggtcctttctggaaagattggtaagctgatcgataagtttctggttcttaagctcagcagttaaaaacagcgatatcgtctggattaagctctttgtatttaaaacttctgacttcacatagttttcaacgcctatatatcccactatctgtttgttatcttttaacatgactcccataaagttgtggcacctgggatcaacaatagtatccggcgcattcttcattatgctcttaacatcagatacaatgataacatcgtccttatttgcgtatctttcccaccatttgagattgtacagatcccttgtgacaggaaattccctctgctcaactcccggagcgctccacaccttggcagccttcatctccccattatcaatctgtccaaaatatatcctgtccggatgtatcagatttcccatctcagctaatacttttgcgacagcatcatctaaactgtctccattgtgcaggtactttgcgcacctgattatcacattgtcgacctgctcatttacagcgataagatcttccttcgaaagctgcgggccaagcccggtgcgtttttcgaagttaatcctctttaatttctcgatcggcacaggcttcgaatacagatacccctgaaaatatgtcaccggatatctctgcaggaaagtctgaagatcctcattttcgataccttcgatacagatcgatttgccactgtctgtgacagaatgtgtaagtccattaataatattctggtcgatcctgttttcaaagatatccttgataaactgcctgtcgatcttcacctcgtcgataggcattttcctaaggagatttagagacgagtatccggtcccgaagtcgtcaagagcgaactttattccctgcgcgtgaagcgaaacgaccttgtcccgaagcatattttcatccatgacacggcatctctcggtaagctcaaggcacaaatttttcgccgggaagtttgtctcttcgagtatatttattacagaatcggcaaagtccgatttctcgatctgcgcataggagaggtttacatttacaatgaaatccggatccttgtccacaaatgacttcgcatcgatgcaggcctggcgcattataaaattgccaagctccgggaaaacagtgtctttttcaaggatcgagatgaactcgtccggacttacgactccgtacttttcgtttttccagcggataagagcctccatgcccgaaaacgtaccgtctgcaactcttataattggctggtagcataggaaaaatcccctgcagccgtctattacgctttctcttataacgttaagctcttcgagccactgtttatttttatttgaaatatgattgtggaagaagatgagttcaccctgatgcctgtccttcgaatctgcataggcatagagaaggcaggaatagagcgtatgtgagcttatcttattatctccaagctccatagcaccgcacgcaaggaagatatgcactcttgtgtgctctacttcaatgccctgcttacattcgaggcggatcttctggtagatagcttcgagatcaattttatttatagaatttgatttgacagcaaattttgcgccctccatcctgtagagttcgcattcgccgcctacataactgcgaagcaggtcagtaaaggctataaggacctgatttccaaacgagtaaccataaacttcgtttatctcagaaaagcgggtggcaccgataagaagtaccgtgcccctctcgccactttccctgccctcttttatatcattaaaaaatgcgtatagattcggaagggaggtcacagtatctatccggttctgaataccgaaatttataacagttccggcaatatatgaagaagccgccccgctcatatttaaatatgaggcagtgacctcacaatttacataacttccgtttttatctttgatcctgcatttaacatcgacctttgacgaaacacgtgcacggatcgcttcaaactggtcttcgtattcgggcctgtcctcaggatggattctcagaagaaagtcctgatccccgtgctggatctgctctccggaaagtccgaaaaagtcaactgcggtgtggcaccatctgatgtctccggtattctcatttagtacaaataagtatctgccgtcatcagagacagtaaacgcctgaaaaagactgttcagaagtgtcttgtttccgaataaatccggtgcgctctccatacatattcctcctcacaatgacctgaatccgtatttctgatactgctctctgcgctttttatcgtccagtctctcaagcgacatctgatctaaatcgtgtcgaagctttacgtctcttcttatagtggcaagatcctcactcataaaagcttcctctctgtactgctttaaagccttaagagggcttctctttacgcccagcttttccttccagaatgcggagagcttcttttcgctcttctcgtcgggacacgaatcaatcgcatcatagattgcggaaagagtagagtattcgcgaagaagcggaacagcggcagaacttacgccctttactcccgggatattatcggaagtgtctccaacaatacctttgagatccgggatctgctctggggctacaccaaactctgccctgcataccgctggtgtgatctgggcagccttgtcgggaactaaaaatccctttccatctgaaaaaagagctgaatacctgttgtttacagcatctgccttatcctgatttgtctgcagaagccacagagtgcagcttttatccacaagctgcagataatcgtgatcttttgtaataatatatgtcggcatctccttcgaatagagcgctgccgcacttcccgccagatcatcggcctcgtagtcctcacagaattccacggcgtatccgatctcttttaacatatcctccatctgcacaaactgagatttaagaggctccggagtcgcagatctctgtgccttatagccttcgtactgttttcttctgaaggtatcacgcgacatatcaaagcagataaccatatgtgtaatctgctgttctttttcaatttttttaagggtcttcgtcatcgcgtacatggcgttcgtatagaggccattgtactgcattatcttgtcgtagtactttttcttcttctcctcatccttttcaaagaggatctgctttggaagaagtccatagtaggaagtgacaagcatcgaagaaccgtctactataagaaatctattcattatttatcaagtttaattccagcgagaaggcttccgaggcttgtagtagcttcctgtcctgaagagtactcgtgctcatctgactcctcttttgtcttaaccgctttccctcccttgggatcgtcgataaggcccttcatggtaagtgagatcttgccgtcttttatgttctttacctttactcttacatcctgtccctcttttactatctcatgagggcttgagatccttctctcaacaaactctgaaatatggacgagtcccgagatgccatctcccaaattgacaaaagcgccgtacggcattatcgactcgacttttccatcgactatggtgccaggggtaagagtttctatcctcttgtttctctcttcagcttcctgctcccttatcagctctctggctgaaagaataagcctgtcgttctcctgatcggcctctgtgaccaggacatttatcttcttcccaacgaagctgtccaggtccttcacgtagtggcctgaaagcctcgatgcagggataaatcccctgatcccttcagcgtaagccacacagccgcccttaacagcctcaattatctctacttctataggagtagaggaagccatctcagccttcagcttgtcccagttgaagtcctcctcgctctcctgcttcttaaaattctcgagcgactcatttatctctttctcgtaatccttcatagtctcttcagccatattttaatgtatctcctttatcaaaaaaataatcagtttcctttaaagccatctttataagtataagttttggaaagatttttttcaaccggattttctaaacttcatttaaactttgcctgttatcatatgaaccatcaaaggaaaacaaaacgagcacagaaaggagtctcatatgaagaattataagaaaatcttagcagtagctatagcatccgcagcagtcgttacagctggtgtttctatcccggccgtatcaaatgccgcaaaggcagaaactgcaacaactaccacctcaaagtcaaataagaagtcagctgcaggcaagaacgactcgaattcaaataagagcagttccggcaaattcaattcaggcaataacagccagccgggacagccgcctcagggtaacggccagacccctcctgagaagccgagcggagacaattctgctccgggaagccagaatagcaatagctcaaacagcagcaactcgaacagcagcaactcgaacagcaacggacagccatctcagccacctcagggcaacggaaaccagccgggaggcaatggcggcagtcagccgggaggaagccagacaaaggtaacctacaagtcagccactacatttaaaaagtccgcaactacgaagggcaaaacctacacttcaaagaagtcaggccagaacgcagtgacagctactggcaagaaagtaaaagtcacacttaaaaatgcgactataaaaaagtctggaagctcaagcggcggtgactccgataacttctacggtaccaactcagcagctctcgcaaagagcggcgcagttcttactataaagaactcaactataaaggcgacagccaatggagcaaacggaaccttcgcctatggcggcggcagctcaaagggcaacggatctacaataaagatctcgaactcaaagatcacaactaccggaaataacgccggaggcatcatgactgcaggtggcggcaaaacatacgctactaacctcacagtccacacttccggaacttcatcagcagccatcagatcagacagaggcggcggcacagtcagagtaaacaaaggaacctataccactacaggtgtcggctcaccagccatctactgcaccagcgatacagccgtaaagaatgccaaactagtttcaaaggcatcagaaggtatcgtaatcgaaggcaaaaactcagtaaagcttactaacacttcccttactgcaaataacaccaaacttaacggccaggcaaagacctatcagtcagtaatgctctaccagtcgatgtcaggtgactctgaaaacggaactgcaaagttcagcgcaactggcggatctatcaccaataagcacggcagcgtattctatgtaacaaataccactgcaaacatcagcttaaaccatgtaaagatcaccaactccgccaaaggcaatgtcctcttaaaggttgccgcaggttcctggggcaacagcggaagcaatggaggcaaggtaacatttacagcaaacaggcagaagctctccggaaagatcaccgttgacaaggtttcttcccttacacttaagcttacaaacaagtctaccttcaagggcacaataaactccaagaagcagacaggcactgtaaaagttactgtaaacaaaggatgcacctggactcttacaggtgacagctacgtaacaagcctcacaaatcacggcaggatcaacacaaacggccacaccctctatgtaaacggcgtagcttacaagggctgaacccctaagttctgatacagcgagagtatgaatttttttctgtaaaaacagatctttcatgaaaagttgcagtgatatagattaaaatattttaaatatattcttctgtatcacttgagtataatattgcatagatcagtcaagaagttcagaaataattctgtcaatctgtattattgacattacagcagttatagctttactggtagctactttactttcaaaacgtgcagaataaggcttagagccttaagtatgataaagcccgagaggttcattctgtcaagggtgccttcggcaccgcagacggctctgcccttgacagaatggacctctcagactagaagacaattaagagctctaagcctgggaatgccgtaaatacggcatctgatctatcccgcagtctgtcaggatacatgatctttaattctcctcggatcttgttccagtttctgattggcatagtccacttcttcgttgtctcccaggttgcaagatacatgctttcgtaagtgcctgtgagctcggaaatacgcttctctggcggttcagacggcgcaggatgaattgattgactctatggcattggtcgtgtagaaagctgttctgacgtctttggagaactgaatatcgggctgatggcatcccagttatcgttccaccgtgtcatccataaggatactggtccttccatttttcagttactttctcaagattggtaaggcagttttctcatcagcagccgtataagtttctaagtcctttgcaaatgctttcatgtccttgttcgggacatatttaagggtgttgcgtaccatatgcacaatacagcgctgcgctctgttttcggaaaagccgtcgatatagcatctttgatcccggtaagcccgtctgagcagagtatcaggattcctgtcctccacggttcttcaggaatcagaacagacaccagtacttgctgcttccattctcgccgacttcaatagacagtacttccttttgccgtcctgttgatgccgagaacaacgtatgctgcaagctttcttaccacactgtcatcacggaccgagaagtgtatggcatcaatgaacactatcggatatacgctgaaagcggccgttctgccattcttctatctgcggcaggattttatctgtcacgtcggagataaagccctcagaagcctcaaagccatagatatcctgaatgatctccgttatctgtgtagtgctcattcccttggcatacatagagatgatcttattgctatctctgatatatctttctggcgtttctttacaacctgtggttcgaacgtggaattccttgtccggcgggacatcgatatccatgctgccgtagctgggattgacacgcgttgtcttgtaaccgttccggtagttgcggcttcttcgtaatgccgttacgctctgatttttcatagccaagatattatcctctcagcctccatcatttctttgatggtgccaccaagaagatccttgagggcttcctggagtcgtttgcatcccggatatcatatcctgcagaagcccctggatgatggctcttttgccatctttcatctgaagtgtgtgtactggtttctttctcttcttgccataataataggccctccatgaattaaaataattgtatggtagtgtcaaataagctatgaaaaacctgggccgaaaaaaatggcccacattggaccttgaaaactgcagattttacttttgatacggacgccacccttgacagcacacctgatccgcgctgagtcgatgccgccgacggtgagaactcatgaacagacgtcttctcccgtcgaaatcatcccattgtagcgcggctccggtgtgcctcagggcatgcacctctcgtggctgttattcaaaacgcctccggttcgaatctctgaacagacagtcttaagcctctgtttgagactgcatcttgagcatttgctgttgccctaggtacatcattacctgccatttacctggcatggttcctgctttttcaatctgcggaacctgtaagtgacttgaatttcgcgtgtttgtgaggacgtagaaagttatagtaggccacccacaatgataaatcgtagttggcaccttccaggttgtcaaagccattggatgtcgatatgaggccttgtaggtcctgttcagacgttcaatcagctgcttgtatggacggaactttgtcgttacggcatcatcgtttgtagccctaagacctgggtgattttgaatttcatctgttaccgaaatgctcgagaaactgttgagctgcaagcgggtaggcactgtacccatcagcaatgaaacgaatcctttggggatgatgtttttgatgtggttgaagcataacgcatggcaaggacacagggaccgacgcttcgattaacgaagcccgatagccgatatcgatcactgacagcatccatgataaccagacatgttttacaccctgactttgatgtagtttcgtcggcagtccaggttttacttggcttgtaatcgtaatggtcaacgaatggtcttacgcacatggcagcttgcaatagttcgctacctgctgatgagagacacgaaatccatacagatcctgcagagcctgtgaggttttacgcagtgacagctgaaggtttacgtgaagtgtgagacacatcccatgatgtttgcgtcgtactttttgaaacggaacgttgcaatcctgttggaatcattgtccagtttcatcttgaataaatcgacagtgaattccctgtaaagatagtggagttatactctacttttcgtcctcttcatctggtttgatctttttcagccgattgagataaaacgaacatttcgggttaacgcattccagacggtaaagacctttctggttttacagggacaagagcacggccacagaatgggcacttgtactgatagttttgtgaaaacgcttatcagaggcaaactcgttccacagactttgcacagatactgcctttggaaccgttgttgcgatagaggtatcagcaggagctccacagcacggacgcgtgtatcagctgggatgtcgcacttgcctttatgcctgatcggcttcacgtcacggccgttgtggctgcgctggtattcacgacgaagatatttccagtccttgtggatgattggaattatctcaggaagcaatcagttttaaatttctggtactttggagaccgtgagtcgtcatgagcccactgtttgtaagcgattatctgagggcgggtataccttccaggcaaaacctctaagatgtgagatgtaagcatttactctattcacagttaggaggccacaacaatgaattccagagctgacgcgtccctgaggataagcgcattgagctgacaatgagtgtcggcgttccggactgacagatgcggaatggtttcgccagaacggaattaagccgggcactttctatatgtgggtcagccgttgcagaaaaaatagtgcagctgaaaaactgatccggccgagatccgaagagatccggccagaacctgtcgtacaggaggttgttcctgttcgattgttccggatgatccatccgatgaacatacatccctggtttctgtaccaaaggagccggtgaaatcgtaccttgacaattcacatgagatcgaagttattgccaatggaataacaatccggatccgaaatgatgcaggttcagcagcgacagacgcgtgttccggtatctgaaggagatcaaatgttaggcgatatttccggcgtagaccatatctatctggtgaccggctacacagacatggcgttccatcgatgtctgtgcgctatcatcaagatcagctgcgcatgatccctattcgaattccctttttctattctgtggcaaacgccgtgaccgcacaaggctatactgctgagcctgacgatggtgcttctttacaagcgtcttaccgttaaaggtcattatgagtggccgagaaacaacaaaggtcagagacctcacctggcgtcagttcgactggctgagtcaggtcttaaggtcgatcagccgaaagcacttcgacggatgatctggcactaagaaataccgaaaaagcttctgagatcattgactaaaaagtgccgaaaaaacagtaaaatcaaggctttcacggttttctttatgcccgttttctgatataataatgtatcaattcgaaaggaggatccaccgtgggagccagcgcagctgaactgaaaaaccgcaaattacgcgacactataaaacagctgaacactaccatcgacacgctgaattctctgatcagtacacttcagaccaccatttccgaacagaacacccgcgagcagaattataaagagcagatcgattatcttacaaagaaactctttgggcgctcaagcgagaagaaggtcggagacatcccaggtcagatgagccttttcaatgaagctgagatgaccgtcgaccagaggcagatgactgttccggtcaaagctcataccagaaagaaaagatgatcaaacgaactctttaaaggcattcctgtcaaaaagtcgtcatccctcttccggatgaccagaaggtctgcccggaatgcgggacacagatggaaaaggtcgtgtggagttccagaggcgggagcttaaatcattcctgcaaaggtaagtgtcatcgagtattacagcgagaactatgtgtgcccgaactgcaagaaagcgcttggtgatgctgataaaccattcttgtcaaatcaaaggtccctgaggctctgataaagaaaagctatgcttcctcatcagcggtcgcatggacaatttaccagaaatacgtcaacagtgtcccgctctacggtcaggagaaagactggaagcagtacggagctgcactttcaaggtcaactcttgcaggctggatcatccaatgttcacagacctgtttctttccggtcatagattactgcaccaaagctgtcctccgcgattatgccatgggcgatgagcccaggatgcagtgctgaaggaaacggccggagggcacagacgcaatcgtttctctggtgtttccgtagtgcgatgatgggcttcctccgatcatcctgttccattattcaccaacaagaagcggcgatgtcgccaaagaatttctaagggattcaacggatatctggaaaccgacggctaccagggctaacaaagtgtcgggatcagcggtgtacctgttgggcacacctgcgacgctacttcatagacgccatcccgaaagggaaacagtttgattacgtcagcctgcagtgcagggagtggagtattgtatcgattattccggcggaacgtgggatcaacagcacatgtgccgcgattatgacaaaaggaaagaactccgctcgaaaaagaaaacctgttctggatgccttctggtcctggctggatcagcaaaaccctttcatggatcccgattcgagaaggcggtgaactatgcccagaatcgcagggagacttccctgaccttccttgaggacggccactgcgtctttcgaacaacaccgaagatcgattcgtcctgcacgtcgaagaaagaactggctgttctgcgacacagtcggtggagccgaagccagtgctgccgtttattcgattgttgaaacagctcatgcacatgattaacatttacaaatatctgtttccttcttgatcaccgtcctcatgcagatatggcaactcagaactcgaacactgagccatggagcgaagctgccataaagctgccaaaagcctgccagccggattcttctgaaaatcttgtgtgaattataagttttctccatctaggatgcacttcctggacgtggaatttttatgcggggctgacgccccatgataactcgcttacactgtttgagaggaatatatctgcagatgaaagttaaaagccaacgcttttgataattaaggtcttgaatgatttgaagtaaataacgtataatgtccatgagcaatacttctttctttgtgagaatgtttggtttggccacttgacattatacacaaaaacagggggtgttgctcttttttgtgcaaaatcccttgaaatcaaggtttatacattgttattcatgctatatgcatgacactaccaattgtatcatgaaagaccctatatgaaaacttttacagactttttttcaaactctcgatacagccactcctttagacaaaaaaatcctccggtcctaaaataaagggccggaggtatttttagtcttcaattaaatccttaaactcttcttccttttctgctacgaatctgtcaaacgggccggaagtctcacttaccttacacccgtaaaaataagtttcaatccctactttctcggactgcattatctttccattgacgcggatattcttgtatttgagctcaatccagagaccgaccttgtattttttatttacaataactccaaatccattcgtagaaacatctaagagtttcgcatcgcggtcgtttgccttgcagtcctcgttaaccgggtatctggcagatgctctgttaaaggacgactcatcgttttcatttctgttaccgtaggtcagataaattctgttcccgtgatagaagaccggaacgatccttagatccgaaattatcttattcgaacccttcaaagacaggcttactactccatctttaaattcttcgaaatttcccttatcgtcagtgcagggtgctaatgctataaggctctcttcctttaccaaaaccgaagtcttatataccttcaccgcatctgctgtcttataatccaggataacttccatgccttcttttaatctttccgacagcatttctattctccttttcttacaaattcatttttacaaaaaagattataatagagtacgctgattttatcaaccttttgcgataagttggccgcatttttgtctttgaatccacattattattagtgttagtattcatatatgtcatatgtatagaataagcatatattttatactaacaaagcttagcataaaatatatgcttattctaaaatgcactaatggggaacgttaaatccgctcatatctataaggtctcccaaagaagtcgtaaaattttcatttgaatcgagcacatgcttaacttttggcgccatctccttaaatgcctccttatcagaggttagcctgtaaagcctcgaggtatttctcgcatcccacagagcatcgtgcatctgtccctcgaaattaaggccacaggcgtctactgccttatctaaagaaaccgcaagctttctgcctatagctttagtaaatatcttctgatagtcgatccagtgagaaagtatgtaggaaagcttatccgtcatcgtaatctcctttaaggctatctcgtgagtaaactgtcccttgtcagctccgctccaggcatagacattaaaatcagactcctccaggaaacaccagtcgatgaactcatcaaggacacttgaaaaatccgctgcatcctttacggtctctgccgtaatccctgtcatcgcctcgacagtcctttgaatctcttctgaatacttaggcttaacataactttgaaactggtttatctccataagcttctcatcgagcatcaccgctccaaactcgatgatctcatgtcttgctatgctccactcgtcaggatgttctctgtggtcaaccggctgcatttcaaagtctacaaagatagatcgctttgtttttgtattctgcatcgtttcaggacttctgacctccctggcttctgcgatatcttccaaaccataccgcctgagggtcccagccgtggaaagcgcactgtgtcgaacagaaccggggagcctgcatcgattcgctcaaaatcctgtcatattccacctgagccatagagaaaggccttccacagccctggcagataagggtaactgtcttcataagcatcgctccttttattaaaattctcttagaaaaatcaaatattttcaagtcccttgaggtaatttataaactgctgcgccgagcgccccgacattccattgtggcggagttcccagatatttgcctctttttcgagctcttcgtcgcttaaatggatcttctccctgtgggctaattcctttactatgtggaaatactccttctggtttggtttggagtaattgatctgacagccgaaacggtttacaagagaaagcttctcttctactgtatcattcttgtgaatgtcatttggatcagcatcgtttctgtcagtccactcctcctttatcagatgccttctgttgctcgtcgcatatataagcacattgtcaggcttcgtctcgacgccgccctcaatgacagccttcaagtatttgtagtcagtctcattaccttcaaaagagagatcgtccatatatattataaaacggtagtttctgttcttgataagcgatattacagtgctgatgtctttcatctggtgcttgtatatctctatcatccttaagcctctgtcgtaatactcgtttacgatggcctttatacttgtggactttccggtacctgaatcaccgtataaaaggcagttatttgcaccacgtccctctacaaacgcctcggtattttccacaagctgcttcttctggctctcgtacccgacaaggtctgaaaggtgaacgacttccatattgttgataggatgaaatactacctttccgtccttatcagaaatcctgaaagctttgttcagtccgaacattccgacaccgtacgccttgtaaaaatcggtcactatattaaaaaattcattctcatcctttgcggatgcaagcttcccgcttaacgtgcggaccttttcagacacagcgtgattgtacatcagatctttctttacgatagccttgtaatgggtgattaccgtaaatacatttatcccaagtgccttctctatcggcccgaagtcaaaatggaaaagattcatggctgccttaaagtcgtttttcgcaaattcatttaccgagccatcattcgctcctgtcttctcacaggtaatagaaaacggattttcatccgttataagtaaaaaagtcagatagttctgccagagatttccgtcgaatccgtaatctgtagctatggctaaaagtctgtgaatctgctcatagatttccctcgtaagctgggcatcggaggccgtcccctcttcaaaagacttgaaaatatcgccaagcttatacaaaatgctgtcatctggtatgtttccgtaggaaatgaattttacgatttctttatacatttgtcctgtctttctgcaaataaaaattcatgcattttatttttcgcatattttattgcacctgtttatctgctctttttattataccgcattcgccctctggttgtacagttgaaaaaaatctgtttctgttgtaatctattctctgccctattcggcagatggaggttaaaatgtcagaaacaagcacattttttgcagctatagcaagaatgaaatacatcgagcgctgggctcttatgcactgtgcccgtcccgaatctctcagcgagcactctctagaagtcgcaatgatagctcatgctctctgcgtaataggaaacaagcgctacggcaagaatttaaatgccgaaaaagctgcccttatcggtctctaccacgacgcttcagaggtaatcaccggcgatatgcctacccctgtaaaatacgcgaacgaagatttaaagaccgcttacaagtccatggagcatcaggctgagcttacacttttaaacaagctgccgtcagaccttgttgaatcgtatcgcgacatagtctgtgaagaggctccagccggaagtggcgaggatgagaaatacatgcgccgcctcgtaaaagccgccgacaagctttccgcctatatcaaatgcatcgaagaggagaaggctggaaactgtgaatttaaaactgcaaaagcttcaacgcgtgcaaaggtagatgcattgcgaagcgaactccctgaattaaatgacttcatgcaagacatgctccctccatacggagagactctcgacgaacttatctgaaaactcattcgtcttgtccaatcgaatggaaaggcatctagccttaaaacggatcaacctttccattctttatccactccatgaatttgttcccgcactcgtagtcttcatttccatccgtgaacatatcgatagaaactccaatattctgcagatattcttcgaactcaatatatttctccgagcgctttttcattgcttttctccaatacgcagccgacatctcatttctctcatcgtctgtcttttcaccaattatctctctagcctttactaccctctctcctttttccttcgatccagagatcaccatctgcggttcctcatagtgatctctgatgcatgaaattatccatcctgtgtaattagaaagcggagtcgtctggctgtctgcaagctttatggctcttatcacctcattttcatcgtgaagggcttccttcaaaaatgccctgatatccgactctgagagtccattatgtcctacgagatcctccatctgcttcgagagtttctggagtgtcatattctcatactggttgtttgtttcttcaacctgtttcttcttggcacttatagcctctatgaccttctcaccaggattgttccagctgattataaatttgactgctactatctttccaccgcgtcccgcagcgaccggatcgtagtcaaactttacatcgcactgctctttaagctcctttttcgctctatctagaacacgtcttcggaagtctccccactcgttaaacgacttttcattggcaatctcgactatcttatcccaactggcaccgttctgtttagctctctttaccttcgcttcatccatattcacgacgccgatcatgcatttcagctcggaaagcccatattccttgacataatagtcttccatgtcacctttttttaagtgccaggcctccgacttgattagctcatagatacgaaaagaataatcacacttgaatctgagcacattcgccagggaataactggtgtaatttcccttgatatttataatataaggggctataaccttattaaaagtcaccgtaaatacgccattttcatatctggcgttcgtgatcattgcgagtacttcaaaattgcctttatcgtcctcgatgaccatctgatgtccagtcatggtttttgcggtacttatcagctttttataaatatttgtatctgactgtctgcctaaaagcttctttatctccgatggataaagcgtcgcaaccggtgtatcaccttccatcgaaagcctcgaaagtgctatcgatgtcagtttattctcaagaagcgatgctttatacttcgctgtgatgatctcgcggcctttataaacccgctgctgatctgctccctgcggcagcttcagattttccttttcttttgtttgacttcctgccattttacctctgtttcgtacctccccagagtcttctatatcagtagtttcagccactattcaattcttcttatggcaatttctacttaccactcatattattaaaaactatttcaccctttatgtcaagtagtttctgcctttaaatcatttttttaatggtcaaaaatacttatccacctttttcctgatgctttcgttgttttcttttttctggcagaaattacttactctttacacctcttattttctggcaaaatatacttgtttaatggcatattctacttatacccctgcatcagatattttaatcatggcgaattttacttgcttttttcctcaagcgtgaaagtcatggcaaataatacttaaatccctgcatcaattatcttaatcgtggcataatttacttgttctatcttttacaacagttttcttctatgataataagtcattagtgccagtatttacggtattttccgccatacctattttatccacaagtatttagcgccattactttatacagcctacgccatatctttacttctttttcgctctaatttcaggtattttatgccatgaaaaaaccccggaatgccttattcccggggttttctgatatttgtaaataacaaattaattttgttgttgtataaatcttttattattgttttctcaatattctggcaatttttacttgctttcaggagaaaattattatgaacggatttactggatcattttctctaagatctggtttatcagttcattttcacttatttcgtacttctctgcctctttttgaaggtttgataaagctaaatctgataaaagaaagccctttctgtggcttcttgttttctttctggtaggcgtaatgtacaataatccattattgataggtgtttcaacttgattttgcgccgaatttaagtagttgatgccaggattagttgaaggcatttcctgcatatttgtattttgcgttggattttcgggtttttcttcctctttttctatattggtagtttttgccagagtttcaggctttttcgtggctgattttacttgagcagttgttttgatatttgtttcaacttttttcttctgctctttctgttcgttttcttcctctttttttattgattcaaagatatttcctgctttgctcctggaattatttttcatggcgcacctcttctaatagttcttttatcaaatttgcgtaatctattgctgcattacagttaggatattcatcaaaaagtctgacctggcgggactgtgcctctttaatctgctggcatgtccttatagatgtgttgaagactttaaatccctgttcttttccaatttctggaagctgatcatgtactaatgaatccagcgcagttctcttatcgtaaactgtaagcagaactccgtatatctcaagatccgggttaacatcctttgcatcgttgatattcgatattatctgcgccaatccatctattgcgaatttctcggctttaagtggaatgatgactccactagctgccaccagagcactggtcatataaaatccaatatttggaggtgtatctataatagcaaaatcgtatttgtcatctattttctttaatgcttttcgcagcagtgaataattctttatatgagcagcaaattcaccctctattcctgccagatgattatctcccgatattatatctccgctttctgtggtctgtattgcctcttctatcgaacactcttcatgaagaaaatcgtaaagcgttgctgtatcctgctgaacggctctgtatgtgcttgaggtattacattgtggatccatatcgatcatcagcacattgtagccacattcctggagtccgttggctaaacagagagctgttgtcgttttcgcgactccgcctttctgatttgctatagctattgtgatcatttttgtcattttcctccgtttttgtgggttgtctgttcattattatatgtagtttttatccgtatgtcaattaatgttattgttgacatatgtactttaagttgtatttggattatttgtttttatttgttgttgcattatactttttatttgccattatatttgtttttttattcttatttttatttgttatcatatttcccttctaatttgttattatatttaatttctaatttatatatttctatttatttttatttgctatctaattatatgtctaatatgtctttgcctttttatttattgtcttatttgtatatttatttttcttagtattttttttaatatttcaatttgtattttttctttacttaatattcttaattatatttatagtccaatttaatattcatattataatctttatttatatttaacattgaatctaaatatatatttgtatattaattttacaatatattatataatcatatttgtttttatattttaaatttacttataatttgtttattgaattctttatcttattcatttttatatataacgtttaattcaagttttaaattgtatttgcttttatatttaactatcatatttaacataacattataagttatacattaaattgacatctatgtcaaatttgattattacatttaaaaacaaatatataaacaaattacaatattacattagaaataaaagatgtatttaaatataactaactaattacatagttgattattaatactaattaacattctaatcaaaatacaatattaatattattgcacatttgaactcaaacaagcatgtgaattatagttagtagtatatattgtattttaatataatatataagtcaaactccacttcgtatataaatatgaatactaataaagatactaacacaatatttatgaaaatcaacagaaattaatagtatatatagtatagcaaaataataaacagttatttaaatctgtaaaatttaatgagaaaataaattctacagctatatcatttaaagcaaatatattagttcaaaaaacgcagcaaaagtggtaaaatagcagggcagtaatagtagctagaaaattatccaggcaggtaaaaaaatgaacgaagaacagattcagaaatttaaagatacactagaggaaacggagaaactttacaatgatagaaagctagatgaagcccagaaacttgtctcagattttatcgatacattcacagatgatttcccagttaaagaggacgacgaatatctttactttgattttaagacagcaatcgaagaggctatttatgtaaatgaagagcttccaaagaaaaagatgagacccattggagtgcctgtatcgaatgtctacgtgataagtggaagcattgcacttgaacagggtgactacagtacagcgctcgaaagactcgaggaagcaatggactggaatccgatcagccccgatatcgcatttgaatatgctgaagctgtcaggatgatgggctcccttgatcaatatttagacctcactaagagaatattccctcatatttatatgggagttcagatggcccaggcttataggaatattgcatattactatgagcagaagggcgagaagaggaaggcaatcgagtctctgttatattcacttatatatgatgaaaataataaggacgttgagaacgagataaatgaaatcagcgagggcttgagtgaagaagagaagactataaacatggctgagttcccggacatctgtaagaatgacggaataccatttggcccggatcagctggtattaaagattgcgtatgcttcggccagacattttgagaaggtggagccggatccgagaaaatcgtattactactattatataatgtacgaactgacgagagatgacaagatgaaagaaaaggctgagcagcagaggaagagagcacagcactgattcttatcattaaataggaaaaaaatacaaaagaacaatttttagacgggaaaaagaaaaacaggagaaaagatggcatcaagaacatttgactttagtgatacttctgaagaaaaagttgcagagccaaaggggtatgcaggaaaagaagcatattcgtttgagacttatgagcaggattctgacatttcagatgaaaatcatccgattttaattattgaagacaaggcaaagacgctggttcaccatgtaagtggcagattttacagatttgatcaaaaaatgagctttgagtacggcagatcttcggatcagctttatgccgcgataaatggaatagacacccgatttgttaaacttctgttctggctcgctgacaatcacaccgatgttagattatcaggccatattgttggcgaaaactactgtgtttataagataagggcagtagatgccgcaggactcaggagacttacttctgaggacggatttctgcagaatgtaattcagagacttctggcttccaaacctccgaaagaagagaagagcagcagcgattcgattgaggaaaaaccggttgctgaaaagatcaggatgagtgacgtcactggaatggagaattttcttaaagtagcgtcatctgttctgccggaaaatatagcagtgtgggcaaagagaaaccttatgatggccagatcgcagagtataagtcctgatgagagacgccatgctatgagagcgctgtctatgatgcttaatattcactggcaggatgcatattttcctgcagttgacccgatggctgcaagaaaagttttagatgaaaacctttacggcatggataaagtgaaacagcgtatcattgagacgataatccagatcaacagaacacatactttgccggcttatggtctgcttctttgtggtccggccggggtaggaaagtcccagatcgcctatgctgttgcaaaaatcctcaaattaccgtggacagcactcgatatgagcacgataaacgacgctgaagctcttacgggaagtccgagagtttattcaaatgcaaagcctggaaagataatggaggcattttcagaggcgcagtcctcgaatctggtctttataataaacgagctcgacaaagctgatgctggaaaaagtggtatgagccctgccgattctctccttacactactcgataatctcggatttacagacaactatgttgaatgtacgattcctacaaacggagtttacccgatagcaacagccaacgacaagtcgaaaatttcggatcctctgatgacaagatttgctgtaatagatatcgatgactatactccggacgaaaaacagaagattttcgagagattttccctgccaaaggtgctaaagaggcttaaaatatcaccggaagagtgtatcatttccgattctggtgcaaaaaagatagttgaaatatataaagaccagccgggtgtaagagatctcgaacaggcggcagagcacctggcagcgcatgcgctgtatctgattgagacgactcatgtttcaactgttaaatatgacgctgatgacgtcgaaaaagtacttatagacgagtgatttcagaagtcggataatttcataaataacaggtctgtaatttgctattgaaaaagtatgtgttaggtgatataatttcaatcatacaatgaattttgctcaagtatattgctgatccattcatagctttacaaaaacagaatagcaataaaataaggcaaaggtgccgtatttcgtaaaagagtactggcaccttttttgttttatatatatagcgtacaaagataataatgtttatactaataaagtatactaataataattacaattataattataagacgtctaactaatgcaaaacgatgaattgatcagcaacagaaggagaaaataaaatgtcagaacttagtaaaattgacgtgatctgtgatatgtcgaaatttacatcgataaagaaggaactgtctgaactgaatgtcggaggaatgacttttactcaggttttaggctgcggtgtagagggagggacaagaagcaatgacagccagactgaaaagaatcccgagatggcactgctccctaagattcaggtctctatagtcgttgagactaaaagggtaaagaagatcacagatgagcttcttgataagctttataccggacacattggtgatggaaagatctttatttacagtctcgacaatgcgattagagtgaggacaggagaagagggtgtggaagcactgtagaaaagtatcaaaagtttcttatgactattgaaataaacggcgaaaagaaaaattacactgtgacgcgaaggcggggcatgaagtctgtgcgtattcgcctgggtgatgacggagtgtttcgtgtttcagcgccatacggggtctcggctgatcatataagggatctgatcagaaaaagcagcgacaagctctactcttataaaaaaggcgacgatcagtcgcgtaaaagatgggaagatttcgtcagagaaaagattaaaaacgtgccggactggcaggtaaggcgattgggagacgatattgtagccggaaaaccttatgagaagggcagtatctataatggaatatcaatctgcactacccagatagagtttcaaaacctgttctggagatcgtacaggagatttagagcagaccatgcaggaccagttacaaatgtatgctttcagcacatggtaagccgctggggctcttgcaggccgaagaccgggagacttacgtttaacctgctccttttatatgtcccgagagagtgtgccgagtatgtgatataccatgaattgtgtcattttttagaggcgaatcattcaaaaagattctgggagcaggtggcagtgtatgtgccggattacaaaaaaattgaaaaagagttgaatgattatggaaaaatcctgatcgaaagacggttataaaaaaagactgacagcagatgctgccagtcttttttataaaatcaagaacgactgtgaagtacatcgaagtatctctttgtctctttggagcagaccccggagagggcgataaggccgataaggttcgggatcgccatcaggccgttgaagatgtcggctaaggtccagacgaacgatactgtcatgtaaggcccgatgaaaacgcagaagatgtagagccatctgtaggtacggatcaccttcggtttgtcgccgacaaggtactcaagacatctctcactgtagtaatcccatccgaggattgtggtcgatgcgaagaatacgaggcagaccataaggataaacgtagcgacctgctgtgggaatggaagaccgtcggagaaagcctttgaggtgatgtttacaccttcgagtcctgtgttccatgaggaggtcatgattatagcaagtccggtcatcgagcagataacgatagtatcgataaatgtaccaagcattgagatgagaccctgctcagcaggatagtcggtaacagctgcagctgctgcgataggtgcggaaccaaggccggcttcgtttgagaagatacctctggcgattccgtttcgcatggatgcgattattgtaccgatgacaccgcctgtgatggcacggataccaaatgcgccttcgaagatcgaaacgaaagcggccgggagctttgtgatgtttgaaaaaataagaataaggacagtgccaacatagaggatagccatgaaaggaacaatcttttcagctactgcggagatacgcttcaggcctccgatgattacgagggcgataaagaaagtgaggacaactcctgcgataactacggctatagaagtctgctgtcctaagacatttacggtgactttaccctgaggatcaaagaatccttttacggcactcgtgattccgtttatctgtgtaaaggttccgattcccatcagaccgacgcagacaccgaagaaagcgaagatcttggcgagccacttccatttctcgcccatacctttctcaatatagtagaacggtccgccaatgatgtgtccatccttagcggtctgtctgtagtgaacagctaatgtacactctgtgtatttggtggctgtgccaaaaatagcggcgagccacatccagaacattgctcccggtccaccagctgcgatggcggtggcgacacctacgatatttccagtgccgatagtggcggagagggcagtgcataaggcagcgaaaccgctgatctgtcccttgctgtcatgcttctcgtctttcgagaacatattcttaaaaccctgtccgaagcctctgaactgaatgccacggagcctgatagttaagaaaatgccagtacccaggatgaataccatcagcggtacaccccagacaaaagtgtcgatttgtcccaaaatgtcagtgaatgttttcatagtttacctttttcttttccagtttaaacaagtaacatgataaagtatatcataaaacatatatgttagctatatattttatataaagatttggcagtcaaaaggctgaccgccaaatcatataaatcttaaaaatatctcaatcagatacagcacggtaaacctgtctcttctggctcgaatacagtccggcctttccgctgaagaaaaatgaaaacgcgctggcaagcaggaaaaacggagctgtcccggtgccgaaaatctctattcctatcgcaaaagctgtaagagggcagtttgtgactccgcagaatagagagaccattccgactgagcaggcgagagcaggtggaagtcccagaagatgcccgaggaaagctccaagtgaagcgccaatgtagaacgcaggaactatctctcctcccttgtagcccgcatagactgagattaaagtaaagagcatctttaaagcaaactgccacgggagcacatcgcccttcatgaaacctgcgatctggtctacgccggcaccgttgtatgtctgtcctgggaagataagagacagagcaaagactgcagagcctaagatcagagctcttagatatttgttttttagctttaatgaagttaatttaactccgtctgagagaagcctgcagaaaagcatggcgacaagaccacaggagacagctattaccgtaactttcagaagagttacaggatctgctgttgtggctttatccatcttcattttcatatctggagctccgacagagcgcgcgataagcctcgagatgtaggaggcgattactgacggaacgaggcagagaacgttaagacggccgactacggctatttcaatagaaaaaatagcggcagccatcggcgttccaaagagtgacgaaaagcaggcactcattccaatgcaggtgcagaaggatttttctctgtcagacagatgaaagagccgcgcggtattgtaacctaaggagccgccgagctggagcgcagcaccttcccggccgactgatgcgccgcagaggtgtgaaaatacggttgaaagaaaaatagatggggccatttttaaagatacaggtgcgttggaataagcggattccagaacccggtttgtgccgccatcgtcttcatttttgaagagctgatagagaagagtgactaatacggcgccgacgggaagaagaataagaaattgtggatgagcctgccttatcgcagtagcaccgcttatacacaggtaaaataaagcgccggcgattcctaagattactcctataagtatggagataagtatgattcttgtgacttcaattatttttttcatgagtttattatatcagaaatttgcgttataatgggaaattgaactgtattttcaaatgaacagcttaaaaacaggagaaaaaatgcttagagttacatttattcatcatggtgcattcgtcgtggagacagatacgaaacagcttgttttcgactattttccgtccgggacatatataaatgcggtctttcatggtaaagagccggtattttctgcaggaaagccgatctatgtatttgcgtccaactgccacaaggaccagttttcaccggaagtcctcaggtgggcagaaaaatacgacgtgcactatattttttcaagagatataaagctcgggaagaaatatcttattgaaaatggatatgatccggctgtaaggaataatataaaattcatcgggccggtttcggattacaatacccctgatatcaaggttcatactcttctgagcaatgatgccggagtggcttttttagttgagacagacggtcttacgatatatcacgccggggacttgtcaatctggaacgtaagtgaggacggaaaagagctgtaccgtgaaatttatgacggaggctacaaaaaacagataaagcacttgtcgcgcagacacatcgatatcggctttgtagttttagatccgcgccttggggccggcgcctatgacggaatagactattttgtccagaatatagactgcgacctgatctttccgatgcactgctgggagaactattcgataatacagaaattcaaaagacgccctcaggtcgcgccttttcgcgataagatcgtagacatcgaccgagacaacattatattcgatatagagtaagcgggcagatactccggcaatacctctgaaatgactaaattagctaatttaagcttaaaacacttgacattttttagcttaatacgcataatataattagtttattgtgttgacactttagtttaaagggaatgtcattttggagggaactatgactgaagaagtaaaaaagaggtatgagcactggcttaatgatccgtattttgaccagcagactaaagacgagcttaaagccattcgtggtgacgaagaagagataaacgacaggttttacagggaccttgagtttggcaccggaggcttaagaggtgtgctcggagccggaacaaaccggatgaacgtctataccgtaagaaaggccactcagggacttgccaactatataaaaaagcagcacggagaagacaagggcgtggccattgccttcgattcgaggataatgtcaaaggagtttgcaaacgaggctgcgctctgcctaaatgcaaacggaataaagagctatattttcccgtcgcttcgtccgacaccgctgctctcgtttactgtgaggtatcttcactgcatcgcaggaatagtcatcactgcaagccacaaccctcgtgaatacaacggatacaaggtttactgggaggatggagcgcagatcacgccgcctcacgataaaaatatcatggctgaagtcgcagacgttaaggacttctcagacgtagtgactatggatgaggagagcgcgagagtagcagatctgtaccatgtgatcggctacgaagtcgacgatgcctacatttctgaacttaaaaaacagtcagttcatcccgaagttataagggaaatgtccaacgattttactatagtctatacaccgcttcacggcacgggcaatgtttttgtgcgcagagtacttaaagagctcgggtttaataaagtttatactgtgccggagcaggagaagccggatggcaattttcctaccgtatcttaccctaatcctgagtcacctaaagcctttgaactggcgcttaaattagctgaagaaaaagatgctgacctggtccttgctacggatccggatgctgacaggctcggagtctattgcagggatatggttaacggaggctatattagctttacgggaaatatgtccggagtccttatcggagagtaccttctgcgtgaaaagaaggccaccgggactcttccaaaagacgcagctgttgtggagaccatcgtaactacagatatgctcaaggcgatcgcggctgactacaatgtatcccttatcgaagtcctcactggatttaagtacattggtgagcagatcaagctctttaaaaagaattcaagccacgaatttgtcttcggaatggaggaaagttatggctgtctcgccggaacatacgcgagagacaaggacgcacctgtcgctgtgatgcttctctgtgaggcggcatgctggtacaaaaagcacggaaagactctatgggacgcgatggaggatctctacaaaaagtacggatactacagggaaactctttcgacgatcacgaagaagggcgaggacggagcatcggccataaaggctatgatggataagatgagaaacgaacatgtcgaatgtatcggtgattataaggtactcgcactaagggactataagacgggattaagaagagactattctacgggagaagagactcctgtgactcttcctgtctcagatgttttatactatgagctttctgacaatgcatggtgctgcgtccgcccgtcggggacagaacctaagataaaattttacatgggagtaaggggcagcagtttaagtgacgcagataaaagactttcgaagttaaaagatgctatgcttaaactcggcgaagactgacaaaaaccgcgaaaggaggggctatgtcaaaatcagttacgctctcggatattgcagaccggataggcgtttcgacagtgactgtctccaaggcgctttccggccagaaaggcgtaagtgaggcagtcagaaaacagatagtcgacctggcgaatcagctcgggtacaagaagagcaggaggatacgcagagagccgacggttccgggacactacaatatcggagtgctgatagcagacagatatatggggaaatattcctctttctatgtgcagatgtatcaggatgttgcggcatatgctgtcgaccggggcagctttgcgatcatggagccggtgtcggacgaggacgaggcagaatgcacaatgcctgtggtcgtctcagaaaagaaggcagacgccataatcgttatcggaaaactaaatgacagatacctttcggcattaaggaagaagtgcggagttcctgtgatctacatggacttttctgccaggggacttacggcagaagctgtgatttcagacagtttttacggaagttacatcatgacaaactatctgtttgaccacggtcatgagaagatcgcgttcgttggtaccttaaattcaacagagtcgataaatgacaggtttttaggctatgtgaagtctctgatggagcacaatatcaggccggagaaatttatggtcatggaagacagggactgtgagaccggaaaaattgacgaggacaggttttttaagcttccagctaaaaaagacatgcctactgccttcgtctgcaactgtgacatcacagccagtaccctgattcataaacttagaaaacagggttataaagtacctgatgacatctctgttgtaggttatgataactatatctatccaggcctctgcgacatcggaatcacgacatatgaagtggacaccagacggatggcccatgaagcggtgcatatgatacttcacaagctcgaaggcaagccataccatggcggagtgcagatcgtagaagggaaacttgtggaaaaagaatcggtaagagatatctctaaacgggaataaaaagaaactgaacaaaatttttttacggcagatattagcaggatctgccgtatttttttaaaggaaaatcagctaaaaagatttacaaaaagaaaaattaactaaattaattagtaaagctgcacaaattaaagctaaattaactggacaagataactaaaattggtgcaaaaggccaatttattcttggctaaattaagttaatgagtataattaaattagcttcagaaatgaggcggggttaagttaatgtgaacagtccgttattgaaggagggactcaaatgaagaagagaattttaactcttacacttgtatcagccatgtgcctttcgatggcagcatgtggcggaaaaagcaccggaggaagcaaagccagctcaaacagcagtaagctgacttactcaagcatcaagctgggtgaggacaaagacttgaaagcttctatcacgatgtttaacaacagaaccgatatgggatcagacaagtacggcggaaagaactggaaagccattcctctctataccaactatgcagccggatggacaatgggtgcatgagatgcctacatcggaatcaatgccacaggcgataagaagtacatgaatcaggaactcgttcatacaaagaatccgttcagtgatccgaaagatggaactcatgcctacaacgtttacaagatcctctacgatgcagtttcaaagaagataaaaaaataatgggacagtagggacggttctttttgtcccattgtaattcctgcaaaatcagccagtgcagatatgaacggatgacgagcgaattcagcgttttcgtcgtgcgcgagcgcgatgttgccgcccggttggccatccgcctaaaccataagcattattaaaccatatattggccagagggcggcagatagacgagcgcgagcaagcagaaaacgcgcactgagctcgccgtccgttcgtgtctgcactggcgaacatttgactgaaatgtctgataatgggacaaaaagaaccgtccctactgtcccgaaattcagccggcgaagacgatgcctttgaagatgtcctctatcgacttgccgttaatggtctgaggatatttgtccttcgagtcgatcgttacacggatgatctggtcgtcatctgtgatcaggtcggttgttttgttgttatcggttcgaaggaattggagtttggttccggcggtgagcttttcgtctttaaaggagagcttttccggggaagctgatgtatcggaggctgtcttaaatgtcatgtctttttttaaagtcagggcatttaaattggcttctttagcggcgaaccatttggattttgcctttagttctccatccgagaccgtaaaatatcccattgtagtgtaagtgctcatcgtatcagatctgatcccggctgagaacccatcggtatttgtcggcacgctgtcgtaaaagccgtcttcaaattcgtcgggatcgttaatcctgcttccattcagatcgtaaatgtaaatcgactggaggtcgttttcctcatgcgttccgacgaaaagatagtattttccgcctttggtttcggcgagatagtagtcattttcaaacgagtggatcgtcgatttatttttcttcccattaaatttcactgtcacatcataatcggacggatcgtctaaggttgtgtctttcgaaggctcttcggcaatggaaatattatagactttgtcctgattttcggtgaaattcctgctgtctcccgggaacaactgaatgaattttcccttcagtgtaccaggccctgcatatttactgttaaaatttccggtaagcgcgccggaatcgtatgagtattccactttaaacgagccagctgcgtatgatgcgagagcatatggagcaaatgtgaagcttacacctgtcggagtcatgtaaaatgcgacagctccatctgaaccattgtcctttaaaagatttaagatattgccctttaatgtcccgccattttctgacgaatcagccgcaaatgtaacatttggatactgggatttgaggtcgtctgcgagtgcggcggcaagctcctttttatttgaaaaaaggttcgaaagcgttatctttcggccggtttttaagtcatagttgaaggccgaaaatgtagtggacgggtgtgcgccgtttgcataaaatacatcagtagtatagatacttaaaatatcatcatctgcgcgcattacagatgaagtgatctggtctgagtagctgctgtaattccagttctttttatgctttttgtattccggatcggcttgtttttttaaagttctaaatgaagatgcgtttaatctcttcacgcttgtgttgtaatctttaagagcagatctaagattcggcgatgcctgtggagatgcatcttttccgaagataacaccctctatatcgtcaatcgtaaaagtgtcgtaacttgtagagaatatgcctgaatcatctgaagctgtgtcatcgttatacacagtattttttgaaaaaaggacagacgaatcagaatatttctgctctgcgtcagatgtactggatttttgcgaagagactgcagatgcctgagaactggccgatgtagcagtagttttgccacatccgctgaatgaagcggtaaccataacacaagctgtaaatatagaaaaaatacgttttaatttcatatatatcctcacgtctgccatagggccttacggtgtaataaagtttttatttctgattaaaattatacgccaggcgggataatttggcaatgattaaaagatatttatgctttaaaaaatatttttaaattaaaattaataacttgattattcagccaaataaagtacaatattattgttacagttaataagccacattttaccaaaggagggttaaaatggctgatcgtattgtgcttaatagcatttcttatcatggggcaggagctattcaggagatagttccagagatccgcaggggcggatacaagaagatttttgttacttctgatccggatctcgttaaatttggtgttaccggaaaggtaacaagtcttctcgatgaggctgggattgcctacactgtttattcaggaatcaagccgaatcctacgatccagaacgtcaaggacggtgttgctgcattcaaggatgcaggggctgacgccatcgttgccatcggaggcggatcatcgatggatactgcaaaggctatcggcgttattatcaataacccggagtttgcagatgttcgttcacttgagggcgtagcacctacaaagaatcatgcagttccaacaatcgcagtacctactacagcaggaacagcagcagaggttactattaactacgttatcacagatcctgagaaggagagaaagttcgtatgcgttgatacgaacgatatcccatacatcgcagtagttgacccggatatgatgtcatcaatgccggccggacttacagcgtgcaccggtatggacgctctgacacacgctatcgagggctacaccacaaaggcagctttcgagatcacagatatgttccatcttgaggctataaagcttatttcacagaatcttcgttcagcagtaaagaacgagccagagggccgcaagggaatggctatggcacagtatattgcaggaatgggattctcaaacgtaggtcttggaatcgaccattctatggctcactgcctctcagctcactatgacacacctcatggtatggcatgtgcacagctccttccgatcagtatggagttcaacagagactacactggtgagaagtatcgtgagatcgcccgcgctatgggagttgagggcgttgacgacatgagtcaggaagagtatcgtgacgcagctatcgccgctgtaaggaaactttcagaggatgtaaagatccctcagaagaacgacaggatcagagaagaagatcttccacagcttgccaaggacgctttaaacgatgcctgctatccaggtaacccgagagaagctacagcagagcagatcattgagatgtacaagaagctcatgtaattagtttacaagctgtttaaaaaagtgacaacagacgccagggttcgggaatttatttctcactctggcgtttttttttgccataaaaatcacttctgcgatgatgattcttctttacagaatagccgaatgtgccgagaggcttttccagtgaaaaataggtgccatgggaatagacgatcggatgcgccatttctaaagcgaaacggcctttttcatccatatacctggtatctgcgtgtactgcaaggacgtcagcgatcatcatgacgtgtgaaccgagctccttttcttctacaatgcggcactcgatcgtaacaggactttcggctacaagtggcacatttattttatctgctttttctttggtgagatggcaatcattgaacttgtcgtgatcccggccgcttacaacaccacagtagtcgacagctctgactaatttttcagtagtcaagttaagaccgaattcatgagtctcatggagagccttataggagaagcggctttttcgaactgagatataaagcatcggcgggttcgtacagatcgtgccggtccaggcgactgtaaaaagattgtctgtcccatcagtccccctggtcgagaccaaaactgcaggcagcgggtagagcatattccctggtttccaagtttctttcatcgtattttcctttcatccagcatatatgtattttgatcttatgtttagtacaagttaaaatgagtaaatttccattttaacttgcgatttttgcgtttttacaaacgacatatatgatgtcctttcagatttcgtataagtatattataccagatatggcactgagatacttgatttatatgaagttgctacgatggtttggaaatagtataataaaaatgtcatctaactaatattttttaaatagatgttttgatggagaattaaagggagaaaaatgaacaggaagaacagaaacaaaattcttattattataatctcactgcttttagcggccttttcccttgtcatatatcttagtattaagagcaaagacaggcagcttacgcatcaaacagagacagggatcaaatctgaaagagaagcagataatgaatctgatcagaatgaacaagactcagctaaaacatcctcagacagcagcttatccgtaaagtccaggcacggtaagacagccaccgcgcaatcaaagaacagcaaaaaagatgataagtcggctgcatcatcaaaacaaaagaaaagccgcgtcacttacagggaaggcttttattacgagaaaatcggtaagaaggtgcttagcaggataaaaggcatctcatacccgaaggatgcgtcaaaatgcagggtcagtatcggggatctgagatactgcagggtgaaatatgtcgattttaacggtgagacgcagtcgggggagatgatctgcagcaaaaagatagctgatgatgtaatggggattttttccgagctgtacgacagcagctatgagatagaaagcataaggcttgtcgatgacttcgacggggatgatgaggcttcgatggaggcggacaacacgagctgctttaattacaggccgatcgctggttcatctaagctgtcgaatcattctctcggtcttgcgatagatatcaatccgctctacaatccatgcataacgtatgataagaacggaaaggagaaggtggctccggcaaacggtgtcgattatgccgacagaaaaaatcaattcgaccataagatagatgaaaatgatctggcctataagcttttcaaaaaacatggatttacatggggtgggaactggcactctctcaaagattatcagcattttgaaaaaaattattaacagtgccaacttggatatcgtgagaaaggcataaaatcttatgttgatagatattagcggcagaacagacattgccagcgtttatccagagtggatgttcaatagatttgtagaaggatatgtgtactccaggaatactatctgtacaaattctgtacgcagataacttcccatcaaatctctgataattccttatgccgctctggttctgacatcttcaggagtgttgaaaaggatatgcaccatatcattgaaaaagccatttatgatggtggtgatgactttacagagctttcaagatgcaccaacggcgaatcagagcagactgattacgacctcgttgaatgggcaataaatatgggatggcattggaatgagtcttcggattttacgttactttgataaatgcccacgagtttaaccgtggaactgttatttaatatccctctgtatatgattgaaccatggattcagaaaatagacagctgaaataatttcaaagcaccagtcaaatctggacggtgttttcgtgtacttaaatctaattttggataataaccagcaatatgcttttgataagttgcttttacaacattaattgcttcctatctctgatataatcacatcaaacgaacaggaggtcaatgttatgttaatacaaagctatatagagactcataaaaaaatagcagcacaggttgaggcaatcacaaagctgatatcaagtggttcgattgaggacaatgcttttgatattggtcgggaaatcagcagactttcaggccttcttaatgtacatcttaattcagaggatagatatttatacccaaagctgctcgaaagcaatgattcatctgtgaaaacacttgccaagagatatcaggacgaaatgggtggcctcataggcgaatttaataaatttaagtccagatataatactaaaaccggaatcttggagaacaaggagggacttgccagagagtggaacggtattgtcaggaaactttcacagagaatcgaaagagaagaaaaagaactatacacgaaatttgaaaggatgtaaggtgatacaaggaaagcgtatgtagattgggctgcctgcacttttttattggcaatagagcagtattacgaataagaaggaaaataagaaaaaggcagcataggaattccgtgctttgtgtttgaagaatctggatagtgtcaaaaatttctttgtaaaatattttgacgctgccgctaattctggataccataatttaaaaactgatttccgttcatattttttaagcttctcagatggatccagattggagatcatgaataagccggaaatggctgatcttgaaaagaatgctgcccacacgggttacatacatattgcattttcagtcggcagcaaagaaaaggttgaccagttgaccgcagaactgaaaaaggatggatatgaagtcatcagcggcccgcgtacaactggagatggatactacgaaagctgcataataggtattgagagagtttgaaaaaaagtctgtaaaagttttcatatagggtctttcatgatacaattattttaattcatggagggcctattattatggcaagaagagaaaagcaaccagtacaccacgttcagatggaagatggaagatggcaaaagagccatcatccaggggcttctgcaggagtatgtatccgggatgcaaacgacatccaggaagccctcaaggatcttctggtggcaccatcaaagaaatgatggaggtgagatggataatcatctggtatgaaaaatcagagcgtaacggcgattccgaagaagaccgcaactacggaacggttacaagacaaagcgggtcaactcagcacggcagcatggatatcgatgtcccgaggacaggaattccacgttcgagccacaggttgtaaaaaaacgccagaaagatatatcagagatagaccataagatcatctctatgtatgccaagggaatgagcactaacagataacggagatcattcaggatatctaggctttgaggctctgagggctttatctccgacgtgacagataaaatcctgccgcagatagaagaatggcagaacaggccgctttcagccgtatatcgatagtgttcattgatgccatacacttctcggtccgtgatgacagtgtggtaagaaagcttgcagcatacgttgttctcggcatcacacagtgaggcagaagggtacttgagctaggcgagaaggagagcagcaagtggctgtctgttctgttccctgaagaaccgtggagtacaggatatcctgatactctgctcagacgggcttaccgggatcaaagatgctatatcgagctttccgaaaacagagcagcagcgtgtattgtgcatatggtacgcaacaccctaaatatgtcccgaacaaggacattaaagcatttgcaaaggacttaaagactatatatacggctgctgatgagaaaactgctcttaccaatttgagaaagtaactgaaaaatggaagaccagtatccttatgcgatgacacggtggaacgataactgggatgccatagcgatattcaagttctccaaagacgtcagaacgctttctacagaccaatgccatagagtcactcaattcatccctgcgccgtctgaaccgcccagagaagctatttccccacacgcaacgcatgaaatgatctaggaacgagcacgaaaagtggacataccaatcagaactggaacaagatccgaggagatgccacgccagacgcctgacaactgcggacaaacattacctccgtatctaccattccaccgcttctaccctctccctctccactaaccatttctgctcaacaccctggcgggggagacaactccttgacaaagccatcggcacattaacgagactgctaagctaagctattctagatctccgtcgtactgttgaaagtacgaacagtagcaaagggtgaccggtgacagataagcccgcactcaaagaagtacgtataatctgctgtaatgtcaataatacagattgacagaattatttctgaacttcttgacaggacagctgatctatgcaatattatactcaagtgatacagaagaatatatttaaaatatttaatctatatcactgcaacttttcatgaaagatctgtttttacagaaaaaaattcatactctctactacgaaagctgcataataggtattgaaggaaaattatagaaattactatataattgacttgtaatgtttgtcttctgtgtagctgtcggtgagtgtattttaattactggttaagtatccctttattacccctgtgatcgttctcattactccaaaagaacacaatgtatccataaacagagaagcatttaggcatattttgcaccttcctataatgtcaagccccaaattacgatttttagggattcctttgacaggttacctcaaaaaataagagtcaacggtgatggatatcgttgcatcaagtgctgaatagtcgatttttgggtatggttcgcaaaacgtcccacatgtcctttgttatcaaggccattttccctcagatcaactatggcagtgaaccttcgtggctatggggatctgtgtcccaacctccttcgtcccacctatccatacaccgagtgccagccaagctttcttacgagttcatgcctcacggagtgaattcctgctggctacggctcctatttgttcttgaatctctactgctaggacattcctgtgacagtcctgatttactcagtggacgctcaactgccacacctgatccaatagtaggtgtgatgataccgaagcatcagtttacaggttccttgttccagaacctggcccagcatccgtgttaccagatgttcggcaaggctctggaaagttatacaatgtattttttcggtttgagttatgctgcctttgttctggaagtctctggataatgtatatcactgagcattctcatcgaatcatacttacgtcctgtcagcaggagcgtatatacgaccctgagcagctgcaggctatcacgatcaacgactgcatcttctttaacgggttctccgctcgtgtcgtgtagtgctcgtgaaggctcttaaacgcctctgaatgaactactacagattttgctccttggaacagccatgttctcagtttcttgcgtcctcgtgactgatctttgtctcccttatgtttttctgagctgcatctacaagcccgagcccgctgatcttctggatctccttcacatcatcgaacctggagatgtctcccatttctgcaatgtgcctgacagaatgttctccccaaggccttcgatttcaagaacaattttcaacgttcgggatctcatggcacttctggtgaagctcgtcctcaatcttgctgagttccttctgtatttctgttatctgctgtgtgaaccatctcaccgcctcctttgccgccttgtctccgtccttaagaccgacgctgttttcggcatagctgacaatccgctcagcgtttctgtatcctgcgccacggagcttcgccttatgccagttcttttattccctcagttcccagcctgattatatccgcaggaaatggcgcgttcatcagaacttcaagggtaaatgctccgtccatttttccgaatgcatcctatactcgggaaaataaaccttgagctgcttatgaagtctgtttactgcctgtatcctgccttccataagctgatcgcggagagaagaaagacctcttatctctgcgtatagcccttcaggtatatatgggattccgaaattcccgtctttcaccaggttcgctataggcttcggatccttgcggtcgtccttccgctggctgttgtcctcaatttcctttgtctgcttcactgcatagggatttactggacaacgctgataccatgagatatcatccacacgctatacagaaccagtaatgacctgttggctcaagtcccatcacaatctggtctttattatttatggcagccagttcgagcatccatctcctggcactctcaaagcctcttgctgtactgaaagaaaacggttctttgctagctcgcgtcctctggtatctatagctctcacataatgagtttcactacctatatcgcatccaactataagcatgttgtcattatgaatgagagcttgtcattcttatcgaacttgccctgagtctccagttcttccacgtggaagccttgagatttccttgatgacagtaattctcttttcgattctccattgaaaaacactttttgctgtgctggtgattagtgcttgattttctattcttttctgtttacaattcatcgtagatacctcttgttcttttgaattttactaacgtccaggtcagtaatgatcaaatctacttgaggtatttttatatgtcaaccccctgacactttatattatacaggagctttctcgaaggacatagccaaaggaccagctttagctacatgcttccataatccattgatttcttctgaagaatatcctttaatatttgtaaaactgccacatggataatcgcactgtgcggatttaaaatctgtacctgattcatttggctgttcaaaataaatagtaatatattctgaaccgctttttttctccttaatatctgaatatgttatctctaagccattatcaaatgataaaaacggatgatgttccatactgatcacctggccctttcttcaaatgttcttatatctattatccattataagacatattctgaatgttttccagccaggattgaatgtataagagtaaaactgtaaattgtaaaattgacaaagcagaagcagttgcagcggtacatatttatcggttaaatatcactttatccgatagcgtcatttcagatatccttatctataactaaccaaagcgctcatgaccaggagaacaaaaaatatcaatgtcagtgcgcgccacatagagatcttgaacggcgttacgaacttcctgccgttgtcgggactcacatagatccggcaggctttcatgcctgaaagccttcttttggtcacaaaaacttcttcgctgcctgtgtattctttcccctcttgataatacctgtatgttattatcatcatattgaaccaatgtttcaggctgcccctgtcaatatgatagtcgatgatcttagcttccgtctctgcataatgagatttcctgatctcacatgaaatatagagcagtaaaaaaacagcttccaatatgcataataaaatctgcatgtcatctaaatgcggcatagtagatcaaatcccctttgtaataaccagtcccatgttattaactatctccttgactctcttcttgttatcattgcttgctttatcccattttttattatctgttaattttatcaagccatcatcctttgcatattcacagaatttatcctctccaagtattctgacttgtgcaagattcgtaagatatcttctgcagtcgtagcctgactcattacttgcgcagtaataattacctgaggtccatgaatcttctttgaaatattcatcacatgattttccaagataatagtaggcatacatttcatacagctgtttataatcatcactaatgcccagtaaacaatctgtgacatctatgccaatcttaaccacatcaactacaacgaaacaatcagccagagcatcaatgactatatctgtagccttatttaaaacttcctgtgttatattattcatcatggcagaagctttgttagtcatttccaataacacatcacttgcaccatcacgagcgtgacaatcatcagcattattaattatccaatacagcagatccatatttttttcaaatactctgagatttgcactgacctttgaagcctcatcaattgactttatacaatcaagtgctgatgatgcataagagagccctttaccaactttgcttagcttgctgcttattccagatacatttacatccagcaaataactcttaaactgatatgtagttaaatttacactgcctaaatccggataataagtataaatcgtttttatctcttcagaacattttgaataaatcaagtggcgctctacttctgtattttttccatacttgactttatccatcagagaaacaacagaggagatacagctatgcgggtcacctgatttttggagttttgacaatacatcatccaatgtatcctccatcatcttcttttcttcttctgctttataatggtctaccagcgacgcatccccatatttgtaaaaatacattgagtagatctgtctgtagagttttctcttattatatactccaaatactgtcgaaagtacggctctgctgcctttttcaaattcactggaattcgcattttttttcgttaaaactgcataagcataataatcatcgttcagcaattcatcagaatttgatttctgaaaatcacaggcaagtggatttgaaccttctgctatttcgtccttatcggatttgccgtctccatccccgtctgatgacagtggatccgatttcattacagcataaaccctggttccatcttttgacgtcgatatcgaaagctcatctccattacgtattccgtcaccgtcataatcagcagctgtggagttcgtaatatttggatttgccttgcttagatctatacccttcaagcttctcccattacttaagacaagctttccttcatatagcagtttagtgtaatagtcagaaattccatcaccattgctgtcagtattaaagtcttttgaggcctgcgccgtctcatcaaagacattggacagatcatctgcggcttcggcatgaagataggcggcaccggtcttttctgcaatatctttcagcgtggattcatctatatcgtcgccgagaccaattgtaaagatcttaatattactgcttttagccgttgagatgatcttatcataatgctgttcccaggtgtcatagccgtcagtaaggaatattatatagcggtcattcccactcttatcagctgacagctcgtctaaggcattgtctagtccagctgagccatttgttccagaataatcattatcatcatcatcattttctatgctgtcgacagatttctttactgccgcataatcgcctgtaagaccttgtaaagtatccgcttttcctgtatacgagacaaggccggccagatccttgccggaactaagtttatcaacaaaattgtcggttaattttaatctcagatttgatggatcattatcattcatactgtatgaacggtcgatgacaaacattacggacatgttttttacagtaccagtcgttgaatctggttttctgatagaattttcccatactttgtcatatgcaactttatttaaaagtatataagtcgagaaatgcgatgttttagcctttacaacaccgtttgaaacagtctggtccggcaattcttcaagttcgcccgtttgctcatttacatagtagattcttggctgaaagtcatttccgatattccctaacgaagtgtcatatgaaaacttcagttcggcgctgtctaattttccttcggtagaaaaattgtaagcacttccaagataacctgcaatagattttgagaccagctcgttctctgaaggagtaacaggtgaaacattcacatcaggtgcttgtccatcaggagaaacagtcgcatctacaccagctgttacagtttttccctcatccggagtctgcggtttgactttaatatcaaatgacttttgtattgtcagaggatctgtaccgttcctgacttcgaatccatcatcagcaccgtctccatctgtatccggattcaaaggatttgtatgatatttatttacttcatcaccatcgctgagtccgtctgcatcagaatccgcctttgtaggatcggtctttaatttcagctcttttttgtttgacaggccatctttgtcctggtcatcatctttatcactgattccatcattatcagtatctgctttgcatggatcagttcctactaatactacttcctgataatcagttaaaccgtcaccatcagtatcttttttgtgaatattggtcttgttataatgctctagttcatcagaaagtccatccttatcagtatctttttttgtattaacccattttccatataaggtgatatcagatgttatttttgatttgtcaaataagaacggttttttgatgttcacaggatttttgcttgtgtaccatccggcaaatctatatcctttgcgttcataattcgcattcggcatagatatagttttgtttgctgacacgtgctgtttctttgggtcttttttacccttatactgaagcttataagtgacagtatatttcccagaatgctttatgtaatctatcttaacctttttaccggcattcgattttgtaaaatactttttatacttattcagatattttttattggtggaattcgacttggaaacatcaattctgactttcgttacttttgatttttttaaggagccttttacacctgctttgttaagcttcttcgtcttgataacgattgtctttactttgctggcctttgcgaaagctcccttatgtatcttcctgacttttgcgcctaatgtaatagtgctgactgtttttccttttacagctttatttactttagcagcagttacagcagcactatttatagtacattttacagaatgctttatgtaatctgacttgactttctttccagcgttcgattttgtaaaatatttattatacttattcagatattttttattggtggaatttgacttggaaacatcgattctgaccttcgttacttttgattttttaagggagcctttcacacctgacttgctcagctgcttagtctttattacgatggtctttatattttttgcttttgaaaaagcaccctgatttatcttcctgaccttggcgcctaatgttatgctgcttatctttttgcctttcactgccgaatttattttatcagcagtcacggcagcactattaacagttgcactgtttgttgaggcgtgcgctgtaacagcgtgtgatgtgacaggcaatgcggtaactattaccgcacaagccataataaatgagataatttttgcccggaaatggtgtgatacatttttcatttttatttcctcctcaaatttttatactgattctagaataaaaaataaaatgcatcatgtcaagccattatttgtaaaataaaatttttttgaaaaaaagtcagaataatctgaagagatatcccagacattttttccatatgttaacatatggcgtgataaattcctatgaaaaatcgaggcttcgggatactttgtgggtaaaatccccacctgcggttacaactaaacattgaaaggtcacctcattttcggtatcattatcagcgactaaacatcaacgataaggagaaacgagatgacctcttccaatacattactcaaaaagatcattggtgtcaaggacgttgttgtgactgatgccgaaatttacagtgatcacgatggcgttacacaccttacgatagatgcacgtccgaactcatggaaccggaacaagtgcccattctgtggacgtaaaaaacttcccggatacgacagaccatcgcaatctctaagggtgtggagaggcctggattttggcggagtaatggtggacatcaggtctcagaccaaccgcatcctatgtcctgaacatggtgtcgtaacagctgatgttccgtgggcctacccaaacagcggctttacaaaggattttgacatgacagtatcatggctcgcaaaatatcttccaagggatactgtctctgagtacatgcgcatagactggaagactgtcggcaaatgcatcagccgtagcctgcatgatctcgaaccggatctgtcaagacgccttgatgggcttgtccacataggcatcgacgataccagttactgcaaaggctataaatacatcacagtcatcgtcaaccacgatacaaacaccgtagtgtgggcggctgatggtcacggaaaagctgtgctctccaagttctatgaacagctcacagatgagcagaaggccagcataaaggtcgtcacaggtgatggggcacgctggattacggactgcgtaaacgagttcacgccagactgtgtgagatgtgtcgatccattccatgtggttgaatgggctatggatacccttgatgagcttcgttcagagcgatggcataaggcaaatgcaaaagtcagggaactgtcaaagaacaagccaaagacaaaagggcgtccgaagtctgatgacaaggctgccgcagctgtaaaagcagcaaaagctgaggcgtctgagatcaagaattctcgatttgcccttgacaaggctccggaaaatcttaccgagaaccagcaggtaaaactggcgatgatccaggcaaatgacagccagctatatcgtggctactgcctcaaagaggctctccgcatgatcttcagaaacaccgatgcggataaggcagaagccgagctggatcattggctctggtgggcgagccacagcaggatcccattgtttcatgatctttacaagaagatcaagcggcataaggagcacatactgaacaccataaagttcggactgagcaacgccaggatcgaggctactaacaacaagatcaagctgataatccgcaaggcctacgggttcaggaacatacaaaatatgctggatatggtatacctggtatgctcaaatatccggataccacttcctaacagaaagtcgaggaatagatgaacgcagtgatactcaaaaggaatggagtttcttacccacagagactaccgaagagccgtatttttcttgccatcgcaaatccctcttaaaaaatatcctgggcaaacaaaaagccagcccgttgatgctattatagcagaatacggactggctttcatcagcatatatatgctttaaaaaatatcttatgctcttacaactgagattctctgctgaatgtggtttcccttctcaatctcatcgataagtgcgattgcgtaatcagcgtatgagattattgattcgcctcggtcattgagtgtaagctcctcgcctgcaagaatgtactttcccgtacgctcaccgtctgcctggaaatctccggctggtgagatgtatgtccacttcacatcatctctatcacgaagctcatttaaggccttgcccattccgtttgcaaccggcttgaacgcatccgggaaatccggagtatcctgaacctgaatggtatgctctttgtttacatagagacttccagcaccgccaaccacaacaagtctggtatctgttccgctgaggatatcgcagagatgctttaaagtggtgctgtgctgcggcatatcctctggtgcccagactccgaacgcatctactactgcgtcaaatcctttaaggtcgtcagcagtcagatcaaagatatcctttttgatatacttctgcgccttggtgttgttatcattgcggccaaagcccgtgacttcaaagccacggtttagagcctctgtgatgaccttgtttgctactcttccgtttgctgctacaactgcgatctttttcatgtgatttacctccatctggttgatgtaatttactttgtttcatattatggttgtaatatatcatattgcatttatgttgtcaatacttttattacatttttcaaaaaaatttttcttatgctggacaatagttgtgttgccattttaacttgctggtaacttgcttattaaaaacagcttttatacttatccccttcaagccgagctgttttatattcttctacattatcgatttgatctgtttaatctttctctttttcatccgatataaaaaatgagattatttttcatggaggatgagacgatggcaatgaatatcaatgtgaatgtttcttcaagcggactgcgtgcaggctctcgcacttacaagattccggatattaagacacaaaaagtagacctgacacagaaaatgcaccattacgagggttaccggatacctgacggcactgacatgtcaaagctttccaatgcccatatcgttatgaattcaaaaggtgaaaaatatgtcgtatctgaaaaaactgctcagcagatggaaagcgacctcaacaaatattctatggaacagttcgctccggttgagcagcttaacgctcaatccacaaaggaagctgctgaaaaaacagcctcagatatgtcaaaaatctatcaggtaattgcccgcatgtgccggggtgattctgttcctttttccgatgaacagagactgataaagtttgaccctcgtatttaccagatggcaaaaaatgcccagaccatggaaaagaatttaaaaaagaagaccaagaaatacggttcgctctgggatgaaaaagaagaaaaggaatggcgtaatctgcaaaatggcctgaatgaaatttctgaccaggcattatctgtagcatcaaacaatacaagagttttcgcaggtgctcaggctgattctatcgaagacctcggagatctgccagaggatttttctcagagtgacctctccgcggatggtcatatcgatttgactgtataaacaggaaaaatccagtccgttgctgctgttatagcagcatacagactggattttttcagcatatatgccaagataattgtttcttttaaatcgctacattttcgtatgaatagctgtcacgataaactgtttccggagctatatctatctttccattatcccacgttataacaccatgaaacaacacaggattatttaagatcttttcgtctgcaagtggagcaaatgcgggaccctttaacaaagtagtatcaaataaccgcttctcacctgtcgagaacgtaacgagcattatacctcctcgcagtggttttacttcagtaacctttataccttccaccatttcaccagcataacagatatcattcacaatatacatttaagtcacctcaattcataggtggtattttttcaaaatgttctcccttgacggcaagattccacgctttgtaagcttcttcttcatgaaacgcaagccaacctgttactatctttaactgcttgcgagggagagaacctgccaacaattctccatctatcgcaattacagcttcatattcgccataatacacatgaacatgaggcttattgtgctgacctacatctcaaaaaagcatatagattaccattcctccgaagcggcttaattccggcatggctgctcactctcctttaatatatagtaagttataattaaatatgtacagaagttatggaataaaaatgtacaaatgctatcattgagaagtcaacctaggaggctttacaatgggattttagtgccaggcaccaatgtggtacacttagcgtcaacttaacttaattgcatgtctccaggatttttgaataggcatttttataatgtttgaatatctgccacgttttgaaggtgattttttatggcatgctgaataagctgtcaatagttatggcagcttgaactatttgaaagcttttattattgcgtcgcggaacttttataaagctcgttttcggttatagaagtgctcccgctcgcgggcatctgatttcttttttcgaggattcctccttctggctgtactgggagggattaacacatgcgccttcaaatatgtcatccaacaacgagagctcacatgcttttgcaataaatcgggctatgaaccacttcatccggcctaatacatatgccctgttggcctgaagcgatatctgtttccttcttttctctgggaatcgatctatcgtcagcagcgctttttaccatggcagacaggtttgagagcagcagatgatataaaattctgctcgattgaagtgcttgttgcacctgagaattcctcaagcaggcactgatgcttcaattcgccgtattttgactctatcggccagcgcataaaatacagttctttgaagtcatcaggtcagatcctcattaaagatagttgtagcaggtactctgtaacaccgccgtcaagcgggatttgatgacacgaatgtcaatgttttctgtacccttcttcttgtttccaggcaaggtgaggatacagtcgccggtgcactgcttcgcaatcttaaaactgtctctgatgcgcatcacgacagataacctctgtctgaaaatatctgaacatggcatcgagagaatagccacggtcaatatgaccacggaatctttgaatagatcaagcttttcgagctcttcacagtgctttaaagcagcgtacgttcagagcccagatagcgtttgattatgccatgaacgacgacatcattgcagacatcatatatggttgagcagagagcaagagtccattttcgattggggttgttatgcgaaaacatctctccatagttttcgaagtttgactttgaatttggcagtgtgatgcgcgatccatcgattgcaaagatgtgatagagatcatgccatttttttcgctttttaatggagcgttagtaggtgtctacggagacatcaaacagttccttgaaaagagatggtagaatgcctgctggctttggaaacggcctgttttgtgactttgggaattcgagtgtggcagatcaagcgggatgtttgccaggtttatgctcataggcctttgaagtatagagcagatagacaatgatatgagtcattgtgaggagtcctttccgaataaacctgtttttcagacgatgggattccgaaaaatcttctgaaaggatcaattcggaaattttttgcaggatcttcctgcagatggatagtgaattcataaagtacctcccattgataaagaattgtcccgtcccgtggacggaacatttgcctttaatcaatggccgctttcactacctcaagatttttcagtagtgaaagcggccccgcactggagctttatgtcaagtgttttttgtgataattttgcagaaatctgcgcatgaaaaaaagccaggaaagccgcaatttacgggctttctggcttaggttgaccacgttggtgccaggtaccgttaaggatatattaagaaattatgaatcactcttaacagtgcctggcacacttttccgttgtattattctaacggcatatatttgtcgagatactgttctacggtctgaatccacttaagtgaaatcgcattatcgttctgaagaccatgtcctgaatgaggcagtacaaaatacttataatctacatggttctcttcaagtgctgacttcagacgcttcgatgccgcaaacggctgcattttatcgtatgctccgtatgccaccacagaaggaaccggagcatcagcgccatctctgtaagcatagatcattgcgagcgcatggcctgcagaacctccggcgattgtcattttatcaattggatagccggcttccttcgccgcttccactaccttcggcattgcggctttgatctcgttggactgtgtcagcacgcttgcatgattcttttcatctgcaagagtatagttaattcctgctgcgacatagcctttcgagcagagccatgaaagcatctcttcatcttcgctcttatctcctgatgtaaagccgcccgcatgaatatagaccgctaatccataggacttttttgaatcatccttcggcagatagagatcaaatttctgcgcctcgccttcaccataggaaatatccttctgaagtgtaccgagactctcattccactttacggaatactttttcatctgaggtgatttcaacagtttggaagccgcacccagaccaaaggatacgataaatgttactattcctaatgcgataaaagctcccttcttcataagatatttcctccaaacattgtcccacctagaagcagattccctacagcgcgcatagcaagccttccggcaatgaatccagttgcgatgatgacgatcagaatgatcactcttttctttgtcataaagttctccttgattttttgctgtaacagatgtatcatctaattgatggtacaaatataccatcatcacattcgtttgtaaataccttttgtaataatggtacaaaccaggaggaaatgtcacatcatgggaaacaaagagagaaattcatacgtgcgcaatgcaatcactgacgcattgcttgaaatgttaaaaaccagggatttatcagcaattacgataggtgagatcactgaaaaagcacaggtttcaaggaactccttttacaggaattttgcttctaaggaagatataatacgccagcggattttgacatatcttaatgaatggcgtaatcggatgaaatctgaaaaatcagcagatcagaagcatatttacttcatactctttgatattgcggagcagcataaggattttttcctgctgttacgcgataccaatcttctgtatctgctgcaggatgaattttttaaaaatttcggtccgactgatgaggacaatgaaatcgcagcctattccaaggccttcttcacttacagcacctatggattccttgagacctggatcagaagaggcatgagccggacagcaaaagaaatgaagaaaatgcttgatcaaggagcttcagataaagatttatagagactgaacttctgtgttttcctcgtttgaattagtgtgtggagctgaagccttataggataaattctgtataatggtgtaatttcagaagtctaatatattttaaaaatcatcgtctgagccttcatccatatcatcatcataaccgtcatcaggaatatagcgtttaaaaccgagctttaacaaaaggcagatcacgtgtttattttcttcaagaaactttttccatcagatcttctacgtcgcagcacagaactttcgacagcttaacgagagtctccgcctgtgctttattaatatttttctgtctctgttcgtattgctggatcgttcggaccgaaatatccgcctctttggccaaagcactctgacttaagcctgcgacaagacgatatctttttaaagcagtttccggagaagcttttttatacatttcatccatcttatcacagaactgtctgatatccatttcatgataaggattgtacaaagagaggatactttttatcggaaccgcccgattgatctctgcaaaagaaaaatttcggaaccactgataatatgcaagcgcccatccggtccagtactcaggacttctgtcaacaggatacctgggctttattctttcataagaaatatttgatctgtcaagaacctcatatgctatctcgactccagacatcccggtcagaagagaaaaatctccttttccaaagcggtcggcgattccagatacaagaaacatatcataaaatccgtcgagcttgaatttgagctcatatactgcaaaatcaagcattctacccattgcggtccttgcacatcccagataagttttatcgtaagcggttatcatcaggtttcatctcctcatccaaaatctgagtgatataaatatcaccgcgtcttcgtctgttacgctcaatatcaaaatattcacgtctggcattactgtcccgatgctttttctttgagtaatattcttctttgtcagcgacctcaaatcccgtataacagatcctgtcaaaagcctttttgctctttaatacaaactgcaggccaagctttccgagatgcattgcattattcagctgacgatacgaaatcgttccgttaatgaaatcctgtgcgaaagaaaaataactgtcatcagcacggtatccgattatcgcatcatattttttataatcaagataaaagttcgagagaatatacttttttgcatcaagtgcaagtcctgacgggacatcaaattccctgttctcaaggagaatagaaagccagtgaagaatacagtaggagctgtcatttaaatttaatattttcagtccgtcacattccaattcatagcagttggcataaccatcgtgatcttcggaaactccccactctttcgccatctcaatactgtcagtgcagtaaaagccgagaccgtaatcattatatttttttccaaatccaaatattggcttttctataatattttctgaaccgtgatacagctttcttatcatcagctttcatctccatttatctgcattatactcccgtgggagtataatgtcaaatagaaaaaccattatctcgtcaaatgatctattacttttggttatagctgaaagcagcggcttaaagacaccctttcatctcagcgacgctatcgggcagagccccgatttgaatcatcttgccatttactagtgcatcagcttacgatctcaatagcctgtaccgggcagttctcatagcatcttccgctgatagtttcatgatacatgttttagcgtccatatcgtcacctccgaaatacatcaagtatttcttctacataaacctcaggcttttcagattcatgccctttttttacagttaaaagcttccctagtaaaaatgaccagtatatatcaccatatttcctggcatcgccatccttaaagagtccctgctctattcccttttgaaagaaatcaccaagaaattttctcccgaaatctgtcagaattggatttttatccgtatatttatctacatcgatctcatggtttgcaaatgtcgtcaaaagaatctgaacaggcggcgcatcggcaaagttgctgctgtcgttcaccagaaaatccactccgaaccgtttcagggcctcgagcggattttccataattgtaaaggggatatttttttcatgaagctgttcaagcagtctccagaagtcgggatgcaggatcggatcgccgcctgtaatataaaattccgacagtctgtcaaatgtccggcagaaatcaagacagttttcaagtgtcttctcgatctcatcccacgtcatcctcgtgagcggtaccccgttattaccatgaaagatgtagcaatgcttgcacctctggtcacagtcatccatcagctgccattgaaaagcaaaataattcttcatatcaatctaaaacctataaaaaaccaccggaacacgtattgcatcccggtggccggttcattaacactaaatgtaattacttaattgaattgatcaagatggcaaagaccatgggcgttgagaatcctacctctggcaaggatttcatcaagagttacaaaaaacgtgacgaaattcatatgaattccgccacgctcttcatacgatcagatcaatgtctgaccagatatcttatattaaattacgattaaagctcaatcgcatacttctgtgtataatcgaccatattgctgtactctgactttggattctcgatatagaagactgctgccttgaatccggtctggtctttgcctgatcgccatcttcagttgcaaggaagaatgttcctgtctctcctaaaaatttttccagataagaaccattagtggcaacatttgccactctgcaggcagctttttaagccacctgccaactttctaatgatatcggggtttatttttttacaatggagtaatgaaaatcatcttctgcatcaagtgcatagccggtttttttcaacattccttccatcacactcttacggattgtgtaataaggactgctgcttttgtcccagtactgggcatgaatatcctctgtcatctcccatgagatgtgatcttctgatgattcagtagttacattgacacggtcgcaaggcattccgttcacaaagaaatcctcaaatgacctgaaggcttcttctacagaacctgcctgtagggaattctgttctccaaactgttctgcagcagaacaaagtgcatccatacgcgtttcatctgaagcaatgattgcggttatcaggtctgcgtatctggtctcagcatctgaaatctgagcctgcagccagccatgtatattttcctcatcgattactgtctccagcggaggaagtgttttcgtataatcatctgcggctgaaatccagccattcttttccgcaagctcagctatttcctgagtcagcttttcctgattccctattttgttatacagccaaaaatgaattggtcctaaaaatgcactcatcctgtcaacctccaatctgaacaaatgattccttcgggagtccgcataccggacaggtccagtcgtctgggacatcctcccatgttgtaccaggttttactccgttttcaggatcaccctttgccggatcatagatgtatccgcaagggcactgccacttaggaagtgaaacctctgcttctgaagctgtaccagcttcttctccgccggtcagttcttttactacatcaggaatctttgcgaaatcatcttcctctggattccatgatgattttacttcaggctttacgacctcaaaaccggcatcggttaatttttcacgaagaactttgttgccttcaccgctccagccatagcatccgaataccgcggccttcttccccttgaacttaagagacttgagataatacaggaatcccgctacgcttgcgagaatgccattaaggatagtcggcgatccaacggcgattgccttggacttgaagacctcgccaatgatatcgtctttctcagtgtgatcaacattaaataccctgacaacggtttcaggtgactgcctgtgaatctcatctgctattgcatgggcgatcttttcggttccgtgccactctgtgccatagacgatagttatctggttttcctgataagcatcagcccactttgcatatgcctctactatcttcataggctccttgcgccagatcgcaccgtgacttggagctatcatatctattggaagatttaaggcagctatttctttaaccttcttaataacaagcggagaaaatggggcgacgatatttgcaaaatagcgctgtgcctcattccagagtgtctcctggtctgccttatccgcgaacatctcctctaccgcataatgctgtccaaaagcatccattgaaaagagaatgttgtcaccagtcaggtaggtcgccatagaatccggccagtgcaggaaggtcatctccacaaaaatcagcttcttaccgtttccgatatcaagcgtgtctccggtatgaactacatgaaaattccagccgcgcttaccatactgtccttccagggatttcacggcattcgcggtgcagtaaatcggggtgtccggtattttttccatcagagcaggaagactgccggaatggtcattttctccatgatttactactatataatcgatcttgttcaggtcgatttctgattcaagatttttgatgaattcaaactgatgcggtgcccagaccgtatccataagaactatcttttcttcttcgatcagatacgcattctgtgagctgccgctgtggattgtaaaatcatcgccatggaatttctgcagatcccagtctagatatccgatccatgatacattattttttacctgttttctcatcctgatcacctcgtaaatttgcctttctggttatactttacgagaatgagatcagaaagtatgttgtatttagcacatttacgatttatctgatcatatgtacaaaaatgcaggcagctttttattaccatccttttcatgtagttgcatttttttgctgctctcactgcttcggtaagtaaatattgaaaaaagcatcggtaattgatatcatgatatcgtttcttgagatatttttaagggaaaggttactagatgaagatttttttaattatttttgcactggctctttttgccagctcctgtggcttccgaaaatacgtgtggttcatatcgcttggatatggagctgcgattgctcttatcggtgtcgggctgctttttattttttcaagtgagctgacgcttgtgacagttctgcagtgtgtgcttcttatagtctatggatgcaggctctccggatatctgacctaccgcgatttaaagactgcctataacaaacggatgaagggcgaagtgaaaacagatgatggagtttcttttggtgcaaaaatgggaatctggatttccgctgcacttctgtacgtcctccagacttcaccggtgactttcagtctcatgagccatagaaccactgatgctttcatcattatcgggcttctgatctctgtctgcggtctgactcttgagactactgctgatcttcagaaaaacaaggcaaagcaaaaggctccgggacgctttgttgataacggactgttccgcctggtacgctgccctaactatttcggagagatgattttctggactggtgtattcatttcagggataaatgtatatcacaatgccgttgaatggatctgcgccattgccggctttgctgggatcatctatgtaatgtttggcggcgccagaagacttgaaatccgtcagaataaaaactacggagacgatccggaatatcagaaatacaaatcttcgactccgatcatgattccatttatcccactctactcagtaaaagatcacaaatggctggtggcataatgaaaaagaaccaagtcatcaaattttttcgcctgaaactgcatttgtcacctcgttataatctgatttcttcccaaaaaggcggattcaatttttaaattttgctcaccggcttgcataaaagtataaatgagtataaaatgtataaagaagtataaacgagtataaaaaaaataaaggagtataaatgtcaaatccatttaccctctcattcggaaaaaagccatatgaatatatatcgagaatccaacagacagatgagatactcgaagactttaacgcagaacatcctgtttcacaggtctatatgttgactggagtcagaggttcagggaagactgtgcttatgtctgctattgcaaatcatctgtcagaaagtgatgactggattgttgtagagcttaatcccactcgcgatttgctgaaaagcctggcttcaaaactttatgaaaaagaaaaactaaaggctgcttttatcaatgcaaatctggatttttctgttcttggaattggaatccatatagaaggtgcttcacctgttacagacatagaggtggctatagagcgaatgctgcggataatacagcgaatgcacaaaagagtccttatcacaattgacgaagttgagaacagcaagacgataagggaattcgtgagcgcttttcaaatctatatgagagaaaattatcctgtttttctcctgatgaccggcttatatgataatataaatgccctacagaacagtaataatgtgacctttctatacagagctcccaagattgaaatgggaccacttgataccggtgcggtcgtgaacagctacaagcagatatttgatatagatacagatcatgctaaaaatctggcatcactcacgatgggataccctttcgcctaccaggtcctggggtatctatgttttaaaaataaatgtgctgtaaatcctgagcctgtcatcggcgaatatgaccagcgcctgtctgaatatgtatatactaaaatctggtctgaaatgtctgaaaaagataaaaaaattgccgttgctatgacagaaacacaggaagtttcagagataatggagaaatctgaaatgaaaaaatctgaattctctccataccgtgcaagactcataaaaagaggactggcatattcaccagaacgtggaaagctgtgttttcttcttcccaggtttgcagaatttgtagaggttaattactaagtatagtctcaaccatcaccctacaaatacacaagccaggtgctatgcacctggctcttgtttttccagtaaatcaatcacatatttttctttaaatatctaccttcttttccagcagatatgctgatgctgcgaaggctgcagctgagcaccctagttcaaagataatcgatgctcctgcttcattgaagttttcaaaaagctttaactcaagtccattggtccccatgccaagactaacagcatctgcaatgtttgaaatctttgaagagataaataccaccagaataaacaaggctaagaacagcaatacactgatcagcttttctcctttttttccacgaaggaccgaagcactgatagtagatgccagataggccagacacactaaataggtcacaagacaaatgatgcaaataagcagcttaattagcgttattacagtgtcaccactgtagagactgtctagttactgcagccctaaaaatgagcaaaagaaaaccctacggatgatcgttgttgtgtttgccgacccaatagcatcattccgtaaggttccaccatgcgctactaatgagcatacaacattctgaaagatttttcaatagcctcagggcacctcccgcagatttctgatactaaagacaccagagatccaacaggaggatattttggctcttcggtagtctctgtgggtaagaaactccattccttttgagtatcactgcgttcatctattcctcgactttctgttaggaagtggtatcctgatattcgagcataccaggtagaccatatccagcatattttgtatgttcctgaacccgtaggccttgcggattatcagcttgatcttattgttagtggcctcgatcctggcgttgctcagcccgtactttatggtgttcagtatgtgctccttatgtcgcttgatcttcttgtaaagatcatgaaacacggggatcctgctgtggctcgcccaccagagccagtggtccagttcggattctgctttatccgcatcggtattcttgaagatcatgcggagagcctccttaaggcagtagccacgatacagctgtctgtcatttgcctgtatcatcgccagttttacctgctggttcttggtaaggttctccggagccttgcccagggcaaatcgagaattcttgatctcagacgcctcagcctttgctgcttttacatctgcggcagccttgtcatcagatttcggacgcccttttgtctttggcttgttcttcgacagttctctgactttgtcattggctttatgccatcgctctgagcgcagctcgtcaagagcatccatagcccactctaccacatggaatggatcaacacatctcacacagtccggcgtgaactcgtttacgcagtctgttatccagcgtgctccatcacctgtaacgacctttatgctggccttctgcttatctgtgagctgtccatagaacttggagagcacagcttttccgtggccatcagccgcccacactacggtgtttgtatcgtggttgacgatgactgtgatgtatttatagcctttgcagtaactggtctcgtctatgcctatgtggacaagcccatcaaggcgtctggacagatccggctcgagatcatgcaggctacggctgatgcatttgccgacagtcttccagtctatgcgcatgtactcagagacagtgctccctggaagatattttgcgagccatgatactgtcatgtcaaagtcctttgtaaagccgctgtttgggtaggcccacggaacatcagctgttacgacaccatgttcaggacatacgatgcggttggtctgagacctgatgtccaccattactccgccaaaatccaggcctctccacacccttagagattgtgatggtctgtcgtatccgggaagttttttacgtccacagaatgggcacttgttccggttccatgagttcggacctgcatctatcgtaaggtgtgtaacgccatcgtgatcactgtaaatttcggcatcagtcacaacaacgtccttgacaccaatgatctttttgagtaatgtattggaagaggtcatctcgtttctccttatcgttgatgtttcgtcgctgataatgataccgaaaatgaggtgacctttcaatgtttagttataaccgcaggcggggattttacccacaaagtatcccgaagcctctttaaaaccaatattttataaatatacttcctaccaaaaaatattgcatgtttacgcatggtttattaccaagacaaaaaacagatggcgatataatcatatttcataacttaagaattccacttgtctttatttacatacttcacaaacatttcacagtcatccattgcattccttggtaaaatatgacaaaatactggtatcaaatcaataaaatttgtgctatttaacagaaaaatccagacatttgcaaaagtatttatggaggacatgattatgcagagatttacaaatccacgtgacctgtaccatggcaagggagctctcgaagctttgaaaactcttaagggaaagaaagctatcatctgtgtaggcggcggatctatgaagagattcggcttcctcggaagagctgaggagtaccttcatgaagctggaatggagacagctcttatcgagggaatagagtcagatccatcagtaaagacagttatggatggtgccaagaagatggaggaattccagccagactggatcatcgccatcggcggcggctcaccaatcgacgcagcaaaggctatgtggatcaagtacgagcatccggagtgcacctttgaggacatgtgtaaggtcttcgcactccctgagctccgccacaaggctaagttctgtgcagtatcatccacctcaggtacagctacagaagttacagccttctctatcatcacagactatgaaaagggaatcaagtacccaatagcagacttccagattacaccggatgtagccatcgtagatcctgagctcgcagagacgatgcctaaaaagctcgtagctcacaccggaatggacgctatgacacatgctatcgaggcctttgtttcaacagctgcttctgatttcacagatgccccggctcttcgtgcgatgactcttattaaggataacctgattcagtcatataacgaggacaaggccgcaggagatgctatgacctcccgtgacataatgcacaacgcacagtgcctcgccggaatcgccttctcaagcgcttctctcggaatcgttcactctatggctcataagaccggagctgcctttgcagactacggtgcccacatcatccacggcgcagcaaacgctatgtacctgccaaaggttatcgccttcaactcaaaggataagagagctgcagagaggtacgctttcatctctgactatctcgtacttggcggcacctcagagcaggataagattgcaaagcttatagacctgctccgcggcatgaatgataagcttaacattcctcactgcatcaagaactacggaccggacagctatccgacagagcagggcttcgttcctgaggaggtattccttgagagacttcctgaaatcgcaaagaacgctatcctcgatgcatgcacacttacgaatccacgtccacttagcgctgacaagagcgaggacatcgagcttatggagaagctcctcaaggcctgctattacgactcagaagtggacttctgataacgtttatttttcaatgatcagaaatgacatccgggctccattggaggccggatgttttgacttaactcgtgagacaattctggataagaaaaaattatcgctgccgggactgccggagcaattgcgcttactgcttcagtcgtcgatttaaagctggctgaatatgtcggtgagataaagaggcgaccgattgcggtcaaaaagcgtgacttaatgacccatatatcatataatgcatttactactgatttttttcatggaatcagacgtccactttcttttccagcagatatgctgatgctgcaaaggctgcagctgagcatccgagttcaaagataatcgatgctccagcttcattgaagttttcaaacagcttcagctcaagtccattggttcccatgtcaagactaacagcatctgaaatatttgaaatctttgaagaaatatatactacaagaataaacagagctaagaaaagcactatactgatcagcttttctccctttttgccgcgaagaacggaagcactgatggtagaagccaggtaagccagacacactaaatatgtcacgagacaaatgatgcatataagcagcttaattagcgttattacagtgtcaccactgtagagactgtctaaaagcttcgcgattgcaggcactaacgaggatgtcggatcatccctcttcatagcgcttgcaatcagatgaatatccgcaaatcctaagaaacagtatccaataaaaagagtactgcccactatgaggattacggttatttttccaaggagaatctgccatgatgggattggcgtcataaaaagcatatagccggatttctcccgcaggtctctgttatacatggctatgccctcaaatatgactattaaaagcgtgcccaagccagccagaatcagtatcacactcatccctgttgaaatcctgtagctaaaagcgttgctgatcaagaatgcaatctcaactatgatcatgattgcaatcattaccagatagcggaatctgttttttataaactcatatttcattattcttgccatatcatacctcactgtatatctcacggtacttatccgcaattgacttgttctcatttattcgcagcgtctcgacgtcgcacatctcagcgatcctgccatttttcataaaaacagccatatccactatactctcgagttcctctaccatatgcgatgaaatcacaagggaagagccctcactcatttctccaataatcatcttagccaatacgtctcgagacaacaggtctattccattaaacggctcgtcgagaaggatcagctttgaacgtctggccatggctgcggctatttttaccttcgcgagcattcccgaggaaagagacctgaccttcatatcaggagaaatctccatatcctttatcaggtcgtagaatctcgctctgtcaaaatccttgaaaaaatcatcataatatgctgccacatcgctgaccttcatatagctgtaaaaaaacggttcagtcggagtgtatgatatatcctctctcgctctccagtccaattgtttcccatccacagagatgctgccctcgctcttttttacaagtcctgagagaatcttcatcagggttgattttcctgagccgttcggccctaacagggcatatatatgcccgccggtaagctcaagattcacctggtctactgctcttttcgcaaagtaacttttcgttagtccctcacactctattttcattctggttcctttcttttaagtaagccgataactccgcctctatctctttgtcatttaatccgaggcctctcatagtttctacaaattctcctacggcctttgttactttttcgttttttaaatcagagacattgccgtcactgacaaaggttcctatgcctctttttgtaaaaactattccccgcctttcaagttctgcatagacccgggacgcagtattggggtttatcctgtaggtcacagcgagttccctcgaggatggaagcttttccccggcggtaatctcacccgatacaattctcgacgtgatgtcttcgatcacctgcagatatataggcttatcgtttgtaaagtccattttgactcctgttaaagttattgtattagtgcactagatatatagtacactataattatagatttgtaaaggggaaatttttatttcgaagattgcttgttgtaaaatgcttttttttactggctcatcaaccccaaaccggaaggatataaaacacagcggagctggaagaattgcaaggattcatatgcttccgatgtctctttacgaggcaggttattccgatggaaaaatttctctgaaagacatatgctacggaaaagctgatgatgtaatgactggtgaagtcgatcttaaaaacctgattgattttattctgcgcggtggctggcctgacaatattgatattcctctcagtgctgcttcactggttccgaagcaatatgttgaggccatcattacagacgactcggcacgaatcgatggcgtccagcgtgatactttaaaaatgcgccgcctgctcaaatctctcgcacgaaacgagatcactactgcgacaaaccgcaccctgatccgcgacatcaagcttcgaaccttttaaaaatcagcggcgaatttgatgaagatccaaaatcaaaaaagccacaggcactctgtgttgtctgcggtatgtcaagcgcggcctaccgcaggcccgacggagtatatgtggtcccgatcacttcacttaagaattaacgccttattttaccggcgaacgttacatcgtccaaatggctgtcaatccagccgatgaagaagctgcttatgagcttgtgaaataacctttacaaacagccagcaatatcatataattgttttagctcggttagagccgagtcggaaggaaccgagtaaaatgaaatttattggaagaactgccgagctcaatcggctgaaaaaagagtttgcttcagatgaaatgcgtatggccctgatatacggaagacgcagggttggtaaaagcgagctcattaaagaagccattaaagagtcagagataaagagcatatactatgaatgcaagcaggtaacggaagcaagcaacgtccagagcatctgtgacgtaatttctgaagcttttggattgccaaaactaggttattcatcaatcgaagatctaataaattatgtatttactctttcagaaaatgaaaatcttatttttgttttagacgagtatccatatctgagagaaaatgtcaaagggctggacagcatcattcaatccctggtagataaatatcgtgattctgcaaagttaaagtttgttatactcggatcctatgtggatatcatgaaatctctgatagaacattccaatccattatttggaagagtagatctggtgatagacctgaagcagatggattattttgaatcagcacagttttacccagatatgtcagacaaggacaaagtcaggatctattctgtttttggaggcataccttatttcaacaggcttatagatgacagtaaaagcgtaaaggaaaatatcatcgaccttatagcatctccaggtgcacgccttgagaacgaggtctctatgtacttaaatgctgagatctccaaaatagtaaatgctaacgaggtattttatgctctttccaaaggagcctccagatacagcgatatcctttcacaatctcacgtttcaagtggtcctacgatggtagatgttcttgataagctgataaaaatggaggttgttgaaaaaacagcaccgatcaacgatgaggacaataaaaagaaagctggctattatatctgtgacaacctgtcactattctattacagatatattttcaaatactcttcccagctccaaataatggactctgatattttttacgacaaatacatagctgatgactttgagaagagctatgtccctcataaattcgaggaagtatgcaagcagtatctgatcaggcagaacaggcttggaaaaataacccctgtcatcgaaaagattggtaaatactattacgatgatcctaaaacccatacaaatggagaatttgatgttgtcactttggatgaaaagggatatgtcttttatgaggtcaagttcagaaaaaagaaaatttccagggaagtaatagaagaggaaatccatcaggtccaagcgactggattaaagagagtttgaaaaaaagtctgtaaaagttttcatatagggtctttcatgatacaattattttaattcatggagggcctattattatggcaagaagagaaaagcaaccagtacaccacgttcagatgaacagatggcaaaagagccatcatccaggggcttctgcaggagtatgatatccgggatgcaaacgacatccaggaaccctcaaggatcttcttgggtgcaccatcaaagaatgatggagctgagatggataatcatcttggctatgaaaaatcagagcgtaacggcgattccgaagaagaccgcaactaccgaacggttacaaacaaagcgtgtcaactccagctacggcagcatggatatcgatgtcccgcaggacaggaattccacgttcgagccacaggttgtaaagaaacgccagaagatatatcagagatagaccatagatcatctctatgtatgccaagggaatagcactacacagataacggagatcatcaggatatctatggctttgaggcttctgagggctttatctccgacgtgacagaaaaatcctgccgcagataagaatggcaacaggccgctttcagccgtaatccgatagtgttcattgatgccatacacttccggtccgtgatgacagtgtggtaagaaagcgtcagctacgtttgttctcggcatcaacttgacggcaaaaggaagtactgctattgaagtcggcgagaatgagagcaaagtactggctgtctgttctgaattccctgaagaaccgtggagtacaggatatcctgatactctgctcagacgggcttaccgggatcaaagatgctatatcgacggcttttccgaaaacagagcagcagcgctgtattgtgcatatggtacgcaacacccttaatatgtcccaacaaggccatgaaagcatttgcaaaggacttaagactatatatacggcggctgatgagaaactgctcttaccaatcttgagaaagtaactgaaaaatggaaggaccagtatccttatgcgatgacacggtggaacgataactgggatgccatcagcccgatattcaagttctccaaagacgtcagaacagctttctacacgaccaatgccatagagtcactcaattcatccctgcgccgtctgaaccgccagagaagcgtatttccagctcacaggcacttacgaaagcactgtatcttgcaacctgggagacaacgaagaagtggactatgccaatcaaaaactggaacaaatccgaggagaattaagatcatgtatcctgccagactgccggaataagatcagatgccgtatttacggcattcccaggcttagagctcttaattgtctttctagtctgagaggtccattctgtcaagggcaggccgctttgcggtgccgaaggcacccttgacgaatgaacctctcgggctttatcatacttaagagctctaagccttattctgcactgttttgaaagtacaagtagctaccagtaaagctataatctgctgtaatgtcaataatacagattgacagaattatttctgacttctgacaggacagctgatctatgcaatattatactcaagtgatacagaagaatatatttaaaatattttaatctatatcactgcaacttttcatgaaagatctgtttttacagaaaaaaattcatactctcggattaaactgctacaggtatgtctttttttcaagatcaggatttacagaagcagagactgataaagtaggacatatagatttaacgcagatatacagataaccactgttttttattctgccttatatctttaaaattctgcattcctaccggaagccgtctttccacaatatcagccgtcctttcagatgaacaatatctgattaaattctaacataattacgaccatcatgacagggattattttatttcaacagctttttggaaaaatgatcctgcccttcagcttgtccacatccactataaatacatagaaaacatcaccatagtgctggtcgtgtaccagtcttccaaagtcaatgacattaataacgtttcctgtctttgtcctgatccggtacgcgacatagtcctcataactattttgtgatgaaggggagtttatttttccctgctcgatctgatcatttatggacttttctactttgtccagatcctcattatagacaatccggcggaaactcgactgtgtgtagtcaagaaaatcgtcgtagttgtcacactcaaacagatctatcaaatggtcatttgcaaagaggattttttcactttcatcggccttatagataaggaaggcgccaggcataccgtaggccatatttgacacgttaaatccgagctgatccctcctgatatttgacatatagtcctgataatgttttgcagtatgctttccaccaagtttggctgcatacagtgcgttatccatcatcgtaataaattctgcactgtccctggcctgcgaagggtaagaggcataccctccggaaagcgtatatcggatgctcttatcttcatatgaaaatgtcttttcacccggaatcactttctcgaaaagttccccgcactcttccggagatttattgctgattatgacgcagaactcgtcacctcctgttcttccgatcaaagcgtccgggaaggacctgcggagaaactctgaaaggtttttaagtgcgagatcacctgcgacgtgtccatatatatcatttatcagtttaaaatcatcgagatctataaaaattccggtaagttctattaccttttcgtcattcacaaggctctcaagccgtcggttcaatccacctctgttgtaaatgccggtcagcggatccttatatgccaggtcatccagctttttgttcttttgtaaaagttttcgattgtattgtttagaaaaatacagtgcaatgataattgtaaggcacatgcagacaatcaccagtataattaatgtgcggtcgacatatggcttaattgcctttctctgaagcgcatcgtactgcctgatgctgcttaaattcatgcccacacagatgacccagttatattccttgtccagggcgcagtaggtaagcttcttcaccggtttgtcattcttatatgctttataataatacatgtaaaaaccactgccggatttttttacaatatcaagctctttctggtatggtctgttcccggctgcatctgttgtcctggttgagagcacaaggccttctgaagacgctggattaggatgcatcagacggacggcatacccgtctcctccattgtaatcctttatctcattgacccacatgtatccgtcacccggatattttaatgaatggaccttttcatatgtactgtcataaacttccgagtatatctcatctttggtcttcccctgttttttcaggagatttctcttactgttaatttttctgagtctgttgtcaacagcagtttttaacacatctttgtccgacttaagaatgatattgtagaggttctttgaattttgtcttaccagtacaccaaatccaatgccaaaaaccagatacaagactattatcgtgataataattgtaatgatatctttatagacagactttttgtctttagactcattatatttttctgatttcatctgttgtaaaccttctctttttcctgtctttacactctatcccttatatatatcgtactacattttcattaactttagatttatctggaatttttatttttattgtgatagaataatgtgtcgttatgattcaaccttgaagtgaatgaatttcaagtatcagagctcagattgaatctggaaggagtaaattttatcatgtcaaataagtctttgaacagccgggcttcattttctggaaaacttggctatgtgctggctacagcaggatcggccgttggccttggcaatatctggcgttttccctatctggctgcaaagtacggcgggggaatctttcttttagtctatgtcattttagccataacattcggctattcgctgatgacatctgaaaccgcgcttggaagaaagtcaaagaagagcccggtcggtgctttccaccacttcagcagcagtaagtcagcgtcgttcggaggatggataaacgccataattcctatgatcatctgcccgtattactgcgtgatcggcggatgggtgttaaggtatctcgctggatatgtcgctggcggagtagacaggctcgccggtaaaaattacttctcgaattttatcggaaatgccgcttctgtcgagggctggttccttgttttttcaatctgcactctcgccgttatcctcttcggcgttcagaatggtgttgagagggcatctaagatcatgatgcctgtccttataatcttagccattattatcgctatatattcgatgacacgtcctggagccgctgccggagttaagtatctgctcgttccggatttttcgcgtttctcatggatgaccgttgtttccgctatggggcagatgttctactcgctctcgatcgcgatgggaattttatacacctacggttcatacatgaaaaaggacgtctctattgaaaaatcaacgtttgaggtcgaatgctttgatacacttgtagcagttcttgccggccttatgataatacctgccgtttttgcattttctggcgctgatgccgctaaaaacctgcagactggcccttcgctgatgtttgttacgatgccaaagatctttcagagcatgggaataggtaccgtaataggaatcgcatttttcctgctcgttttctttgcagcgcttacaagctcagtctctctggctgagagctgcgtttcgaccgttcaggatgaatgccatatcagcagaaaaaaatcaacatttatagtcggtgctctcatgctgctgctcggttcactctcgagcttcggttttaatattctctcaggtgtcaggatcttcggaatggattttctcgatttcttcgacttcctttcgaattcgattatgatgccaatcgcagctatcgccacctgcgttctcgtactgcgcactgtaacacttgacagcgttgcagaagaagttacgtcctgcggcgaaaagttccacaacagaaaagtctacaacttcgttatgaaatatctcgctatcgcattcctagggatcatcctgatctcatcggtcctcaatgtacttggcgtaatccatatgtaagaaaaaatttcaagggattgtgaagaaaattctacttcacagtctcttatttttttgatatcatataagaagtgattcctttagactcgcacgaaacctatagagataaaaggttttgcgccatttacattatttttgatggcctatgaaaagtttgataaataagttcagtaaatggttactttctacagatcttaaggatatgcagagtgaaataaattcacggaatgcgataagcctttacaggatttctcaggccggtgtcattgtcactcttctcaatatcttaaatcaggttaacctgcgctcttacaatgccttactttgtaacctggttcttcttgtcattcagataatcatatcgatagcctgtttttgctgccagaattctgtaaagcagtccccaaaagcgacttcagaactttatctgtacgagagcctgatgcttgtattcaatttagtcagcagcacatttatcaatcacaatatcaagggagttgcgtttctgatctacgctaccgttctgccgcttttgatcatagatattccgtggcgggtcattttgtttatgaccatctgggacacatcatttatctgctgctcatttattgccaaatcacctcatctgtttcaggtcgacttaggccatatcctgatgagttatgtgaacacactgatctgcctttccatcgttctttcatcacggctgaatgagatcaaaaatcacgtgagatttttaaagagtgacaggacagatcatctgacgaatctgtacaatcgcaggtattttctctatcttgcgaaaaaagagctctcctctgccaggatcaagtatgactattcgatcatctactatgatttcaacaacatccgtgattttaaccaggagcacggcttcagagacggcgatacccttctgaaaaagttcgccatttttcttcagaacaactacccttcaaggctctgcgcgcgtttcggagaagaccacttcgtcgtacttgccaaaaatgacgagtggaaaaacgctacgataaatctgatcaaagaccttgacgcctttattatcaggcgttacggaagacatattataacagatcttacagccacttcgggacttacctcggatatcaacaaggaggaggaagctattactatgcctctttcgatccggtgcggtgtctgcgctgttcctgacagctcttcactggagagtgcctgtgacaatgcgcgtatcgcctgccattactactctgctgacaatccattcaatttcatgatatatgacgaatccatcgcacacgatatccagagcagtgcctatgtgcgccagcacatcgacgaggctgttcagaagggctatatcaaggtttactatcagccgatcgcgcgtgcggccacgaatcagatctgcaatgaggaagctcttgcacgctgggaagatccgacttatggactgcttcagccgtcgtcctttattcctatcctcgagaaacacgctcttttgtacaaggtcgatttttacgttctggagcaggtgctaagggattttaagacgagaaaagagagcggaatgcgtatcgttccggtatctataaatctttcgagaaatgatttttatggactggatgtcgtaaaagaagtcacaagccgtgtcgatgctgccaactgcccgcataatctgatcgacatcgagatcactgagagcgcctacgccgccgatccgaagaagatcatgcaggctatggacggcttccacaaggcgggttttcatgtctggatggacgatttcggaagcggatactcttctctcaacctgcttaaggactcctcttttgatcttataaagctcgatatgaggtttatgaaaaattttgacagcaggaccgagatcgttgtcggctcaattctgtctatggcttcgcagatgggcatcgatacgctggctgaaggtgtggagacagagaagcagcgaaatgaacttcgccgcctgggatgtggacgtctccagggctactattacagcaaaccaagtcctttaagctacattatcgataagcagaccaataacccgggatttacaattgaagatcactctcacgtctcctactatgatcaggtaagccgtttcaatctcgacaagcctcttgcgtgctttgaagattccctcgtggaaggatttacgaactctctgcctgcggcaatctcacagtgggacgataaggagggaactcttctgattctccgcgccaatacagcctttacacaggcacagaaagatctttcagatatccggtatgatttttcagctttaggtgccaccgatcagtacacttatgtcccaggaaaagaaacggctgacgccatacgtgaaagtataagcaccggtcgtggcgtatcatatcagcttatcatgaataaagttcctgtcacgttctatgtacacatgataggaaaagacgatctgagcgacagaaatgccatcctcttcgttgtgatcccgaatcgctcatgatcacaccaatggagaattttcagatcacttgaagtcaaaccttacgagttcgcagttatcgattcccgaatttgaaaattcttcgtttgtcatatcatgaaaatatgcctgtaccattctggcgattccgttgtgggcgaccaggatatatgtctttccagtcgcctcttctctctccttcaagtcgtcgagcagattgaaaatccgctgtccgagctttagcatcgattcaccgccactgtacgagtcagcgaaattctgcttgcttctttggaattccgctccgtctcttgctgtcccctcatatcttccaaaattctgctcgataagacgtggctctatgctcatcggaagaccggtgattttcgcgatggtctcagcagtgtgcctcgcgcggctgaggggagaagcgagaagctcgtctgccttgacttcgccactgtccattttttccctgatcaggtgtcctgtcctttcagcctgcctgtaccctgttggagtaagatcgatatcggtccttccacagacctttccctcaacgttccaatatgtctgtccatggcggacaaaataaatgcatgccataaaagtgcctccatatataatataatataagctaaggcacttatcttttcaaggataaaaaagcatcagctcctacatcaggacgatcttattcatgtaatcctgactcttaattatgtttttgtactctttcggtgtgaggcctgtaaacttcttgaaggtgcggacgaaggccggctgatcgtagtatccaaaggaagtggcaacatcgcagatatttgacgtcgggtttttgtcgataaaatctatagcgctctggaattttaaaatcccggcatattttttcggggagaggcccatcgcatcgcgaaacactttctcaatgtatctggatgtgtagcctgattcttctgctatcgaatcgatcctgacatttccgcggaggtcggaaatttcagagactatcgaacgcataatctctgaagtggtggtgtacggcagctcgagcgagcccagttttttcctgtaaaaatctaaaaagaagttgcagcggctgtcaaagtcaggaagctcgcacattttttcagtcaggaactgatctccgccacagatagggaggtctagctgttcgtggttgtagcttccgaagcttccctctaaaaataccggctttacaccgggcagaaatctcattccaaagtaggtgtgcccttcgaccatccaggtcttcgtgcgctcaaggacggttccggcggctatcgccctgtccccgtcatatgaaatatcaaagatcagatcaatgcagccatcgggaatagaaggcagcacagcgagtccggggtttttcacctcgaactcgtaaaaatgtgctatgcccatgtcgtttatgattctttttttatagatatcactgcttagcgcccaatccggttgaattgaatacataagcacgcccctcctcttcttcttcgtaattcagagcttctctgtttacttcgtccatatcgagcggcgtgaacggctttaccttcatcacgaatttgatccagatcgcacagtaggtcacaaggactacgaagagcacagcgcagagctcatagatccttatcctgtctgccccggagcttatatgggcgatcatatagacatttccgataattcctatgatctgcgggatccctttcattgtaaactttctcggccgatccgggtattttttccttaaaataagaaccgaaatatgaacgaggatatatgtaaagagccagaagcatgaacctgaaaggatcaggaagcttactgccgaagctgttccaagtcctgataccacgaggatcccaacagaaacagaaaggaaaacgaggccaacaaatgcggcgccgtttttatttgtcctggcaaaaactcttggcaccattccagcgagaagatactgccccgtgcctccatctacttccggcatcagctggtttagttccgcaaatgaaagtccgacaaatgagctaaggatcacaaccagaaaaagcgggattataaaccatcttccgatcgaacccattcctgttcccaaagatacgagacagcttgtcgcaactataagtcccacgttgatcgcaacggcactgaaaagtcctaatttcttctgctgcatagatgagcctccttccaataaaaaaacggagttccatttctggaactccgttgtcctttaaatttgtatctctttttgaataaaaaaagtatatcacaatttaaggcgtaaaattgtatttttccgaatcatctgcttaagcagaagtaattgccccctactgccatatatggtctggcccatgagaaatatcttcctgccgagaagaagagcaggttctttggatgagaattctttataagcgcatctttggctgcgtttacggtctcaccacagagccttactctgtttatcgagccgttccttactactgaaaacgcgcccctggccgtgatcgcagatttaagcggatgagaaccgccaaaggtcctcgccctgtttacaattgtctctgccacgagctctttggccttgtagcttgaagcatctcctgcctcggccgaaatgaccctgcacatcaggtcaaaatcgcctttcgtaatctttacctgggataatttcttaagttctttgtaggaaatatcgatcagaacctggctttcaaacttcgctctggcgttgtaattctttttattgacccagatatacttacctctcattttagaaagctttgacttgtacttcttcgtaagctt

SEQ ID NO: 4 - DNA, 192972 bp, Unknown
  Metagenome-assembled genome
aatacgcagtgttccgtgctcctgaacgataagcgcatttctcagcggaaccatgaaaagcacaccgaggacaccaccgaccaacagataagagcgataagtccaaatgaagggtagccgtctttccatcgtttgcccacataaacatagctggcagtgtaaaaatagcgcctgctgcactgactcaccggctgatccgatggtctgaaccatattgttctcaaggatggaatctctgtgcaggataaaacggataagtcccatcgaaataacggctgcggaatcgatgccgagattgtcatccgatcttcagacccaggtacgcgttcgccgcaccgaataagattgccagcaggatacctactattaccgaaaacggcgacagctcccgcatcgttgtttctgcagacacaaatgtttgaattcttttgtttcgttactcatttctttacctttctttcctttattccccaagcccccaccaaatggcagactttaagggccgcttcccgcagctgtaagtaatccacggaaagcagcccttctattataaatgtgatattttcgggtgtcaactagaattaatgcaggctgttgcacgtcaagccaacattatgaagcgccatcagcttatggctcactcaatgcgcgttttcctgttcgtcgcacgactatttgcggctacttttcaggcaatccattaaccctgcatcagctcatcacctggcttattgatttaagccttctcataaattcatctttcggtactttatacttgctcaaagccctgcttgcagcgacatctacagacagtgttccgtcgtatgccagtccaagaagctcatcgatcttcccctctgttctgccttcttctcttccttcttctctccctacattgtcaagcactttttgcctgaaaaataaaggttttcattgttcctcaaaataaagaagagtcaaatattgtgagcatttctgtgtatctggtacgaaaatagcctattcagggtacactttttaaaacgtcttcatatctcgttttaaaggccttatgtatacccctgtcagctatggcagcgtacctcccatgtctaccgggatctttgtcccaacttcttcgttccgcctgcccacaaccagggtgtcagcttagctccttttcagggtcgtgccctatggaaaaaattcctcgactactggctcattctttgtaaataacttactgaccatgtatcttccacaacagcaccttgcggtggacgtttacctgctgtttccaatggcatagtctttgcctgtgtgctacattcttttacatcgcagctggcctcaaccgactcatatctgtcggctcaggacactgcgatgtgctgggtatgctacctatttctaagctgccactatctctgtgtccatatctttccttcgtatgtctctaagcatctttgtgccatcataatctacgccttttgccaggattacataaaagattctgatcagcttgcaggcaaccgcgattatagcctgcatcttctttaacgggttgtccttcttgtccggtagtaagtatacaattccttgaactctgcattcttgcctaccacaatactgctgcttcatacagcacatatctcagcctttttcgtcctcgatagcttatgtgactttctcctttgtgctttccggaactggtctccactattgcgtatcctgcagtttctgaagctgtcttggatcctcaaaacttcttatgtctcctacttcagcaacaaacccatacgccgttttttcgcctatccccggtatctcaaggagtttgttaacataaggtatatcactggtcttctcattcagcttttctaacagttctgcaaccctatgactgtatttgtcatagtcttccagtgctccgctatctcaatccttgctgcctcatgggcggtctgcttccctatgctgttcagcgcagcttcgtatagctcaacagccctcttgtgtccggcgccgcggatttttgctttcctccagatcttctctatgccgtcagctcccagtttcacaatgtcttccgggagaggcgcctcatgaagaatcattatccctgttatcggatcgggctgtgtaaaacgtctttgattcagggaaatatatgctgaaccatctcgcaagcctgttcgttacgcgtgtcagttcttcctgtgcctggtatctcagggatgaaagcaccctcacctctgcatatacaccttccgtatgtagggtatctggtaccttccatctttcaccagccctgctatcacctttggatccttgcggtcagtcttcagtggattactcatccagctctttcgcctttttacatgatatggattcacgagaacggtcctcattccatgagattggagaaatgcgcccaagttgaaccagtaatggccggttgctccattctggtattacggcatcgagtccattctttgattgagatcctccatccacgccagaaacatatagtaaccctcttcactatttctaaactcgaagggttccgcagagatctctatccctctgtatgtaacgctctggcgtcatgcttctcactgcctatatcgatccccacgatcattgtcgtctctgtgatagccctgatcctggcattctgtgatctgtcatttttgttgcattacttctggtctttgtgttactattcatttgtgatacctctctgttctatatgttttaccaactatgctgagtcagtaaacttattttacattgagtattactttttatcaacctcctttccggaattccttatatatgtattatacaggaagcccttcattataaattctctctcctttgaattccaatatttttccacccataatctcatcaagctcctttctagcattgtcgtatctcactgacaggctgtctgccaccttctttatcatatcggtgagcagcagatacttgtcaaaggcaagcctgccatcgttgtaaagttcattgacatagtccagaagctctgtaaaagagctgatcagtatctttctggattccgctctctcatcaaaagtcctgagttccttctcaagattaaacagataaaatggaaacaggaacaacaggtcttttctgatcaaatcatccagcgaataatcagaaagcttcatagtcgataccggatactcaatactgccaccgactgtgtttatagtgtgttgctgctgccctcgttttcaacaggcacagcgtcagtaacccctgctttttctttcataactcacctcttctgaaaaaattaacaactgattctgtttcaagagtatcacagaaaatagcttttttcaagttgctaattgcagccccacaacccctttatttcattccacaccctgcccacaggaagccccactacattggtgtagtcgccgtggatttcgcggatattttttccaaaagagccctgaatgccataggccccggccttgtccatcggctcatcgctgtctgcgtacgcgcggatttccgcctccgacatcggatagacgctcacctgcgtcatctcagaaaaagttttcctgtttgtcagtgccggcctgccatcgctgcttcctaagaaaaataacgtgaccccggtatagacctcgtgcgtcctgccctgaagggccgagatcatctcgaaggccttttcatgagacgcaggttttccaagaattctgccatcagatacgaccacagtatccgccgcaataatgatgactggcttatccgatgcatgctgcccggagcgcagcaattttaaaagagtggcattcgccttttgagtggaaaggtcctccaccacggcagacggctccgtctccagcgtaaactcttcaacatccgccggaataatctctggaaaaatatcaatctgttccaggagctctctcctcctcggcgactgcgaagccagaatcacccgcggcatcagctcagacgagaccagcttatctccctggtaattaagcttcaaatgaaaaaatggcgcctcctccaccagatacttcaaaaaaatcctgtcgccttcccacagatcaaggctcttcacctgatctttttcaacccacttcagatcaccctcatcgcattcgtgcatctcaccagcgaactcatctgaagtgtagagaaacatcctctcgctctcaaacttatccggcaaaaaatcgatcacgcccctgtacttaaggcttttcaacgtaagaccagtctcttcccaaacctcgcgtctcacgcacatctctttcgattcgcccgactctacgtgcccgccgacaccaatccacttgccctcatttacatcgttgtgcttcttcgtcctgtgaagcatcaaaaccttgtcatctcttgtcaaatagcaaagtgtggtatttttcatatgaattcctttataaaaaatttgcagggctcagtgtaattagtctataccttccatttctttgacaaattcaacaaattttgaaatggtctgtatgaaatcatccatttgggctttcaatgagcttaaacatattgtctgtgagaattattttcttatcgtcaaatttataatccttctcatagaattttaccggaatctcttttttgcccacaacatgaaatgcatcgatcacattattaaatccatagcagatcgccattttaataagctcctgatgtgttatcttcccatcgttgtagtctgcacatgctttaagaaaacggctcgatttactggttgtctgttttgcgcatttttttatatgttcgcagagatttcttgtatatggttctgaaagctcctcaagtgttatctccgttttgcctttattagctagttccaatagtgacttggcaagtgcaaatttatatgtagctacattgcgaccaaacaaaatgatagaacgccagtaagattctattgatggatagtattcttgaaattctttaactctgtctttcatttttcatgcaccatttttgcttgaattatcccctttgtctttcaattacttattatttatagctcttccgcaatcttctccaccagctctttatctgccggcagccattctacgcttccgatgctttccttggtaagccaccttgcgtcctcagcttcgagaagcgtcagctttcctgaaacgacttcgcaccagaaacactgcatagacagatggaaatttggatagtcatattctactgtatctatcagatcgccaaccttgatttccgtgtctagttcctctcggatttcacgggctaaagcctgctgcggcgtctcgcccggttcaatctttccgcccggaaactcccatccatccttaaattcaccgtaaccacgctgggtggcaaatatcttatttccttttctaataacagcacaaactacatgtaaagtcttcaaaattattacctccaggtgggtcagaggggacggttctttttgtcccacgttattaagtgggacaaaaagaaccgtcccttctgacccagaaaactctagcttactatataatcgtaaatgtcttcccgcactggcacatcgaggcggtagtttatctcaaatgcatcgtcctgctttttgcctgtcacattgccggctttatccgttacatcaaatgtcatttttactggatttggctcgccgactgcgttgatctcgcccaggaaataaaactccttggcctcattgtcgtccttattttttcggatgaagagatatatccggttatctttatcttctggcgttctcttgtaaaaatggtccgcatccgcagatgtcactttcctcggatgctttgaaagagctatcagattttcaggagatacaaagcgatcctcataggctatcgcgtcatcggccttctcgtagttgataaaaaccgggagctgttttgtactcttatcgtaaaaatatccgccgagattctgggcgttcatatttttatcccagtttaaaagaagacaaacatcctcgtacgtgtatttctgatagagattaaagttcgtgtccttataaggctggctgtaattttccttgtaattttcaattccgatatctaaaagctgctctacctctctcttgaattcagagtcctgaagcatctctataaatttatcggaggctttgaaatcaccattcttatcagctgtcaaaaatacgcagtcactgaatttcttcttctccgtatctttggcgaaattatttgtcagatttctgacagctgacatgattgcatctttgctttcatttcggaaatttcggatctttttctcataagttgagatacggaatttatgtccgtcaacatcgacgatatctctaagcatcatcaactcttctgggcgcttgccctttgtcagtttttgagaaataaatctgataacctgttgttctggtgcagtcaaagtacctttgaaatccttctcgtattttacaagaaaattgtagtacgatccaaatttgtcaaagtatttgcttatgtcaactgttccatattttacaaaatcttctggttccggaattcgtccaatcctgtctttcagcttattgtaggcttcacgaagcatagctgtatcgttggttctggctgtatcaatcgattcgaaaattctctttctggagatctgatcgatatatattgtcgactcacctggaatcagcctgcttccaccacttacgaaacggcgcattctatccttgttgtatgacctgtcgccagagagtgcgatcggaatcatgtagttgttcgcgtaatttccaatgaaatcaataattacgacatactctttatccttcgatttacgaaggcctcgaccaagctgctgcacgaaaatgatcgggctctcggttggtcgcatcatgataacctgattgatctcgggaatatctacgccctcattaaaaatatcaacggttatgatatagtcgagtatctcgctctcaggaatgtcatcggaaacgagccggtttatactctcttctcttttctcctgggtgtcttcacccgagagaaaaacggttcgtttccccttttcgttcattttgttagaaagctccctgcctacgtccttacggctgacaaagataacaccctttacacgttttccgctgaaaccataaatcctggatttttcaagaacgtaatccactctctggtcgctcgtaagatactgaaaatcttcaaggctcagcttcttttcttcctgactgtcaccggcgatctcaccatttatctcaatatctgtaactccgaaatagtgaaacgggcagagaagattttcctcaagagcctgctgcagccttatctcataggcaatattgtggtcaaagtccgtgtaaatatcataaccatcagttctctctggcgtagcagtcataccgagaagaaactgaggattgaaatagtcgattattttcttatagctgcctgctgccgcatggtggacttcatcaatgattatcgtctgaaatgcgtttctcgaaaaatggtccagtgtcccgtcttttgacatagtctgaaccgtcgcaaaaatatagtcggcgttgtagtccttctctgttccagagacaatgccaaatgtaagtccacttccaagaactctgcggtagctttcgagtgctgctcgcgctatttgttcacggtgtatcaggaatagaactttcttctgcttttcgtctctcatcgcaaaagccgatgcgtaggtttttcctgtacctgtagccgaaatcagaagggcttttatctcaccactgttcctgatttctgagagattctttacaaatttagtctgcattgaattcggctcgaggcggaaatcattaaactttgtgattttctctctggccgctgtctttcgctgctgctcgatgattttgtatctggtctcatattcatcgataaaatcaggaaaagcagcagtactcttggaattccaaagctgatcccattctttcttgagattcttcaagaattcgccatcttctgtagttacagtctttacattccactccttatttgtcgtgagtgcctttgaagtcagattggagctaccgataataatccgaaaaagtcccgatttctcaaagatatagcctttagtgtgaaaaccaatattgtcacggcctgccagctgcgtctggtaaattctcagctcaatatttgaaaagttcgcaagtcttctgagcgctttcggatctgtgaaattctgatagtcagttgtcaggattttcccaggtattccttttccctgaagttcttcaaggactccgataagactctcgacgccggaatcagtgataaaagcgacactgataaaaaatctctcgcattttaaaagttcattctctattgagaccagaactttctggcctatgttgtaatcattcgacagaaattccggcctgtatgccaaattagagtcgcacgttgaatcgataaaagcggtcatcagaccttttctcaaatcatccatcatttacccctttgaaaaaccaatggccggtctctcatgaaatgtctcttatatggaacggcattccacccacgtctatattttactactatatgtgcataaatggtaaaaatcttttctctcagcagcttattcaccaaaaacttcctccccaaaaatttccagattgaatgaacatccaaagccagatataatagaacatgaatataagatttcagttagttttggtgcgagacaatgaaggaacggatactgctgcgtggaaaaggcagagcagttgagaaagagcatgctcttgtgatgaatgatgtgaagcttaacagagatacacatatgctctcctctgctgccagcggaactgaagtcaggctttcccaaaaggagattccaattcaccttctggtgacacagcaaagccgtctggcccacaaaaggcaccttccgggaattcagttacagacgacagcagccgcaaaaacagcagaatcatccaagagtactttgagcaggctctttaacaaaaataaaagttcagcttcctcgtagttctcatgactgcgatataatcgaagttcttatagtcccagaatcagaattttcagattttgggacaataagaaccgtccccgttgacccagtatttatgtcttaatgctttcgataatgcgttatttgagaaagccacttttttatcattttgtaagcgtcctaatacgattccaggatctctttcaattgaactggcaaattctcttatagcagattcatcaaaatgattattctttaaaaatgatgcatactcatcgggaggtatcagcttatcctctgcatacttatcagctcttgattcatggttgtcatgttcttcttcgaatgaaattccataatcgccattcatgatatgtccaatctcatgaaacagtgtaaaccagaaagtatctgaatacagtcttctgtcatttaccataagcataacacttcggcccaatctttttgtcgcaccattaattcctgaaccgggaagatttggcagaatgacaaatacaacacccgcctcagcaaatttttctctaagcagagtataaaaaccactatgctttgttgtcaaagtcagtgcatattcaacagcatcttcaaatttctttttatcatactttggaacatcgatttttaatgctttattaatggcgatctgaaccatagcatttgctcgtacagtatttgcttctttcatatggcccgacatacttctgaaactaactgacatgttcggtttcgttaatactgaaagagaagcgacatttagaaattctcttaaagatttaatctgttcgtttatttttctaggaaaatccggcaagttaaaattatccctaaaatacttataatccaagtacttaaaaacttttttttcctgctctaattccctgtctgattcaaattccgcaattaatgtatcataatttttctgcagatttaaccaaaaatctacgcttgtccccatcatcctagacagtttcactgccatttcaatggacagactctgctctcctcgtaccaaaatgctcagattcttcgcagtcgtatctaatctgctggcaaagtccttctgagaaagtccgctttcatcgataatctcttcgatatagtatccaggatgaaaagcaatcctatcatgatattctttataattactcataatcactctcctatcacaaaattacctaacaggtaattttatgatatcatcagaaataatatttgtcaatataatacgaaaatgtaaaaaaataagaggtggcaagaatcaatgtgatctgccgcctcttttttattcttcgccagtctgaatatcatgatttggtgttcaaaaggttgaccagcaaatcatgatatagttttgtgagtgtttcacactcgcaaaacctcacagcttcaaaaaagctaaatacatataaattttattttactatatttttagtttttcttgataaaatcaaattttgtaaatttcgggtagtctgcaaatataaggtaattcggcttaacatcctcttcgatggtcgggattctgtcgctggctttgtagaatctgttatcggtccggtcgtcattagtcgtagaaacttcgaacaggatgacatcgcctgttcccggaactccctgccatgaatgataaaggccaggtgtgatggcgatcgactgaccaggatgaagtgtcacttttccgcctgccgggaccgtgatttccctgccatcaacttttgttgtgacaggggtatcgagaaacgtgcctcttttgaattctcttgctgcctgaacatcggcaaaatcctttggatcagaattatagagtgttacatccagatctccgccgcctctgttgattatatcctcacgcttcgaccagtggtaatggaacggcagtgtctgtccatccattacaaaatcaagtttttcgcagtatggctttggatatttttccttcgcataaaaattaccgttcctgaatgtgaagatcgtcagcccgacttttttgaaatctcctccgaagtcactgatgtcccagccgagcatattttcaacgatctctatctcagattcgtccagatttttccaatcctcggttgaataatacgcaaatggcggcaacggaaactgatactccttcaatttgtccatcgtgtactgaatgatactgttgatttgtgaccttttcatctataacacctccatttttactttccctcttctattgtactactataaaagccaaaatgagcgaaaaaatcagtatatcattctccgaatctccgaaagcacctggccacttgaagcgtccggcatctttccaccattgtaagccataaattttatccttttataagtagacggcactctgcgttatctgcggtatgtcaagcgcggcataccgcaggccggacggagtgtatgtaattctgataaccttgcttaagaactgaaaattcccgcggctcatcaggatacgaaatacttgactatgacccgatgtctcttgtctgctgggctcatgaccgtaagctgccgattcacgccatctaagaagccgctgccatctgaagagtccattggccggctttcatgtatgatcatccatttgttactgatgtataaaattttacctgctatgccatagcctctttcaaactggaacaaagtattagtttttcctgtcttcagattatatgtcttcaaatttactatcttagtgtcagatgacgaataatctatttcatcataataaatgattccatctttaaagccattcatatacgctgtctgtctgtcattaagattcaatgtctttaatttcttcttttgaccatttgaaagatctaactggtaaaaattagtggtattactattatatgtttcaacagcatagtaaagttttccagagtcataccaatagtcccaatatgtatcatttttgctggaaatcttatgcgcatttttgtaaccagaatcagccgacaatgagtagattccatctgttccctttgagggggattgttcctcataatatcatgagcacggtcatgatcatcaggacaaatgccagcgtgcggcgtagttttcgtttcatatgagcctccttcggttggaaattttataacctgtgataggtgggacaaaaagaaccgtccctactgacccacttacgcgaggatagcggacacttttttacgaagctcgggcactactgtttcctcgaaccaagggttctttgcctgccagcgaaaattcagaggacttggatgcacgattgggaaatattctgggagatactctttatagctgcggactgtttctgtcaggtttttctttgccctgcccttcagatagtagtcgatgctgtatttcccgatcaggattgtcatttttatctctggcatcgactcaagaatctgcggatgatattcctcggcgatgaactttctcggtggcagatcgccggtttttccctttccaggataataaaaatccataggcattatcgctatctgactcgaataaaaagtgtccctgcctattcccatccagtccataagcttctcgcctgatttgtcattgaatgggattttcgactcttccacttttctcccgggcgcctgcccgattataagaatccttgcctcactgtttatttgaaaaacaggcggcacatcccgccttgtatagtccgcattccgtggatcagcctttaactttttctcaatttcctgaattgtcataatgtatgcgtctctctgtttcccgtcctgaaaattctgctgggcttttattttatagtcaccggcttaagttttttgacattgagctgcgggatcagtttctctgcctgtttttttgtcaataccttgtccgaaatcaggcctgtgtcggtatacgggcagaattcaaacatccttttatctgacttgtgtatggcatagtaatggtacatcctccaacccactgttccgtatttgtaatcaccatacatgctcctgagcgggtaaccaatttgcttaccgatgtatacaagctcatttggtgacgtaaatgagtcatagaccatttttacaaagccaggagttgtgctttcctttaacgtgataatatatgaaatttctccatcataatccttgtttttgaagcagctgttatatctcgtatgctgacacaggtaattgcagaccgcatccattttgtcgcctggatcttttttctggttcgctccgctctttttaagaatgtctttgacccaggccttgtgggcggcttcggtatcctcaagttttatggttccgagtgtcattttacccgttggatagttattgtttatttcagaaatttttacagtaatatttcctaccgggtattttttcgttttcagattttggaactggtgcactgtcaaatagccaccgggaactttttcaacattactcgtccagtatgctccattttttacatctgagtatgatgaacattctgcccatccactcacatcatttccctttttatcgtaaaaactgatttgaaagttggagtttttcctgttcgttttgatataaagagctgtaccacaccccgagtacatcttatcagaaattcccgtatagaggcggtagccgtatttcagagctttgcaatgatacagcccgtccttcccaagtttaggagtaagcgggcctgacttcctgactgttttcttcgctgactttttaacttttaccttcttggtagagctgtattttcctgaatttttgccgttcactgctttcacacgaaggtaaacggtgctgtttgactttgcgctgaaagtcagagccagttttttggaagaaacagtcctgcccttcgctttctggaatttattgttataagcgtactggacataatatttcccggcgttcctgactttcttccattttacagttatctggccagccttaagagactttgcataggtgacatttaccctgccaggcttgactgatttctttttcgatgatgatttcttcttcgcggcctgcgccgtgacatttgctgagagtgtaacccctgaagccgctgtaaatatcatcgcagccgtaagaagactgcaaataaatctggtgaaaattgttttcctcatggtgtttcctccttttcgcaccatcttcctggtgatttaagaccttaatatcatattaatacaaagagtggccttttgcaatgcagacatttgctttcgcaatatacgccaatacccgataaaaatcctgcagttttgcagctcctcggttttacttgaattcaagatagagcctgtcagggttgaaattatacaatggccttactctagttttaatatagcgcagggaggaagttaaattcttaaacggcattctgccattttctatatgagtgagatacttcttaaaaatcttacacagcatatttctggctgtcaatatgcatccaatgctcctgggttttctacagagcattgatgatttcaagctccgcgtacaactatattgaaaacgcaggagtcattgatgtagatttcttgctccgcggaggactctattgagaaatggctttcggaaaaaaaccagagccggtacaaaaaaagctggaattagaagaatcagcgacacagaatggcacgggctcgcgaccttaggatttttcgtagagagcggcggttcgccgtttccgctctgacttcgtccttcggactcgtcaatcgcggacggctatcgcatgggcggtttataatgctctcgcttcgtccttcggactcgcgacagcataacaaccgctccatgcgcgctagctgcggcccgggttgccacccgcctggaccataaacgtatgtaaaccatacattggcaagagggccgcaattaggcgcgcgcacgcgaacagaaaaatcctaccgagcgagaccgtccatctgtggcgctgcttcggacaaaagaaaagcatattatgtctgaataatctaaaaatgggacaaaaagagcggttcgccgtttccgctctgacttcgtccttcggactcgtcagtcgcggacggctatcgcatgggcggtttataatactctcgcttcgtccttcggactcgcgacagcataacaaccactccaaccgtccccactgtccctagagttcgtggatgaagagaccgctgcggagcttcggctcgaaccaggtcgactttggcggcatcagtttgccggcgtcggcgacggcgaagagctccgagatcgaggtcggatacatcgcgaatgcgacgctgcagtcttcgtggcagcgacgctcgagttcttttaagccacgaataccaccgacaaaatcgatgcgagggtctgtcttcggatccttgatgccaaagacaggctcaaggatcaggttctgcaggagtgagacatcgaggcctttgatcgggtcctcacttctaagctcctgcctgaatgagaaattgtaccaggtattgtcaaggtacatactaaaagagcccttgaactgcggctttatcggagctctgccctggcggtgaagctctgcgacatcttttacatcggagaggatatcaaagaaatcgtggccgttcatgtctttcaatactctgttgtagtcgaagattttaagctcgtcgtctgggaacaggaccgagaggaagtagttgaactcctcgtctcctgtgtaacccggatgctcggcgcggcgcttcaggccaacttttacagcagatgctgctctgtgatggccgtcagcaatataaatcgaatcaatgccctcgaaagccctgcggatgatctcgatatcttcaggctcgcttacgatccagactctgtgtgaaatatggtcgagtgtcgtaaaatcgtaaatcggcttctgatccttgtaacgtctgactacatcttctattgaattatttctcctgtaggccaggaaaataggtcccgtctgtgcattgcaggcgtcgacatgattaatacgatcctgctccttttcggcgcgggtagtctcgtgcttcttgatcacgccattttcgtagtcgtcgatcgaagcacaggctacgattccagtctgggcgcggccatccatattttcctcatagatgtagtagtatggagcaccgtccctgacaaaaagcccttcatcaatccattcccagagaaggtcatgcgccttctggtaaaccctcggatcgtattcactcacttcaggcggaaataatgcatcggctctgtctactgcaagaaaggagtgcgggaaccttttgacatgagatgtcgcctccgctctgttgtatatatcgtatggcagcgcagcgatggtctgcgccatatcaacccgcggacgaatcgctgcaaaaggtcttactgttgccatttaaaaagctcccttccattttttaaaaggaaaattatctgactaccctgacgcggataacatccggaatcgagttgagtttcgcaactacgtcagctgtcacctctgaatctgtatcgatgagagaatatgcgtaatcgccacggctcttgtttgtcaggtctgatacgttgatatttgcatcgcctaaaatagtcgtgtactttgcgataagtccgctcttgttgtagtggaggactgcaagtctgcccttcgatgtgacaggacccatatcgcagtctggataatttaccgagtggcggatgttgccgttctcgaggtaatccataatctcatctactgccatcatcgcgcagttctcttcagcctctgctgtcgaagctccgagatgggatgtggcgatgactcccggctgtcctgctgtagcaggattcgggaaatctgtcatgtagtgctttatcttgccaagcttgatgccgtcgaggactgccttctcatcgaccagaaggtctcttgcatagtttaaaataacgacaccctgcttcatcttcgaaacagcgtctgcattgatcatgcccttcgtcgaatcgagaagcggcacatgtatcgtgataaaatcgcactctctgtagatgtcatctacatttgcgatgtgctttacatttcgtgaaaggttccaggctgcgtttaccgagatgtacgggtcatatccgagtacatccattccgagatgtgtagctgtgttagcgactctctgtccaatggcgcccaggccgatgactccgagcttcttgccagcgagctctcttccagcaaactgcttcttggctttctccatatcctttgaaatatcggcgtcgtccttattttcattgacccagtttaccgatcctaaaatgtcacggctcgcaaggagcattcccgtaaatacgagctcctttacggcgttggcattggcgcctggagtattgaaaactacgatgcccttgtctgcgcacttgtccagagggatgttgtttactccggctccggctctggcgatacatgagagcttgtcagaaaactccatatcgtgaagcttggcacttcttacgatgaaagcgtctgcgtcattcgcgtcatctgtctgctcgtaattatttgaaaatttgacgagtccctttggggaaattgcgttaagtgtatggtatttgaacatttttcttcttcctttttgtaaaaattacttgagattcttcttctcgaagtcttccataaatgtgacgagcttctcaactccagcctttggcatggcgttgtagatagatgctctcataccgccaactgtgcggtgtccctttaagttctcgaggcctgctgccttggattcagctacgaacttagcgtctaaatccttgtcgcctgtaacgaatggaacgttcatatttgaacggctcttcttatctgtaactgtaggcttgaaaagcttggactgatcgaggtagtcatagagtatctttgccttatcggcatttttcttagcgatgccctcaagtccgccgttcttcagcagccacttgaatacgagaccgcacatatagatgccccagcagttaggtgtattgaaaagagaatccttgtctgcctgtgtcttccacataagcatagtcggtgtattcggatatacgtcatctgtgatcaggtcgtcgcggatgatagagatagcgaggcctgcaggtccgatgttcttctgaacgccgccgtacataactgcatatttggtgacatccataggtcttgataagaagtcacttgaaacatcggctacgaggtcaactcccttggtattcggaagttcccagtactcagttccataaatagtgttgttctggcagatgtagacatagtccatatcatctgtgataggaagatctgagcaatccgggatatatgtgtaatttttatccttggaagatgcaagctccactacttcaccgtacttcgaagcttccttgtaagcctttgtagcccactgtcctgtagtgatgtagcctgccttgtggtgcttgttcatcatgttcataggaactgctgaaaactgtgtccaggcgccaccctgaaggaaaagcaccttatagttgtctggtattgacagaagagtcctgatgtccttttctgcttccacgattatatcattgaacatggatgatcgatgtgacatctccattactgacatgccgcagcccttataatctagcagatctgcctgtgcttcttttaatacttcctccggcaatacggccggtcctgcagaaaagttgtaaactcttgacattacatcgtcctcctgtaattaatatagtttgaaaagattatcagccagcggcattcactgccaatgtctgacaactatttttactactatagcttttttcaattaataaatcaacccttcatatcggtatcatcatagctttcggatattgaagttccaggcgataccatagggaataccttgtcatccttgtctattactgtatctatcagtacaggcgtatcaatatccatcgcagcctttaacgctgcatcaaattcctctttggtcgtggccctgaggccttttgcacccatcgcctccgcgagcttgacgtagtcgacacagctgtcgagcacggtgttcgaatatctcttaccgtagaaaagattctgccactggcggacattcccgagaactccattgtctatgacaatttctactacaggcagtttgtttctaactgccgtgactatttcgttcatattcatacggaaggagccatcgccggcaatattgaaaactttcctgccaggatttccgatcgcggttccgatggctgctccgaggccgtatcccatggtgccgaggcctcctgaagtgatcagctgtcccggtctcttgaagagatagtactgggctgtccacatctggtgctgtccgacttctgttgtaataaaggcgtctccatcggtagctttgtagatctgctggatagcataaggcgctgtgagcctgccgtgcggatagtggagcggatatttttcacagagatctctcatgtgctccatccactcgtggtgatccatctgcgaaagcttcggtatcaggcggctcaaaacctcctttacatctccatcgatctcagcgtctgcgatgatatttttatttatctcgacaggatcgacgtcgatctggagtaccttcgcctgctttgcaaatgtcttcggatttccgagtatcctgtctgaaaatctggtaccgattgcgataagcagatcgcaggatgagacaccgagattcgaagccttggtcccgtgcattccgagcattccggtgtatctgtctccggttcccggataagtgccctttcccataagagtgtcgcaaaccggcgcatctacgatgtctgcaaattttctgacttcctcagaagccctcgagattactgctccgccgcctacgaagatataaggctttttggatttttcgatcatcgcgactgctctgtcgatgtcttcttccctgagcttatcgatctttctcttgatcggagccggctccacaaattcatactctgcctgagctcctgtgacatcctttggtatatcgataaggacagggcccggacgtccggtctttgcaatcttaaaagctcttctgatagtaggtgcgagcttctcgacatcttttacgataaaattgtgctttgtaataggtgtggtgattccggcgatatccacctcctggaacgagtccttgccgaggagaggcaccgtaacattgcaggtgatggccaccatcggtacggaatccatataggctgtggctatccctgtaaccagattcgtagctccaggtcctgacgtcgccatgcagacaccgacttttccagtgcttctggcatagccgtctgccgcgtgcgccgcaccctgctcgtggctcgtaagtatatggcggatcttgtcgctgtttttatagagctcatcatatacatttaaaatagctccgcctgggtagccgaatactgtatctactttctgctccaggaggcactctataacgatctgtgcacctgtaagtttcatttatctgcctctttctctcccggaacttccaggattgctccgcggtttcctgatgtgacgagtgctgcatagcgcttcagatatcctgtagtaacctttggcttgcgtggcttccaggctgcctttctctttgcgagctcctcgtctgatacttcaagagttatcgtcatgttcgggatatcgatcgtaatagtatctccctcttctacgagtgcgatcgggccgccgactgctgcctcaggtgaaacgtggccgatagatgctccacggcttgcgcctgagaaacgtccgtctgtaatgagcgctactgatgagccgagtcccattcctgtgatagcggacgtagggttaagcatttctctcattcccggaccgcccttaggtccctcatatctgatgacaacaacatctcccggaacaatatctccgccctttatggctttgatggcatcctcttcgcagtcgaagactctggccggtcctgtgtgcttcatcatctcaggtgcaactgcggaacgttttacaactgagccatccggcgcaagattacctttaagtactgcgagtccgccgttctccatatatgggtggtcgataggacggatgacctccggattcctgttgactgcgttcttgatattttctccgatagtctttcctgtaactgtcatgcagtcgaggtttaaaagtcctgcgtcgccgagttccttcatgactgcatagacaccgccggcttcattcaagtcctcgatatatgtaggacctgccggtgccaggtggcagaggtttggtgtcctctctgaaatcgggtttgcgtagctgatatcgaaatcaaatccgacctcgtgagctatggctggaagatgcagcatcgtgtttgtcgaacatccaagtgccatatctactgtcagggcgtttatgatagattcctttgtgatgatgtcgcgtgggcggatattttttctaagcatatccattacagcgtagccggcctgctttgcaaggcgaagtctggccgagtaaactgccgggatcgttccatttccgcgaagtcccattccgatggcctctgtcagacagttcatcgagtttgcggtgtacattccggaacagctgccacaggtcgggcagacattttcctcgtagatgcggacttcctcatccgtcatcttgcctgctgcattcgcaccgactgcctcaaacatcgatgagagggatctctttctgccctcaacgtgtcctgcgagcatcggaccgcctgatacgaaaactgtcggaacattaatcctggctgctgccatcaaaagtcccgggacatttttatcacagttcgggatcatgatcagagcgtcaaactgatgcgcgatcgccatacactctgtcgaatctgcgatcaggtcacgtgtcactagagaatatttcattccgacatgtcccatcgcaattccatcgcagactgctattgccgggaaaactaccggatttccgcctgcttctgcgactccgagctttgctgcctctgcgatcttgtcgatgttcatgtggcccggtactatctcattgtatgagcttacaatgccgacgagcggcttatttatctcttccttcgtaaatccaagtgcattcagaaggctcctggccggtgcctgctgcataccgcgcttcatgttatcactctgcatacttttcttcctttctctataaaaatataaaaataatttctaaaaatcgttgtgctggtaaacaatactataatctatttgtgaaataaattcaagtaggtattaaattaaattcattattcacaacgatttgtattatgaaaaaattgtactataattacaagcatgcaaaagagaaaatatgtacccgcaatcactattgcacttatcattattaatttcctgatatatttcgctgaaactgtatctggcggaagccagaactctgacgtggcccttcggttcggcgcttactatctgccctacgtcattgaaaaaggcgaatggtggagactttttacaagcatgttcctccacttcgggatctcccacattgtgaacaacatgatctcgctctatgtcctcggaaatattgtcgaggcctattacggaaagatccgctttctgattctttacctggtcgccggagtcggcggcaacctcatgactctgttcgtagacctccactccagcggtgtcgaatatggacttgaagccggtgccagcggcgcgattttcggtgtcatggcggctttcgtatttttcgcggtaaatcccctgaccagaaaggccttcccgttcaaacgtgtcatcgccggtatcttcttcgctctgcttccgggcttcacttcaagtggcataagcctgaccgcccacatcggaggctttatcaccgggcttgtactctcatttatcctgaacccatacaaacaaagaaaaagactgaactgagcttattggctccgcggagccggaaattttcactctggcttccagtagtctggttttgctgcaaatcgtataaactagcagctccgcggagctggaaattttcaccatagttttctgcaagatgtatttgttacaagtcaaaaagacttctagctccgcaatccggtagattatcactatagctcgtttttatggaagtttatctcattcagttttcacaggagatcaggcaaaaagtcatttgtaacaaataatttttcgcattttctctatacgctagagtaggtttgattcgttacaaatccaaattttttattttcacaatacatctaaatcattccggattgttccaaagccgtgttgcaaattaacgtcgtaagagcttctagtgataaaacactatttttttaatgtggtgtcaattttgacgtttggattgaactgattccgtgacagcatatagtgaaaattctcgccataaaaccaacatctgacaggtacacttctaaaaacttcaccccgtcagtatctatattgaaaaattcctcacaaattggcaacaaaaaggcgctcccaacgggagcgccttaataattacaaagctaaacgtgtacaagtgcaaaagcaaagaatcagatcctgtctgctaccgcctgtcccatggctttgcagcccacgattgtcatcttatctgcgccctcgcgagggagaatgtcccgggttctgatgccatcctccaaaaccttcgtaaccgcattctcgactgcatctgcctcatcatcaaggtcaaggctgtagcgcaggagcatcgctgccgagaggatagtggcaatagggtttgcgatgtcctgacctgcgatatccggagctgaaccgccgctcggctcgtagagaccgaactttgtctcgtttaagctggcagatgagagcatgcctagtgaaccggtgatcatagctgcctcatcagataaaatatctccgaacatgttctctgtcaaaatcacatcgaactgtgccgggtcgcggacaagctgcatagcgcagttgtcgacgagcatgtgctcaagctcgacatccgggtaatcggcccagacctcttcgaccacttttctccagagtctcgaagaatcgaggacgttcgccttgtcaactgaggtgaccttctttcttctcttgcgggcgatatcgaaggcctttacagctacacggcggatctcgttctcattgtaagtcagtgtatcggtagcctgaagaacgccattatatgactcggtatgccgctttccgaaatagagaccaccggtcagctcacgcaccatgataaggtcaaaacctttgtcggctgtagcctccttcagaggacacgattccttcagctgtgggtaaaggtaagccgggcgcagatttgcaaaaagcccgagagatttgcgaagcttcagaagtcctgcctcaggtctcttgtcaggcgggagcttgtaccacggtgaagtcgaggtgttgccaccgatgcttcccataagcactgcgtcctgagccttagcggatgctatggcatcatctgtgagcggctcgccagtcgcatcgatcgaacagcctcccatcaggatgtctgtcctctcgaaatgatgtccaaacttctgtgcaactttcgtcataacagtccatgctgcatctgttatctccgggccgataccgtcacccgcgataactccaatcttgtaatccatttttctccttttccaaaaaagcaaaaaattttaaaaaatcagccgatctctgcgatcagctgatgctttttccaaacaatcgatcaatgccccagaccattcaaaaggccagtcaatgatcatagcagtacaaagctccgacctttcaacgatcaaagcagtgcaaaaactctgaccattcaacgatcaaagtgatgcgagcactcctaccgcatcattctcacgtatgacatcgccgtgctcccttaagagaccgaggatgttcccgtgattctcaatacgaccggaatactcagagatggcgaataccgtattcgcaagagtcttcttcgtatccgtgagctcgatagtcagataatatctgtcgtccatccggtacagattcgaagcggcgctccggtcctctgcactgatatgatggcaaagagagatagcatcctccaagttatcaaatgacagtgcgaccgggaacagtaccggtgaatcgctgtctgtggccgcaagtctctccttgacctggtcttcggtcagaagagtgatgttctgcctgccagaaaaacgcggggcaatggtatcgatctcgacaccaacgtttggatccttcttctccggcttctcttcagtctgcttctcttcggcctgcttctcctcctgctgttcgaccatctgagcaatatccttgtatttctcgataatagacttcacagcggccttcctgtctgaaaagattctgatagtgacagaaccatcagccaggccgaccatctgaacattaatctgagaattatcatccgggaagtccacagtctccctggcttcctctatgacttcgtcgaggagttttctagcctgggcctggtcgtgcagcagatcttcaatgttgtcaaaaccacgagccgatagttcttccttagaaaccctgcaagtgatcgaatgcttgtcttccttctttatcagcatgaaaaatcctccttcccgctccatacagttccctcatcgtatatctatttaaaacataatagcacacttgaaaaatatctacaaccgtttttcgttccttcatataaaaaatgcttgacacaacaaaatcattatagtaaactattcaagtcggcagaaagccgcaggctggcgtggcacagttggtagcgcacctcattggtagtgaggaggtcaccggtccgattccggtcgctagctttacgcgtattaattgagcggtgcaaatggaaagagccattatggctgcaagcttgcttgcacagccattgatggctcttttcatttatagcgcgaaagcgcgaatgagcaggcacgacagtgcctgcgaattgcaccgctcaattatacagagagcgaacgcgcgaatgagcagacacgttagtgtctgcgaattacccctctctctgagatgagcaccgcgcgaatgagcagacacggcagtgtctgcgaattgcaccgctcaatcatgcagacacacttttattttttaaggaaaaaaaatgaagaaaacaccgtttgctacaaaggagaaactagaagaaattgccgcaaagtatccgacaccttttcatatttacaatgagaagggaatccgcgagaatgcgcagaaagtaaaggacgccttctcctggaataaaggattccgcgagtattttgccgtcaaggctactccgaatcctttccttatggatatcctccatgagtacggatgcggtgccgactgttcatcgatcacggagctgatgctctccgacgcagtcgggctcaaaggtcacgagatcatgttctcgtcgaatgacacacctgatgtggagtttaagaaggccgcagagcttggtgccattatcaatctcgatgacatcactcatattgatgcctgccttcgtgctttaggcggcagtcttcctgagaccatgtgctgccgttacaatccgggcggtgtctatacactttcgaatggcatcatggacaaccctggagatgcgaagtacggcatgactcacgaccagatccttgaagcttacaagcgactgaaggatctcggcgtcaggcatttcggtctccacgctttcctcgttagtaatacggttacgaacgactattacccgacactttcgaagactctgtttgatctcgctgttgagataaaagagaaggtcggtatttcactcgatttcataaatctctcgggtggtgttggaattgactataagcctgaggacacgccgaatgacatcacgatcatcggtgagaaggtccacgaagtctacgacgaagtcttagttcctgcgggacttggagacgtagcgctctatactgagatgggacgtttcatgacaggcccttacggagccctggtcacaagagttcttcacgagaagaagacatataaggattacatcggagtcgacgcctgcgccgcaaacctgatgcgccctgctatgtacggtgcttaccaccacattacagtcatgggcaaagaggacgaggcctgcgatcacacttacgacgttaccggttctctctgtgagaacaatgataaatttgctatcgaccgtaagcttccgaagattgagattggcgatctgctctttattcacgatacaggtgctcacggattctcgatgggttacaattacaatggccgtctctggagttcagagatcctgctccatccggacggaaccttcgacatgataagacgtgctgaggagccgaaggactacttcgctactttcgactgcttccctatctggaagaagctcgagaaagagtggcagtaattacattataaaaaagccggaattttttccggcacatatatgcaggagtggcggaatggcagacgcgacagactcaaaatctgttatgggcgaccatgtgtgggttcgagccccatctcctgtactaatgaaaaaaagcagctgcagatgaaattcatctgcagctgctttttattgcgtctctactcttttcagttgtaatatctgcgaaatttatttacgtacttctgggctgatgccgtgagctgattgccgttacggcggatagctccgcctccgacagcgtaagcgccaatggccagatcgagattgccattgaatgacttcaggttatcagagataaggtgtgccccggccatgatattctgttccgggtcgtaagcattagtaacaccataagcccgcgcagtggccggcatcagctgcatgatgcccatagctccggcgctcgatgtcgcattactctggaagcggctctcgttgtaccctactgtctcaagaatcttctcatcgactccatacttctgagctgctctctgatagatgctcttaagcgacgacggaactgtaaaaccaagtccggtatcgactgaggctgactgatcagcgcctgaagctgactgcgcagtagtgccgttaattgtcgaagcattggaagcgttctgcgcggaacagccccttatcgccgagccgtaggaaacgttctgcgtcttgtaatttccctgctctgccattttttcagcgagaatctgctgaaattcctgcagtgatggggcatccttcgtaagtgactgtgtcctggcggccttagtcgtctcagatgaagtcttctgaagttcgctcgaatatttgtatcctggtgatgtgatagtaataaccattatgaatcgtcctcagcactcactgagtatcctgtgttagtataaataatgctgtagtagtcgcgtaaatctgcgtcttttatggtcaaaagcctgacctcggcgtcctggtctttgatatgtgtatctcgaacagtaaggatcaccccgccggctgcggcgatagaagcgcaaagaattacgcagagcagaaacagcgatttaaaaaagccgaggtgcttctttttcccaggcttcttcgccttagcttcggacttcttagtctctgcagctgccttcgtataagaagcatttgccttggtatcagaacttccggcttctttcgatgcatcggcactaccggtctttccctgctcatcagcacctgctgtctgttttcccgaagcttctgtctcagcgccaaccggctgcggcttcttaggagctgtggcagtgccgagcgtgatcatcttgtagcagtctctgcagaccgggttgtcgccctcgagcggcgaaccacagaggatacaggtgtgttcgtagttctcgcggttgtacatctggcggagacgttcgatatacctttctccgtacactgtcgaaaagagcgctttcggattcagctgcaggaccgcgccaatattgtcacggtcggaataatctattttttgatcaaggaccgctatgactttgagatccttgagtaaagcctgcttatctgtcatgaaaaatttcccttcagattttaattatatcataaacagatatcagaaaaaagttgtttttttctgtcaatcatctcgtcgatacgctcgatgtagttctttatgtctttgacattctcgcagcggcttattatgacaccgccggctccgtcggagcggacctttttcgaagacgcgccggctccgagagctacgatgtcctctctctcctccatgatcatgacattgtagatcccgtcttttccgggcttcgccattccgacattttcaagagagcctgccatatttttctggcgatagagataatacgggtgcattcccatgctcctgccggtctctaatgcctcgtccatgatcccgaccgaatttgtaaaatcaaggtcttcgtatttatcccactcgagcctcagccttgcagctgtttttaccgcgagagagtgcactgtaagattgtccggagaaagctttgaaagctctgtcaaggtgtgtcttatgtcttcggcattctcacccggaaggccgaggatcatatccatatttacacatgaaaaatcagcttcgcgcgcgagctcgtaggcctttatgatatcttccacagtgtgctttcttccgatcaggtcgagtgtcttctgattcattgtctgtgggtttaccgaaatcctcgtgacgccgtgagctttcattactcgaagcttctcaggcgttatcgaatccgggcggccggcttctacagtgtactctgcgagatgcgagaggtcgagctttttttcaatataagaaaaaaggtcatcgagctcggattcagtcagcgtcgtcggagtgcctccgccgaagtagatgcagtcgaggcgcctgtttttaaagcactctgagacgaagtcgatctcttttttgagggaggcgatatagcccggaacaagcgaatggtacgcgtctatctggtgcgaagaaaacgagcagtacaggcagatcgacgggcagaaaagtatcccgatgtagatgctgtagccattggtctccagattatagtcctgatggccttcaaagctgtctgtcttaggaaaacgcgataggatctgcttctcggcctgtgctatttctatgctttctgatattttttcttcggaggtaaagtacttcttcctgtaaaaaccgcggatctcgtccggatcttttccttcgagcgtcatcaccagagcttccttcgtcggacggattccggtagttgaaccccacggcagggcgcggcctgtggcagaggatacgatgctgtagagagtccgcttcacggcatttttttcagcggggcaggatgcctgctgccgctctccgctgatctctatctccatggaggctgtctcatccgaaaaatcgagtgtcagcacagcagatggttttactgaagccctctcctgtttttcttcggtgctctcacggcctaagagctttccctcgcaaaataccagaagcctgctcttcggaaaaaaagaccggtacagcggaccggtctcattgtcaaaaaatcgtttattttctcttagttctatcagttcacgcatagggattatttatcttctcaaaagctatcgtggtgtttgaatcgtgccccggatatacagtggtatcctccggaagcgtcaggagcttctcttttatcgagtggacctcgtcagaaaacgagcctcccttgaaatctgtccgccctgcgctctcgcagaacagcgtatctcccgggaacaaaagcttcaggtccgggaaatagtaagaacagcctcccggtgtgtgtcccggagtccagatcactttgaacttaaagccggctatggtcttttcttctccatctttaaaagtgtctgtgataagacctgaaaaatccttcgcctcatagctcatgacagccgagagatttagctcagggtcccttaacgtatccatctcctgctcaagtatgtagaccggaagggagtcgtaatgtgaacagaggtcttcgactccgctcacatggtcaaagtgcccgtgagtcagaagcaccgccaccggagtcacctgatttttcttaagttcagctgcaatgctgtcgcccgaagcacccgggtctataacgatgccctgattcttatcggatactaatgtgtaacaattagtctgtatcggtcctacgacatagtgtaataatttcatcggccacttgctctctgtatatctataatcgactctatctgccttatcttgctgcagatgtcatcaagctctgaacggttctttacaaggaatgaaagatctatcgtagcgatgccctgcttgctggtcttcgagtggatcgaccggatatcgatctccctctcggtaaatatctttgtgatatccacgagaagtcctgtcctgttatgtccatatatatggatctctgcaagaaagctttccttctccttcttgtcttcaaggagctcaggctgccactccgcctcgatcagacggctcttgtcagattcaggcatatttataatattgatgcagtccgttctgtggatagagacgccgcggcctctcgtaacgaagcctacgatctcatcccccggtacagggttgcagcatttcgaaaaacgaactgaggcatcgtagagtccatttacaatgataccgctcttcgacttctttttctttactttctcttcgacctgaggatgttcatgatctacaggagcatccggattgtgagcctcgagaatatcctcatctgtcagtgtcagaggatggtctttcttatagccgtcctccatcttgtttatgacagctccctctttaaggcttccctgcccaatggacgcgagcactgaattccagtcgtggaatccgtagcgtcttaagactctctcctggtacttaggcttatttataaccgaaagctcaatgcccttgctcttcgcattctcgactaaaagctcctggcccttctggatgttctcatccttcgtgatcgagcggaaccactggttgatcttgctcttggcctgggcgctctttacgatgtttaaccagtcacggctcgggccgcgtgagttctgggatgtgatgatatcaattcggtcgccgttctttatcttgtaatctatcgggacaagcttgccgttgaccttcgctccgaccatcttgtttcctactgcagagtgaatgttgtaggcgaaatctatcggcgtagatcccgcaggcaggttctttacatcgcctctcggcgtaaagcagaataccgtatctgaaaaaaggttcagatcatttttcaaaagggagacgaattcgcggttgtcggacatgtccctctgccactcgaggatctggcgaagccacgaaagcttggcctcctcacggttaatagtggctccttcgccgctctccttatatttccaatgagccgcgataccatactctgatgtgcggtgcatctcccaggtgcggatctggatctcaaaaggcgtaccgttcggtccgataagcgtcgtgtggagcgactggtacatattcggcttcggcatcgctatatagtccttgaatctgcccgggattggcttgtaattctcgtggatgactccaagcgctgcatagcagtccttcacattatcgactatgatcctgatagcaaacaggtcgtagatctggtccagtgtcttgtgctggtttaccatcttcttgtagatactgaaaaagtgcttcgcacgcccctctactgtcgctgtgatgtctgcgtcgcttatgtacttcttcacgtcgtttacaaggcgctgtacatatgcgtccctctcagactttctctgcgctatctgctcgaccagatcgtaataggcttcaggctcgagatacttgagcgagaggtcgtcgagttcgatctttatcctgctgataccgaggcgctgtgcgagaggcgaatatatctcgatggtctctctggccttttccttctgcttagcaggcgtcatgtattttagggtgcgcatgttgtggagacggtcagcgagctttattataatgactctgatgtccttcgccatggcgaggaacatttttctcaggttctcagcctgaacttctaccttgtccgcgtcgagtggcacctgaccgagctttgtaacgccatccacgagttccgcgatctcctcgccgaactctgacgcgatctgctcccttgtgacatccgtatcctctactacatcgtgcagaaggcccgctgcgatactctccttgtccatctcaaggtcagctaagatcgtagctaccgagagcgggtgaatgatatacggctcaccggactttctcttctggtccttgtgagcctcttttgcaagcttgtaagccttctcaattatcgagatatcgccgttcggatggtattttctgaccttgtctataagctccttatagagatcctccgggttctcgaaatcgtgagtggccactatgcttcgatttggcttcgatatcttttcttcgagtttttcaaaatctttcgacgtcacatctgatatatccgccataatgtccactcctttctttttggtaaatataaattatgatctggtggtcaaaagtctgaccccaaaatcataatatatattcagttaaaaatcaatttaatcacgcgattcgatgacgagcaggtcacccttctccacaaagaaagcggctttgtcctcagtaatctcattgcttatagtcagagtaaaatagccatcctctccgcctatgtccttaccatccagcgggtaaaatactccggtcgcgctgacaccctggcattcgccaaaaagcggaaaaagcgagatgtatttgccgtactggtctttttttgcgagagtaaacttctctccgccgcttatcatgcggatcctgtttgtcctgtcgtagatcacggcatttttgccgtttctcttcgccttcttgaggagggtcaggttgccaaggatatggtcgactctcgagccggtggctccgagaatatttatcgtgtcacagttaatcctcattgcgatgtcgagcgcagcctcgagatctgtatcgtccttaatcggattcagttcaatgatcctgatgccgctccgtgcgaactcgtctaacagttctttagtgcctgctgagacagaatcgaaatcacccaccgccagatccggccttatatgaagaaggcggcagtagtctaaacccctgtccgccgctatgatatatgctttttcacgtctgatcactctgatggcggtctcagtgtcgacacttccgccgccaatgataactacctgcattctattcctccagaatatttaaaaactgggtagcattttcctccaggtccccgctgaaaagagcatgccctgtaaccaggatatttgctcctgcatctaagagcattccggcattctcggtattaacaccgccgtccacttctatatcaaaagagttctttgactcatcgcttaacttcttaagctcgcggatcttatccacagtgtaaggtatcagcttctgtccaccgagtcccggatttactgtcataacgagcaccatgtcgagctgatctaaaacgcagcttaaagccgagacaggtgtcgccgggttgatagcgaccgacgccatggctccgtcctgctttattcgctgtattaccgcatcgagatgcttacaggcctcatagtgcaccgaaatgatgtcggctcccgactctgcgcataagtccacgtatcttatcgggtcatcgaccatcatatggacatcgaccactttttcggtaagagacctgacagccttaaccatcggaaatccgaatgagatgttcggcacaaaggagccatccataatatccacatgaaaatatgcggctccggcattatccaatagcctgacctgatccgaaagtctggtaagatctgatgacaacagtgacggtgacagacagttcatttaaagttcctcctgtttatatcttttagttcatcatagctcctgcaataattctcgtacctgatacggctgatccccccggattcgaccgcgtcttttactgcacaagaaggttcatttatatgtacgcagcttctgaatctgcatccatcctgcaattttacaaattcagggtagtaatccctgagctctgtttcttttatctttggaaggaataccgtcgaaaaccctggcgtatcacagataaaagtatcagacgagagcgccacaagttcggtgtgcctcgtcgtctgccggccccttccggtgtgttcagacaccctggaagtctcgagctcatcctttccggtcagagcgttcagaagtgatgacttccccgcacccgaaggccctgcgacagttgagacatggtgttcgatagtgcctctcagttcgtcgatcccactgccctcgacagtcgaaataaagtgaatctcaaacccgctcccgccatagactctcctgatctcctcctcgtcagaatccgtattcagatccgacttcgaaaagaccagtaccggcgtaagccctgagtgctgcagaacgacaaggtatctgtcgatcagtgagaaattgatatcaggcgtgtggacagatgtcaccagaagtgcaaggtcacagttggcaaccggcggccgcgccatagcagatgaacggggaaggatcttttcgatatttccctccctgtcgtgctcatgcgtgaccacgaactctgcctcgtcgccgaccagaggatggacgttcttctttctgaagactcctctggctttgcaggcatatatgtttccggaggcatagtcaaatacataataaaatccggaaagtgcctttactatcctgcctgtcattactgcgactgctgtgctgtaaatgtcactgcactcgatccaagcttatcggccatggaactgtccacgtagtactcgagcgttccgttctgagtagtaatgtctgttacggatacagtcgtttcctcaccgatagtccatgtcttcagctgcttgccgttcgaatccttgagaactacgaaattctcatcgtaattgtcggtatccatcggtgagatcttctgtgagaagctgtagagctgcggtcctgtggatacgacaaggtttaccctggtaccctttgagactttagatccgcctgcagggtcagaacttataactttgcctttcgcaatagtgctgtcaggctgctgtgtaacgtttccaacagccagacccgcgctggttatcgcgttctgtgcatctgactgtgccttttcctttacataaggaacctgtactgtctcgactcccctgcttacagtaatagtaacggtatcgccctctttggcgtccttgtcagatgaatccggagtctggcttataactttgccacttgccacactgtcactgtagacagtcttcgtctccacatcaaagcccgcgtccttgaggatagatgtggcctctccctgatccttgcctacaaccgaaggaacgtcaatatttcccttacctgtagaaacataaacagaaactgtagttcccggttcaactttctttcccgacttagggtctgtccttatgatgtcgtccttgtctacagtatcagaactctcttctccggctttcgcgaacttaagtccctttgctttcagagcagtcttcgcctgggctattgaatagcccttgaggtcaggaaccactaccgtagttttctcagtcgtggtctttgcctttttcttgctgcttccgaagtggaacacgttgaaaactgatccgacaaaaaatatgatgatagctactatgactatggcagcagctatgcccatgatggttatggccttgtccatccggctgttcaccggtgaatcgtcgtcatccttatcgtccttgtcagtgtcgggaaccctgtctgattcatcgtcatcatttttgaaaaatgaatgcttctttatctcttcctgctcatcatttgaaatgacgcgcgtcttgtcgaagtccgatgcacccggctgggggataacgacaaagtcctcgttcggatttaccatggccttcttcaggtcgacaagcagttcacttgctgaagcgtaacgcctctcagggctcttcatcgtacacttctctatgattcggcttatggcgataggaagccccgggaccagatcctccggaggagtcatctgggactgaatgtgctgaatggctatggcgaccggtgtatctccgtcaaacggtaccctgccggtgaccatctcgtacatgactatacccatcgagtaaatatcagaagcataggacacgtaaccatttctcgcctgctcaggggatacatagtgtaccgatcccatagagcctgcacggatggtatttgagttggcagctcttgcgatgccaaaatcagtgacctttaccttgccctcttttgaaataataatgttctgaggcttgatgtcctgatgaactatgccatggttgtgagccgcttcaaggcccctggccatctggatagcgatcgagagcgcctcgttgtatcctagcctgcccttcgtggcaatatatctcttcagagtgataccgtccacatactccattacaatgtaatagagtccatcctcgctgccgacatcgtaaatatttacaatgttcgggtgctcaagcgatgctgctgcctgggcctctgtgcggaatctggtgacgaatgacgaatcctccgcaaactccggcttcagcacctttatagcaacgtcacgtccaagggaatgatcctttgccctgtagacatcgctcattccgcctgatccgattttttcaattatctcatatctgtttcccagaaaagtttcattattcagcataggttattcgcctttcttcggatcgataacgacgatcgtgatgttgtcttttccgcctgcctcgagtgccttatcgagcagagacttcgcctgctgcttcggttcaatatcttctgaaagcacagaactgatgtcatcatctgaaaccatgtttgtaagtccgtcagtacacataagtaccctgtcaacgtcgtcgagcggaatactgaaaaaatcagtgtgtaccatagattcggctcctacagccctggttatcctgcttttatacttgtgatgcttcgcagcttcctctgtgatctcgccgtttctgaccatctcctgtacatacgaatggtcgagcgttatctgatagaggtttttacctctctgaacatagagtctgctgtcgccaatattcgacacatagagcaccccgtcaaggaatgtagctgtgaccatagtcgttcccattccaatcttctcagggtcgcttctcgctttctcaaacaactgccagtttgtctctgagatgacatctctcatcacctcaacgactccatccgggcgcacagaatcctcttcctcgtttcgaagcagctccacaaccttcttcactgcaaactcggatgcgtagtctccggcgttctctccgcccatgccatcggctatgacaaaaagattgcccaatggccctacgctcttgtctgatacgaatgcgaaatcctcattcgtcgcccttactttgcctttgtctgtaagacagtaaaaattcataaaatagtgttacctttccagatgacgtctcctgagctgtccgcaggcgccgtctatatcctgtcccatttctcttcttatagtagcatttattccgaatttttcaagttttctctgaaaatccatggccgccgccctcgtgggagcggcaaaacttctctcttttaccggatttaccggtatcagattcatatgtgctcccctccagagcagctctgaaagctcctctgcgtcctcgtctgtgtcatttactccctttatcagcgagtactcgaacgtgactctcctgccagtcttctcctgatacgatttcatcgcatctactgcctcgtggatatcgtatctgttcgcgataggcataagcttctttcgcttctcctgcgtcggagcgtgaagagacagagcgagcgttatctcaagcttcttctcagccagttcatttatcttcgggactatgccgcaggtcgaaaccgtcagatttctctgcgacagatgcaggccgttctcatcagtcagaagcctgataaatgacagcaggttgtcgtagttgtcaagcggctcgccggtccccataacgacaacatggcttatcctgttccttaaatactcttcgctgtccggcttcggaactgcccctgccgtctcattgaaaatatctctctgtatcgcctctatctgtcctagcatctctcccggcgtaaggccacgcgccagaccgttcatgcccgaagcgcagaacgcgcagcccatccggcatccgacctgcgacgaaatacagaccgaaagtccgtatttgtatctcataagcaccgtctcaacgaggctgtcgtccggcagacgaaaaagatatttccttgtcccgtcctctttcgagatctgaacttccaccttctcaggcgcagtgatatacgcctgatttgaaagcctggtcctgagggccttcgggatatcagtcatctcctcaaagctctccgataagctctggtgcagccacttgtaaatctgcttcgccctgaatggcttctcgccaagtgacgcagcataattcttcaattcatctatgtttctgctggaaatatcttccatatcttctcttcctgggtcactagggacggttcttttcgtcccattttctgaaagttctgacaaatctgcttatgcctgttttttccggattatactatagaagaaaccgtcatgctccgcgtctggaattatcgttagctgcttctgtataaaaaattccggatgggcgctgataaacgcatctgtctgctcttcattctctgccggatcgagggtgcaggtcgagtagataagctttccacctggttttacatatctggcagcattttctaatatttttctctgaatagcggcgagctctgcaaaatcgctctgaagaagtctgagacggatctccggcttcctgccgcttaccccgagtcccgaacacgggcagtccgctatgacacagtcataggaagtttcccactcggcgcggaattccgtggcatcatttacagttgcagatattctgtcattcaagccgagccggcttatattttcttctatacgttctgtcttctgccgggaaacgtcgcaggaagtgacccgggcgccatagagccatgccgcgcagaccgacttgccgccgggtgaagcgcagaggtcgagaactgatgcgccagactcgagaccggcgttgagcagtggctgcatcgaggatcggtccattatataaaaaatgccgtctttaaaagcggaaagcgaagccggattcgtaccagacttaaaagtcagctcgaaaagtcctcccggaagttcatatgaatccgaaacagaatccccgatcacatctgctccagccttcgatatcgctgttatcttcctctccgcggataagccctctgtcacagacttcccagggtatgatttttccagaaattcagtaatccaataaggatacgagtatcttaaagatttgtcaagaagcggctcaaaggacgcatatcgcttgtccaaaacccgccagtgcccggcagaatatttaaggcgtattgaagtactttcaagcaccacccgggcttctggcgcatccttttcgcggatgacctgacggatcacggcgtttgcaaatgaagcgaagcgcggcctgccgagtgacttgataagccctaccgactcgttgcaggcagccgcatcaggcactttttccatgaaaaaaatctgtgcgagagcgagacggattgctgaaagcaccagtctgtcaatttttttcaggcgggtgctgctgtatgctgcgatcacagcatcgatcgtcgactggtgcgcagtctcagtctcaactaaagccgtatagaaggcgccgtcgcggtggtcccagtcagagcgctcttttaaagtccgctttaccacagccgagcggtattcgtcggttttttcgagagtcagcagggcattttttcttatatcatccattagtagtcctcagtgaaaaagtgcttcactccgtcctttttccaggcgactatagtcgacaggttcacgttttcgacacttctgaatatatttttttcaacattcgggtttacttttttgagctgacggatgagctgctttatctccatgcgcttcgagtttgtgtggccctcaggatcgagtgacgaacagttgtcggtgaagtgacaggcgcactggatgaagtgcagtccgttcgtgtcgcgccagcgcttgatgtcgtcctcacggatcaggtagagcgggcggataagctccatgcccggaaaattcgtcgagtgaagtttcggcatcatggtctggacctgtccgccgtagagcattcccataagaatcgtttcgatcacatcgtcgaaatggtggccgagggcgatcttgttgcagccgagcttctgcgcctgggaatagagccagccgcggcgcatacgggcgcagagatagcacggatttttaggcaccgtgtctactatatcaaaaatatccgatttaaaaacagtcagaggcacatccagaaggcgggcattttcttcgatgacagcgagattcgtatcgttgtagcccggattcatgcacatgaaagtcatgtcgaattcgaacttgtgatgccgctgtatctcctggaaaagctttgccataagaaacgaatcttttccaccagatacgcagacagccacatggtcgcccggctgtaaaagctcgtaggtgtttaaggcccttgcaaaaggcgaaaagagcttcttgtggaaggtcttcctgatgctctcctctgcctgttttttcttggactgtgcgtgctttatgtcaaaaacgacccatctcgaataaccgcccgccagagaaaatgcatcgacgccctgctcgcggagcttttttacaggctcaacggactgggtcccgttcatacagtagacgattaccggaacgccctggcccttccagtcggataagtgcgagtcaaattctgatgcgggtatcaagaccgctcccgggatagtgccgtagtcggtcgcacttttgttgcgcatatcaactaaaatataagaggagagccgtttctcggacatctcctccggtgtaatttcaatatccataaaaaatcaatctgcttttgccagcttctccctgagggctctgcctgcgcggaaaagctcacgttttttaagctttttttcaagatctgacttctcgcgcgctgcgtgatcaaagccgataatgtcagtcgcgatcttcgatgcgatcataatgcccgcaaccggcggaacaaacggagtcgaagacggtatcgcacggcggtcagagcaggacctcggcgaattcggcgggcagacgcagtgctcacggcagctgatctctgaatcgtcgataggagtaagcgcagtctccgtagaatagagcacagtgcatttcctgacgcctcgttttctgagctcacgcctcataaccttcgcgagcggatcatttacagtcttgtaaatatcggttatcaaaagcttcgtcgggtccacgcggttaccgcagcccatacacgaaataacgggaattccagccttctgggcctcctctatgataagaagcttcgccgtaactgtatcgacagcgtccacaacatagtcccactttgaaaaatcgaactcatccttgttctccggcaggaaaaatgtcttgtgagtctccacttcggcgtgcgggttgatagaaaggatcctctcctttccaatctccacctttggatgcccgatagtgtttacagtggcgagtatctgacggttgatattcgtaaggcagacgacatcgtcatcgaccagcacaaaatggccgactcccgccctcgcaagtgactctacaacatagccgcctacgccgccaatcccgaagatggcgacgcgagcggcttttaacttgtccattgcttctgcaccgagaagcatctgagttcttgaaaactggttctgcattatgccagagcagctgtgatgacagccattgagtaaacctcaagggcattgcagccacgtgaaaggtcgttgataggtgcgttgagtccaagaaggataggaccgtaagcatcgaaaccgcctaatctctgggcgatcttgtagccaatgtttccagcattgatatctgggaaaatgaaggtattggcatgtccggcaacagggtctccagggcacttcgtctctgcgacacgaggagctacggctgcgtcgaactggagctcacctgaaatagggagatccggatacttagccttggccttctcagcggcgtttctcatcttgtcaactgaatcgcccttgccagaaccaagtgtagaatatgaaaggaatgcaaccttaggatctacgccgaatacccttgcacactcagatgcctcgccagcgatctcaacaagctgatcctcggtaggatcgatgttgatagcgcagtctgcaaatgcgagaacttcgttgtcaccagtagctgctggacgaaccaggatgaagactgagcttacgttagatgcgcccggcttggttttaataagctgaagtgcaggtcttacagtatctgctgtagagtaggtagcgccacctaaaaggcagtcagcctcgcccatctttacaagcattgttccgaagtagttggcaccggcaagtgtctttctggcctggtcaggtgtaacacccttcttcttgcgaagctcgcagaacaggtctaccatctcgtcaaatttctcgtagttgttcggatctatgatcttggcgccacggatattgtaaccttccttctcagctgctgcttcgatctcctctggatttccaagaagaagcggatgcaggaagtttgaagcgagaagtcttgatgctgcctcgagaattctcggatctgtgccctctgtgaagacgatagtcttagggctctttttcagtttttcaatcatgcttccaaaaccgaatgatgccattttaaatctccttttataaaaattttgttagtaaaggctgacagtccgttcagccataactatgataacactcagaagtatttttttaaagtactatgtattgtacaaatatcagtgccggtcaaatttaaacagggagagaatcttctccgagttcgactgcgtaataaactcgacattgtttaaaaatataacgtccttaatcttcttgtcctttatcatctgagtcagatcgtccctgtaatagcggaaatccacgatatatgtcttgtcgtagtgatcgacgaggaaaggcgcaaaggcgcatccgtaggagtcttttataaggacacaggcgctgccgtcatttttctttggattgtcgatctcctctaacggctcatccccgccaataaatacagagtagctttttcccggctggatgatcttatatttgacctttttgtagttctggtctgtcatcgtcatcgtatttgtcgagatagggatgtaggcttcgatcgtgtccggatttttctgaagctccggcgacttgcggctgaatgagtagtaagtcccgaggaagcctttagacacctgcttcttgtagtccccaagctcgtgaggtgtaaagcccttcatcctgcagaactgcctgtaggcgtaatatgcgccgcgggcggtccagtggtgatccgtcctgaaatagatatactcagagctgtgatttctaagctcgttgtagacttcgaccacgttcacattttttgcgaagcgcttgtaaatatagtcgaaggcgtctccctcgtactgtgacagcttctcctgagtcttcttcgaaagcacagctccaaaactgtccggagtaggaatcgcgtagacattcaccgaactgccgaggcgctcggcgacggtatttaccatggaagcgtacgtatcaacatttttccggttgaaatagtacagtgaaaaaccacttcctccggcaatataaatggagccgaccttctccggctcggcctgtatggctttgctgtctgcatcatcattcagtttcgtctctgtggagtttgtctttttttccggcttcttcgcaccagaagaagcagtcttagatgaaggtatcttcatggtctttgcggcagtgaccttctttttgaccgggatcttgtctcccttcttcacagcgttggctgtcacgattttgtctccgccgatcccatagtggtcctggatgtcggagtttttcgcgatcatcgtctcgcgcagcggataggtgtcggcgtaccaggtctgcaggccgctgtaaaattttccgttcaaaagcccctgaacagtaagagtcgggaacttcgcgagttttctcttctcattaaccgactccgcaggccttgtcccaaagattccgacagcacagaaagtcaggactattaaaaatatgaaaataataaaaatgattgaaaaagatctttttttcatgttttcctcatctcatagctttggtcagaactggttgtaaaggaacggcgtgtagttgtttccagccatcgcaaagagcgaccagataaatatcactgcagtgaatgctgtctttatgatcgtgacagaaaattcagcggcaccgcctctgtcggcgactttggacaatttgtcctcaatgatcttaaagagcggcgtgcaggctaacacggccacagctatgaaaaatacattgccacgcagtgtatagagtatctgctggtcatagagctcgcttcccgcaaaaagtcctctcactgccatcttcagctgaccgaaatcggagaaccgaaatatcacccatccgaaatttacaacgaacagcgcgtagatatgtccgaaaaagcttctgaccggtccggctttcgagaccttgtgccttaacgcgtgctcaataccaacgaagacgaaatagtaaagtccccagataacgaagttccacgaagagccgtgccagagcccggtaaggaaccagactacgagcaggttgaacacatgccttaaagcgccgacccggctgccacccatcgggatatacacatagtccctgaaaaacaatgacagtgaaatatgccatcttctccagaaatccgtaatgctctttgccacatacgggtagttgaagttttccatatacgtatagccgcacatgtggccgagccccagggccatgtcagtgtaggccgagaaatccagatacatctgcagtgtaaaaaatatcgagccgatccagagtgtcagcaccggctgggacgcgagagccgctcctttaggaagcagcaggtccgcctgtgagccgcagtaatcggcgagtatcactttttttgacagaccgataataaatctgaaaagtccatcagcaaactctgtcttcgtcagatttctcgacacgagctgcggtctgatgtcgccgtagcgcacgataggtccctgcacaacatggtgaaatgacatcgtgtataaaaggaacctgccaaaatttgtctcgtgttcaactgtcccgcggcttacatcggcaagatacgaaatgatcttaaaagtgtaaaatgagataccgaccggcagggcaatttttaaaacaggaagtccaaccccggtaaaatcatttatcgtcttctctatgaaacctgtatatttaaaaaagccgagagccgctataagcactatgactccgctgacgaggaagcccttcgtgctccccgctcttttcctctgatatgagatcagccggcccgtgtaccatccgaaaaagctcagcgctatgataaggaccagatacccgacgccggcgctcgcatacaggattattgaaaaaataagcagcaccgcgttctgagcctttacgcctctggcaagcagatagattatcaagaaaaccggcaggatcaccagtacaaagaaaagtccccaaaatgtcatatcaatttctctactttctcaaatttacagactcttattttatgttggcatcagacctttgtcaatgacttaatatcgtaacatttctgtaagaaatgcaaaaaagtcccggtgtctttttctgacaccgggtatgtaaattggaaggaattacctgtgaaatccaaacaggccttttttcttctgaacctcagattcactgacatccaaaagcttgtagccgatgtccttgaatgccgagttcaggtcgtgctttaccatgccgagaggcatcggctcatcgagcagaaaagaagcctctctagtcgtgtgatcagccgtgagcttcttagcctccgggatcttctttctgatggcatccttgatatgtgcctcgcacataccgcacatcataccatcgatcgtcatctcaatcttctgcataactgccttctttccaaaaatcggattcacttccgcgctttctgaagtttcacgatatgcctctgcatcgctcctacttctgcgctttctgaagttccttaagcctctttatcgtgcgctcgacttcacggcgggtctctttgtccatatgctcattctggcagtgaccgcatctgccacggcatacctcgtcgccgcacacatatccgcaggtaggctttccgctccttttgtcgcggatgatcgagccagctgcaagcactatgaaaaatgccagtaccgcaagtacaatcaaatcagccattgaagccacctccactgctttctgtatcacctgtatcctcttcgcatataccccttgggggtatctcatttcatttactactatacaccctttcaggaaaaatacaagtacaaaacgctatacaatttattagttgtgtctaacttttattttttaaaagatgaaaagagacgggtggaggtaatcccctgcccgcccgaaagattgtgcagcaatatagttatactgtttgttttaagctttagcctttgagatcccaccacggtcaatctcgacatacttcttgttcggatccggtctgaacagaagaaagaggtaaccggcaagaacagcgaaggctgctacggtccagcctgagaatggtactccattgaagagaccaatgatctggtaaaccatcagagctacgcaccatgctgagatgttctggaaagcaatggcctgccagaatttctttctgtctccgatctcctttgccattgaagaaatggctgcaagacatgggctgtcgaagatgttgaatacgaggaaggagatagctcccattgaagcacctacgtgtgcgcttccggttccgaagaactctgtgaaggctgtacgcagagcattgaagtgatatccgctctcagtaacggcatcagatacatcaacaccgagctttgatacgattgaaagtgtacctacgagctgctcctttgcgacgaagcctgaaagagtagcaccgactggctgccagtgaccaaatccaagcggaacgaagattggagcgatgaaaccaccgatagcagcaagcaatgaatttcctgcatcgtctacgaggccgaaagcgccgccctcgataccgaatgatgtcaggaaccacataacagcacagcagaggaagaggattgttccggctttcttgatgaaggcccagagacgctcccacacatgaagaagaaggcccttaactgtagggaaatgatatgccggaagctccattacgaatggaacaggctcaccagcgaaggccctggtcttcttcaggataatgcagtaaactattacaagtccgattcctgcgaagtaacatactggagcgaaccaccatacatttgaacccattacatatcctgcgatagcagcgattacagggagcttggctccgcaagggatcatcgtcgtagtcatcattgtcatacgacggtccttttcactttcgattgtacgggtagacatgattcccggaactccgcatcctgaagagatgaggaaaggaatgaatgacttacctgagagaccgaactttctgaagatacggtccatgatgaatgcgacacgggccatgtatccgcagtcctctaagaatccgaggaacaggaatatgatagccatctgaggtacgaatccgagcggcgtagcgataccatttacgataccatctacgataagtgaatctacccatgcagatacgtgaatatgcttgaacaggaagcctctgaagaagtcctcctcgatccactgtccaaagagtgtgtcgttggtccagtctgtaagaggacctccggcaagggttacacctacgtaataaacgaggaacataactccgacgaaaataggaagcgcgagccatctgttcgtaacaactctatcgatcttatctgaaattaaaagctctcccttggcgcggcccttctttacgcacctgctgataagctctgttatatattcatatctctggtttgtgatgatagactcagaatcatcgtccatctccttctcacagtctctgatgtgaccttcgatctcatcagctgcgtccttcggaatgttgatgccctcgagagctttcgtatctctctcgaaagtctttattgcgtaccatctctcctgattctttggaaccacatcctggattgacccctcgatatgagcaatagcgtgctcaacagaacctgtgaaaacatgtggaagctctccgaccttctttgccatggctgctttgactgccagctttacaggttcatcgacattatcgcctttaagtgctgaaatctcaacgacctggcatccaagagcttcaccaagctttttggtatctatctggtcaccattttttcttacgacatccatcatgttgatagccatgactaccgggatgccaacctcaataagctgtgtagtcagatagaggtttctttcgatgtttgttccgtcgatgatatttaagatagcgtcaggctgatccttaacgaggtaatttctggatacgacctcctcaagggtgtacgggctgagtgaatatataccgggcagatcctgaatgataacattgtgatcctctgtgtagcgtccttccttcttctcaacagtaacaccaggccagttaccaacgtactggttggctcccgtcagggagttgaaaagtgtagtcttaccgcagttcggatttccggcaagagcaatcttaatctccatttttcctcctaaaaaatattccaatgtagttctcttgctaatctcagagaacgacctcgcttcggattcgaacaaggaagttctcttcgttaagctcacgctgcgccttcggcttgcgttcgctaatctcagagaacgacctcgcatgtggctcgaacttcgtcttcgactcgttctcgcctacatgctttcggtcattccatctcaagaatgtctgcgtcatccttacgaagcgagagctcaaatccacgtactgtagcctcaaccggatctccgagtggggcaacctttctgacgtagatctcagttcctttcgtgatacccatatccatgatacggcgttttaaagcaccggcgccatgaatggctttaaccttagcggtctcgccaacttttacatcgcggagcgtcttcatagaaaaattcctcctatctacttgatatctggctctgacggtacaacctgcaccttcgcagccatctgatctgtgatcgcaagcctcgattccttaagattcactatcacattcccatttccagtctggcttatgatcttaacacggcttccaacaacaaagcccagatcctcaagatgctttctgacatcctctgaaccgccgatcttcgcgaccataacggtctcaccatttttagcgaatgacaatggtaacataacaattcatcccttccattacttaacacttctcacacaaattaaaaaagcgctcaaaaatgttagttagtctaaacttgcatctagtatattagcatcaccttacaaatctgtcaagaaaaattagtgattgctaacaacttgaataaaataccattttagtgtatattagagggaataatatgaatcagatatttaaatgtaaaaatataaggagggatttcatatgaagatgcgtgaatcagctcaggattatctggaatccatactaataatttcacagcagaaagactatgtccgcgcgacagatatctgcaactactttggctatgcgagggccacagtctcagttttcatgaagcagctcaaggaaaacggctatgtggatattgacgagcataaccacatcacactcacggattccggcatgaaaattgcccagcagatgtacgagaggcaccagtttctctcgaagctcttcatcaagatcggggtgccggaggatatcgcagtgcgcgatgcgtgcagagttgagcattacgtgagcacagagacctttgaagcgatgaaaaaagcattcagttaagttatcttatgtagaaaatcgcccgcgtgtgccgctttttaagcacaaaatcgcccgcgtgtaccgcttttcaagcacaaaatcgcccgtgagtgctgcgtcaggtcagctggataagctgccgggacggcactcacgggctctttcttcataagagtatgcgccaccgcgttttttactactgtaaggttaagaaatatagtttggtgaacagataccaaggtttcgatttgcagctgctcattttttcaatcggggcgttcgcagagctggaattcttaagggcaaaaatgcaagtatcaatatagatccaaagcgcattagaaatcttaaacgtccaaatgcacattttcaatatagccgtatgcggtgctggaattcttaaatgccttgtagaaaatccaagagctcaaagcatatactgaaaaccccaaaactgaactgtaagtttttgaaaaaattgttcatatatattgaaaaagtaaatttacattttaagattttgaggctctccatgatctatcttaaaaacgccaactctgccattgtataaaattcaccaattaaagttatatactgaaaacattcaccaattcatatttttcaactttacagccagatttattttacctcaaaacccattcaccaattcatatttttcaacactccgatcgcctcaaaacccattcaccacatcgtatttctcaaccttactccaagctgctttctgtgacgcttatttatacacaaaaagagcccttgaggaccgcggcagctttttccagctgctgggcggtcctcaagggtgttttttatatttatacttataccatctgcgctttaatcagattcgtcgttcccgaaataccgagcggcacaccagcgatgagaaccacgatatcgccctcatctaggagcttctcttcctggcagcgctcgagcgtatgcgagaaaagagtctcggcgtctttttcctcggagatcatgatcggagtcgtgccccagcagaggttcatctggcggcagactctgtcgtccaggcagcctgcgatgatcggcgactccgggcggaacttcgatacggcgtgagccgtgcggccggatttcgtaactgtgactatggccttggcgttcaggtcacccgcgagcatgcaggctgagtgagtgattccatctgtgatggatggctcagccggcctgtcggcctttttcatacggttaacatagttgatatcctgctctgtcctgcgggcgatgcggtccatcgtcttgacagcttcgaccggatattttccagcggcagtctcacccgaaagcatgatggccgaagtgccgtcgtaaacggcgtttgctacatctgtagcctcggctctggtcggccgcgggtgtgttatcatcgagtcgagcatctgtgtggcagtgactacaaatttgccggcctcgtaaactttctttatgatcatcttctggatgaccggaacttcctcgagaggaatctcaacgcccatgtcgccacgtgctaccatgatgccatctgctgcctgaatgatcgaatcgatattcttgacaccctggttgttctcgatctttgcaatgatctgaatcttttcaccaccgtgatcttttaaaatcttcctgatatcctcgatatcctgtgcagttctcgtaaatgaagctgcaataaaatcgaagtcctcctggactgcaaagacgatgtccttgtaatccttcgcgctgacgaatggcatagagagctctacattcgggacatttacaccttttttatctgaaatatgtccgccgttgatcacggtgcaggtaatgtctgtatctgtaactttcgttacaagcatctcaatgagtccgtcgtcgatcagaatatgtgtgccgcgggtaacatccttcggcagatccttgtaggtgatcgataccatatggttatcgccctctacatctctggtcgtcaggacaaattcctggtcatcgacaagatctgtgccgccatctttgaatgacttcaggcggatctctggtcccttcgtatcgagaagagctgctatagggtatccgagctcttttctgagttttcttaaagtcttaagcctcccgagatgctcctcgtggcttccatgtgaaaaattaaatctcgctacattcattcctgccttgatcagggaagccatcgtatcctctgactcagatgcaggtcctaaagtacatattatcttggttttacgaatattattcatatatactccttaaaaaacgcatcacttagctatcatagtcccgtccctgcctgcaataagcggcttctccgggtcaagttttgcgataagtgtctttctgatggccgaatctccaatataagaaactgcagcttcaatcttcggcttcatcgtgccttcctcaaactggccttcctcgagatatctcttcgcatctgccactgaaataaaatcgagcggcttctcttcaggtgtgccaaagttcaggcagaccttgttcgttcctgtcaaaatgataagcatatctgcatctacctgatcagccagaacgcctgctgccgtatccttctcaataacggcagatgctcctttaagcagatgatcctgcataagcaccgggattccgccgcctccacaggcgataaccacctggtcagcatcgagcagtgcttttatcgcatcgatctcaactatactctgcggcttaggtgtcgcaactatacgtctgaaacctccatccactttcgtgacaggatttccctttttctcctgggcctgtgcctctttttcattcaggactctgccgatgatctttgtcgggcggtaaaatgcctcgtcgtaagggtcgacagtgacctgcgtcaaaactgtggccacagtcttatagatgcctttatttatcagggctccccggatagcactctgcagatcgtatccaatatagccctggctcatagccgagcacacactcataggagtgtctgtgtattccggatacttctgtgaaaattcgttcatagccgtatgaatcataccgacctgcggtccattcgaatgtgtgaccactacctgatagccttgggaaataaattcagctaccgcctttgcgctgccctccgccgctttcttctgttcaggaagcgtcgttccaagagcattgtgtcctaatgctattacgattctttttttatccatgagtctcctttgctctacatacataaaagacgcagtggaaaaccactacgccctttattatattatttatctgcttttttcacaagagaaacatgaattagtttccgaatatctggctccagtcgtagagattgccgtagctgtttgaaccgccattgttgttcgaatttccgttggatgagccctgattgtcattatcattgttgtcggatgaagagtcctcactcggacgagccgtgagcgtgatctcaatatccttcgccttgtagttattttcaacggtagctactgatacctttaccttgtcgccttttttcttgcctgaaatatagctgtaaagggacgacatagatgtaatattcgttccatcaactgctgtgatcacgtctccctttttgatgcctgccttatctgccgggctttttgagacaacctttgtcacatagacaccctcaggcatattgtatgagcttgccatttctgaggagatgtctgctccctgaattccgaggaagccctgtttgctggtggttgatgcagaagaccctgaagtattggaagatcccggtctcttggtaacttttccggaatccatcagctggtcgatgatagtcttggcatttgagatagggattgcaaagcccatgccctctacagatgcctctgtcgatgaaccgctgctcgaatatttcgcagatacgactcctactacctcgcccttcgagttaagaagcgcgccgcctgaatttccggcatttacagctgccgaggtctggatcatcttctgtgtgtatgtcttgttcgtctcctcattcttaatggaaacttctctgttcaatgcactgatgacgcctgtcgtaactgactggccatagcctaatgcatttccaataactatagcctgctggcctaccttaaggtcctcagatgtaccgagtgtagcgacctttatagctttctttgtgctgtccttaagtgatgagagcttgactctgatgactgccagatcagtctgtacatcggttcctaccacttcgccggaaacactcttgttatcgttgaaagtaactgagaggctgtttgaattcgacactacgtggttattcgtagcaatatataaataattatttttctcgctgataataattccgcttccaaggctcttcgtcggaactgtcgatgaagtgccgaaccagctctgtacctgctcaagtgacatatttgtcacctgaactatggaaggaagtgtttcgctcgcaatcgttgaaacatcctgagatccggctgtagccgatgtcgttgtcgagctgatctgtccatttccattcgatgtgcttgaagagctgttcgatttggtactctgcgaaactgatatcttatcgtttcccgtcagatggttcgtcagcatattcgtgcctgccgtaaccggtcctgcaaccgctccgaaaataagggcagcggccacaacctttccgacaaacttagccttcggatgaggcttcctgacctttttctttggctgctgatactgtccattgttgttgtactgatttgtgtaaggattgtactcgccattcggctgattgtcatcgtcgccgcctggctgatattcatagtactgatagttgctcattatatattacctcgctttctggggctcatttccttttgacagtatctatagtactatttatttatgttgaaaatgtgtcctgaaaagcttttatctgtgaaagtgatttgaataaaataagaatagagtttcttcccgctccgcggagccgcttgttttcaacatggattgggatttggatgattcgctacaaatcgttcaggcttcccgctccgctgtcaagctttttatcaacatacaggagattccagataattacctccagtgaccttcgaaaaattctcaaccgggctcaaagaaaaatccaaatgtgacaacagcttcaatataagcataactccctgcaatttgtgccaaatatgattttttaatttttaacatatgctaaaaaaagcactatttcctccaaagccttggagcgcttacgcttgataacgagctatagtgataaaataactttattttaataacgaaaatgctgtaatctttggtgatatccggattgacaattaaatatagtgataattctctgcaaaaagaccatcgcaggcacatatggctttgcaccaagaagcaccgccgctgatacgggcgcctattattcaagaagcagcgccgcagatagagacgggctcgcgaccttaggatttttcgttgtgagcggcggttcgccgtttccgctctgacttcgtccttcggactcgtcaatcgcggacggctatcgcatgggcggtttataatgctctcgcttcgtccttcggactcgcgacagcataacaaccgctccatgcgtgctagctgcggcccgggttgccacccgcttggaccataaacgtatgtaaaccatacattggcaagagggccgcaaataggcgcgcgcacgcgaacagaaaaatcctacggagcgagaccgaccatctgcggcgctgcttcgggcttgacgagcataatttatctgacaattccgactttgggacaaaaagaaccgtcccttctgtcccattattcgactgttactgattttgcgagatttctcggcttgtcgacgtcgcagcccttgcctacagcaacgtagtatgcgaagagctggagcgggatgattgccagtgagtttgcgaagaaatggttcgtctgcggaatgtagatcacgtagtccgcattctcttcgatgctggtatttccctcatttgtaacggcgagcacgaaggccccacgggtcttgacctcgacgatgtttgatacagtcttcggatagagatcatcctgagtagcaactgctgccacgagtgttccgtcctcgataagagaaatcgtgccgtgtttcagctcgcctgccggataggcctctgaatggatgtatgaaatctccttgagtttcaatgaaccctcgagagatgtagcgtagtcaattcctctgccgatgaagaagatgttctttgcagcgatgtatctgttggcaaatttctggattctctctttatcatgtaagaggagctctatctggtctggaagcttctccaggtcatcgatataggccttctctttggcatcgtctatttcgcccctggccttcgcaaatttgatagcgatcaggtagtggcagatcagctgtgcgctgtaagcctttgtggttgctacggcaatctccgggccggcccaggtatacataacctcatcagcttctcttgcaatagttgaaccgactacatttacaatggcgagggtcctgattcccttctcctttgccagacgaagtgccgcaagagtatcggccgtctcacctgactggcttacaatgactacgaggtcatttttgttgatgatagggtcgcgatagcggaactcgctcgcgacgtctacgtcggtcggaatgcgggccatctgctcatagacatatctggctgtcactccagtgtgataagcactgccgcaggcgacgatatggattcggccaatagcctttatatcgtcatctgacatatggagatcgtctattacaacatggcctttgcgaattctcggagaaagagtattcttgacggtcttcggctgctcgtacatctcctttaacataaagtgggcataaccgcccttctcggcagcatttgaatcccagtcgatatgctttgactgcttctcgaccggctcaccatcgatattaaaaaatgtgatgccatctcttttcaggcaggcaacctcctgattgtcaatatagtagacatcgcgggtatgttttaaaagcgctgtgacatctgaagcgatatagcttccgtcatctgcgaatccagctacgagcggtgaatcctttctgactgcgtagactctgtcagggtgatctgcaaaaagaattcctaaggcataacttccctcgactctgttcattacctttgtgatagcttcgagcggatttccctcgtagtaatagtcgaggagctgtgcgacagtctctgtatctgtctcagaaataaatgtgtagcccttagcagtcagcttgtcttttatcttctgatagttctcaataattccattgtgaactacggcaatagttctgtccttattgaactgagggtgtgcgttgacctcatttggctcaccgtgtgtagcccatctggtgtgacctattccgaccactcccggcatagtgctgccatcgtgtgtcagttcctcaagcaccttaaggcgtcccttggattttttgatttcaatctggttaccatcgtaaacagcgattcccgctgaatcgtagccgcggtactcgagtttttcaagtccgtccagaagtaccggagcagcctgctcagttccaatgtatcctactattccacacataaaaatctcctgactatgatagaaaaatcatcatgcgctctgtttaatttgttgtgcctatacttgacgaagatgaagtcgtcgtactggatgtcgacgaagaatcatctttcttgtcatctatacctttattaccctcatcaatactgaagtccactgccgaagatgcattttttcctgtcttatacataatcgtctgactgattttttgtacagtacgggaaggggcgtagtttgtctcgtcgaacatctcctgatggagtctctcgacattgtcctcaagtgtacatggaatcaagaccgagccccaaggctttatcgtatcaatactcttcgaatatgggaatccgaaagatttctctatcttataggacttcgcagctgaagcaagtgacagtatatctgtcgctgaaaaattagtcgaaacctgtggaagtacatcgtcgattatcttgcttatctggcttacagatgcgttccttaacttctccaaagttgcagccataactcttctctgtctctcggcacggccaaggtctcccttgtggtccggagcatgtctgatacggcagagtgaacaagcctgtacaccattcaaggtctggcgtccggaatgcgtaacaggagtagctttctttcccgaaagtctggcaacttctgaaatgtaatcgtacttcttgtactggaaggcctgatactcagcgtccgttacatcgatctctacacctccaagatcgtcaattacatcggttactgccttgaagtcgaaagtaacgaacttgtccagattgagatccaggttaccattaaccatctcgagggtctgcttttcaccaccctttgcataagcggcgttcgatttctgataaggtttcgaatctgatcccatcggatcagtatttagcagagtatcacgatacagtgatgctatacgtatctttttggtatcgttattaatgctgacaatcatctgtacgtcggagcggccctgcttcacagcgtccgttcccacacctctgctgtctacaccaagtacaagaaaattcgtatagcctgaaagagacttcacggttttttcggaaagtttgttagtctttactgttccgacatcgcggaaacgtatctggccgaacttcagccatgcaaacagtattactaaaaacagcaccagtatgactatctcaacgatcagaagtatcttcctgcgctttctgcgcctcgctcttctcgattggtgcattgacttttcgctcatttcttacctcacaacaaacgcaataaccgtccggttatttcatatttacttcagcactgctgtaatctactgctgaagatttgtttttacctgttttgctgatgatcgtctggctgatagacctgaccttctcagaaggcgtatagtcagtctcatcaaacatcctctgatgtagttcctttacattgtcttcgagggtgcacggtactacgatcgatccccatggtttgattgttccgatccacttcgtaaaagggaagccaagagacttatccatcgaatatgactttgctgaagtagcaagtgataaaatctctgtaaccgagaagtttgtcgaaatcttcggaagaatatcgtcgattatatcatttagctggcttaaagatgctttctttactttatctaaaacaagacgcagaactcttctctgcctctcggcacggccaaggtcgcccttgttatctgcgcagtgtctgatacggcagtatgcgcaggcctgtacaccgtttaatttctgaagtcccggatgtgtcagataagtcgggctcttccctgccagttttgccgtctccggtatcatattccattcgtggttcgacgctttcattacatcgtactcagcctgtgagacatttacctcaatgccgccaatatcgtctacgacatcaactaccgcattgaaatcaaaagtgacgaacttgctcacattcagatcaaggtttccgttcatcatctcaagggcctgcttctcgccaccgagagagtaagctgcatttgcctttctataaggagtcgaatttgtccccataggatctgtattcaaaaatgaatcacggtatacagataacagacgcatcttctttgtgtcgttatttatgctgacaagtatctgcacatcggaacggccttcctgcgtagcatcagttcccgtagatctgctgtcgacaccgaataccataaagttcgtatagcccgacaatgactttacagtctcagctgatagtgtgttggtctttactttaccgacattctggaaatgtatctttccgaacttgagccagaagaacagtacgataaggaccagtaccaaaatgatcagctcaactatcagaaaaaccttacggcgctttctggacttcgtttttccagaaggacgcggtgtattttcacgcatctttttacctcacgaaatattatgatataagggtcaacaagcgtgacttaatgacccgccccacagctccagaaaagctaaaaatatagtaaaataaaatttatatgcatttagcttttctggagctgtggggttttgtgagtgtgaaacactcacaaaactatatcatgatttggtggtcaaccttttgaccaccaaatcataatataactcgataactttagcataataccccaattatttcagaatgtcaatctcagagatagtagttcttaatccccgcaggaaggttcctgttgtaaaaaggatctcccgccgttatagtcctcttccacttctcacgaagtacagagcgtgagttctcgtcgcctccctcatctgttctgctgcgatgggccgtgaccttcgggacatagacgactcttagtcctccagctcttgctttaagacacaggtcgagtatcatatcgttgccgcggagccgtttgtcgaatccaccgcattttttaaaaaaggaagcgtctaccatgcagaatgaaaagtctaccatagagacgtcagatgcagtacggatacggccatagagccccggcgacagcggattttctcctctgcatgccggataggtaattccctcctgatcatagatgtaaccgcagttgtttaccgacaggccgctgataaattttccaccggctacagctatatccggctgtgaaacatagccgtagagcttttcggccgcgtttctcgtagtaacatggactcccttgtcttttatcagaagaaccgagctcatatgcgacctgtaatcgctcccgtcataccgcacagaccacgagtcgttttttgtccgctcgactttgcctctgatcccattttcgttcaggtaagcgcttaccactgtcatgtgctctctgatactcctgtctctaagcgaaaggagctcatcgtttacaggtgaatcaggtgctacattgtgccagaggagcgccgcaatgtgcccgaatctggcctttctctgcatcgccctgataaaaaaatcataggcaaatgcgaatgaaagctcttttctaaagagtcccagtctccttatagaatcgcgttttactatgaaagtgtccccgatataattctgcccgaggagcagctccttattgaaatcaggaagaaaataaggattcatccggcaggcgtcttttatctcgtcgtgatcggtgtagatgatatcacactccggatgctctcctatgaaatcactcaggtatttgaggatcatcgtattcagcttgtccgtaagcccgacgaatatcaggtaatcgccctgtgcccttctgatgccctcattccagacatcggcgagggaatttttcggacggagcttcacgtacttcagcctgtagtcatccttcatgaccgacctcgtaatattgccaagtccagcctccgggcaggcgtcgagaacctggatctccatattccgccattcgagagcttttgccgactctaaggactccttaaaataccaggctgcggtctgataggctccgatgatcactgaaaaccggatgctctcaatcgccatcggcatttctcctggcttcaagcagtttccttgcggaatcgaccgagtcggtaccatgcaggttttttactggggcgaattcgtcctcgcgctttacctctaccggaagaaaatccgggaaaaatttcaggatatctgtgataagaatctcaaatttatagccgttcggctcttcgggctttacaagccttccatcctctccgatatacgggatcttcttttttactttgtgaaccggcatatcctgcccgacagtatttaaaagaatagaagtatcaaaaagataatttacagtgactcctgcgctgtagaggagctctccatcctcaccgcgctcgtgagcctgctcgtcgccaagctcaaaatactctactatagacggatgcccgtttttctcgcagacgactccgacattttccgacgggtccttcttaaggactgccttgacagcagcggacttgtgctcttctatgactgctcccaagaaggccgggtcggcgatcttcgcgaggacattgtcaactccgaagacattgagccattttacaccgcaccgttttaatatctcgccgtatcctgcctttacgagcgaagtaaaaaatccgccgtttccattcggagaagtagccgggacatcctttccttcgagcaggagcttctcatcaaagtcacaggccggtgccatctcctgcttgaaaaaataaatgagcttaggatcgtatccgaagtaatttttctctttaaaaaatgccctcgtggcctgatcatttttatcagatgtcataacgaaaaacggcactttgatgtctccgatatctctgcggagattgtcgaaaaggcatccgaaaatggacttgtcctcttcgataggataagttcccttcggcccgctgaagccgagcctcgtgcccatgccgcccgcaaggagcagaagtgccagctctccgcgcttaatagacttaaggcctgctgccctgtactcgtcatatttcttcgcgtagtccttaagcctgagtgtctttatcgggctgatatctgatttttcgcacgctgtattatcatccgaaagtcttaagtattccgaaagttttttctctgcctctgctgtagtcatattactcctcattcaatgcctcaagcctcataaaaggctcgagatctttatttgaaatctcaacgagaatcctgccattgtcttctccgcagcgtatcaaaagatcatcgccttttcgtgcctggttcttgtactctatcctgtaaaaatcaaacggccccctgcccgagagaacgctctcagcgagcacaatatacttgccgttattcatgtgtccattcgaatcgatcatgatctcgttgaccttgatctggccgaccgtctcgaggtcaccgtcgaattttatctttctcttcccgaagtcctctgtcggcggtgctccggcaccgtaagcagtaatcatctcctgcggcgcacgggtaggttccgatctgtcgagatccatatatacccagagcgagtttgccgtaacaaacggggtctcgtcccaatccgttatagtaaaatacctcgaagccagtgcacctctggccctgtatgggtaggtacgtacggtcacattttctcccatgaccggacttttgtgaattcttatctgccagtccgttacgaaccagcctctgcgttttcctgtaagccactgcatcgtataacctgtatcctgcgaatgaaatgtggcgcagtcctgcagttcatttataatgcctgacagcggcatctcaaggttttcgttcacctgtgaaaatcccactctggtcttcatctcatacataaaattcgacctttcagctaagtgtacagtaatatcagttattatatcatttaaaaatgagcggtgcaattcgcattccgcttcgcttcatgctcattcgcgcgttcgcgctattgaaataacacatcggatgcctttgcggatgcaagcatccgccggcaccgatatgttatttcagcaccgctcatttaatacgcgaaaaaaagaggcgatgtactgatgtacatcgcctcttaaaagagctggcccacaaggattcgaaccttgaaatgacggagtcagagtccgctgccttaccgtttggctatgggccaacaacagatattattctactccgtttctgagatattgcaagtttttatttgagtacaatcctgtgatctcagctttttgaatttttgcgtgaattatgtactgacgcgggcggtatccgggatgtgtgaatattgcaggtccgaagcatatcatctgccgagatcatatatttgctgtcttcggtacccggacttcctccggtaataaagacttcttttactatgtcagacttagggcagaaatctccagccgggagtcccgaaatcttacaaatgtcgagctttacatggtggtcacaggtctctgtcggcactgtatcagctgtgaaatactcttttacgaccatagagcctctcgggtccttgttgcagacattctcctcaggcagtttccctgatttcctgcagatatttgcagaaactattcctgcaggtctcttgaaaatcttatagctcttatccatatgaatctgctgcattattgacttccagatctttgtcgtatatgaagtatccttctgcggcgagtcatcgtcgcagcctccggtgacgacgcaggtgtaatacggcgaataaccagctaacagtaagtcccggttatcagttgtcataccactctttcccgcgagagtcatgccgtcaaacgatgcatttatcccgcttcccttgtttatggcgtcttccatcgcagatgtaagaagccatgccgtggattgcttcagaacgcggtgtcccttgtcgttggtggtatcgaggataactttaccagtactgtcctcaatcgtagtgtaatatacaggtctcctgtaatagccaccatttgcaatggttccataagccgccgcaagctctatatttttaactccacgggtgagtccgccgagtgcaagcgattcgttgttatctccatcccttaacgtcgaaatgccaaagtcctttacatactgatatccaagtcccgttccaatttttgtaagcgtcttaacggcgacaacatttacagaactggttacagcatcccttatcgtcgtaaacccacggtaccttttatcgtagttttttagtttctgcccgttctggtatgtcatcggcgcatcatcttcgactgtcgctagtgtctctccggcggcatctatggccggcgcgtaggctgagagaatatcaaaggttgagccgggctgtcttacggtatcagttgccctgtttaaagtccgcccgttctctctgtctccgcgtcctccggagaccgccctgacttctcccgttttctggtctattatcgtaacggccgtctgtggttctaacatatagtttatgcactctccgccttcaggtacttttccgtcggcggtcatctgcttcctgtatgccgcgtacgctttcttcgcctcttctttggatttataattcagggtgtaagccttatcacgtccgcggtagtactttagcatcgtcttctcgttgtaatttttcgtcgtgccgttttctttctcgacagtcagcgaaaaactaagtgagtacttcgtgcctcccggatagtttgccttacggtcgacttccttatcgactatattctggatgctcttgctctgagtcgcgtagatcttcagccctccggtgtacagcttcataaaagcttcggtctcagtgagcccgagctgcctttttagatctcctacgacctgctctgtcaatgcatcttcaaaataagacgacttttcctcatcttcgtaattttctgacgcgatacggctgtatacatcgtcatctatcgctttctgatacgatttacgtgtaatatatccctggtcgagcatagtcttaaggactttctcacgtcgcagtgcattgtttttccgatggtttatcgggttgtatttcgtgggatttctggcaatggcggcaagtactgtgcactccgacagattcagtttcgaaacatccttgttaaaataccgctctgcggcagcctcgactccgagagtattccgtccgaggtttagagtgtttaaatacttctcaagaatctgatccttggacttcactctctcaagctggacagccagatactcctgctggatcttgtggtcgagcctgtccacaaagcccttgtcctcagtcttcgttgaaaaataggtgatatcgaggagctgctgagttatagtgctcgccccctgtgaaaaatttccgccgtttacgagtcctgtaaagattgccctgatattgctgcgaatatccgctccattgtgctcatagaatctctcgtcctctactgctacaatcgcatgctgaagatcctttggaatttttttcaatgagacatactcgcgctctgttcctccggccgacagtgtcgccagaatcctgccgtcagtatcgacaatcctggtcttattccttgaaggcgaaatatttacagccgagatatccggcagcttgtcgatctgcgatttgacatagtaggctgcgcctgcgatagagagagccagcactataagaatcaggataaggatagtctttataagactgtggatgaagcggttctgcgctgccagcctttttctgattctcggcgagttgtgattttttacataagttctgctgaaatccatctataaaaaacctcgggggaaaatattaagctgaaactgttaaatacaaaagccactttattatagcaaaaatatttcgtataataaagcagacaggctgtttaaaaaaacaggagaattcgaatgtacaggattttaaagaccggaacaagtgaatacgatgaaaaaaagtcgcgctttctcggatatgtctttgcgatagaaagccctgaagaggccgccgaaaaaatttgcgcactaagaaaagagcactacaacgccagacatgtctgctttgcctggcaggtcgatggaattctccgctcttctgacgacggtgaaccacagggtacagccggtcacccgatagcagacgtactgactcacaggggatttgatcactgtcttattgctgtagtcaggtatttcgggggcacgctcttaggcaccggaggcctgacccgcgcttacagcacagcagcgtctttggcagctgatactgcaatcgtcatggaagttcttaccggatacccactgactttaacactcgattacaacgattttggcagggccagctattttttcaatcagaaaaaaataccgcagaccggtatagaatacggaactgcggtaacggtacatctgatggtaccatctgatctgaagggcgaaactgacaggaaactctccgacatcacatccggacaggcttccccagagtggggagatgagacttcctacggtctgtctcaagacaaagtcatttcgctctcctagaattcatttggctttcctggtcagtgtcttcgaccatttaccgaaatattttctgccatttactgtgatgtatgggcggacgctgacccagtaggtctttccctttttcagcttcgtaaatgttttcttcgtagatgaggtataggattcattccacttctttgcagtcgaccgcttaatcgcagtctgatatttcacggtctttccgctgacctttacctttttaaaactgatagtcagctttcttttcccaacggaaatttttgtgatagagccacgtttcttttttatagaagaaatctgcttcgaagatgccgactgcttcttttgtgaagcatttctgatcttgactttaagtgccttttcagtggtcttatcaaatgatgtgtcagaaagcttcagctcactgttcgtataaaattctctcgtgtcatcatcataagtgtgctcgccaaaagtatcgccattatctacaactgactgaccgccgagaatatactgcggtttgtatgaaggggagtctgtggtcttgtcataccaggtcacgtcgacgatatagtttttgccgccgatcgtaactacgttccacatgtggccaatgccgccggcattgcttgtcacgatctttgagactatccccgcattggtaaacttcgtggtattgtccatcaggtactgaaaggccttggtgtaaccctcacagactacattcgtagatgggtcacggtcaaatacagagataaggctccacggagagctgtttgtcctgtacccatccgcggcatcctgatcgtagcttacctgtcctgcgatgtaatccgcgtaggcttttatagtatcgtaaattcccttctttgaattcgcagaaatcacccgcgcggcctctttctcggcggctttaagctttgtgagagctgatttacttaaagtatgctccttatcctttccgcttccctgatagctctcgtctacagcaatataggctgtaaaagatgacgccttatggtttttcagcgtaactccaaccgaactgctcttcgaagataaaagatcctgatagcagagcagctccggatggttattcgaagcatatgtatagagcttcttccagatatttagtgcatcctgaccagacgtaaggtgcagtttgtacgaagaactgttaaaagtgatcttcgtagaaccgccatttttcaatattctccccagctcacttataagatggtcgtacatcttcttttcagatgatgagaggcggcctacaccccacgatgccatcttcagcgatgcttccgctcttgtcggtgtaaaaaccggtgtcgttaccatggcggcggtcagtatggtcactgcaaattttttaatgggtaaatatctcatagtactgctccatttgcctgaactttaatctaatcactgccctcaaaataaatataccaccttattttaaaaatgtccaacctgttcaggcacaacataaggcaggagaaaactcctgcctttcgtaataaaatatctttgagaaagaggcacaaatgtgtctcaagcctcctgttatttgatgactgtgagtgactcacgatcagcgaagatgaagacgaatacaaggaagatgattccctggatcagctgctgtgttggtgtagtaagacccatcatctggagacctctgttaaggactacatagaggaatgaacctacgacaacgttcaggaagttaaccttagcgccgcctgagataggcataccaccaagtactaaggcgatcaggatctttgtctcgagcatgcttccactgttgtatgtagcagaaccaacttttaatacgttgatgaatgctgcaaatcctgtgatagctcctgcgagtacgtagatcaagaacttcgtcttgtcagtctttatacctgcaaacttggctgctgtctcgcctgcgccgatagcctttaagtctgttccgaatcttgtgaaacggaagaagataaagccgatgatcagcacaatagctgtaagagttacaagaagaggtactgagtaaaggtttgtaaggtttgctgatgctgcaacaggtgtgttcgatgtcaggtacttgatgatacctctgaacaggaacatggtgcagattgtaactatgaatgacttgatctttctctttacatagaagaaagcgttgatcaggccgatagctgcgccggctgctacaccagcgataacagcaagtgctacgttgtattttgaaagagcacagataacaatcgatgcaattcctaaaattgaaccctgagaaaaatcgagtccgcccatcgtcatgatgaagaatacacccatcgatgaaataagtgttacatatacatcagagaatgtaagcgcaaggccctgaatcatttgtccatgtgtaagaatattgaagataacaaatatgatcaccaggccgacgataggaagtaatgttctcatcagcgacattctggaagcttttttcatagcttcgtcatcggtttctgccgccgtaactgtttttgttggcattgtgtttcctccttataccatcattccgatcagatcattttctgacagttcaggacttctcttaacttcgccgtttatctttccatccttcattatcatgattctgtcgcacattccaataagttccatcagctcttctgagatcataatgatcgacttgccctgcttgcgcatcttgtcgaggagctgatatatatcctgttttaccttgatatcgataccacgtgtaggactgtcgaatacacagatatcagaatcttttccgatccagcgggcaactactaccttctgtttgttaccacctgacagttcagatacgaactggtttacattgaccatctttacagacatttcctttgcgtatttattggcaaattcattctgctttctgtcgcttaagagatgtgacttacctgctatctgatcaagtgaaggcaggcatatattgtccttgatgctctggttgataacgactgactcgttatcacggtcctttgaagtgtaggcgatgctgtgcttgatggcagtcgggatatcgtttatctgtgtgccgtctgctaaggtaacgcttccctctctgtcaaatgatgctccgaagatagctttgccgacttcgtgcatacctgactctgaaagtccaccgaaacctaagatctcgcccttgtgaaggtcgaaacttacatcggagatgattcctggaactgttacatcctttacagaaagtactacctgatcagagatcttctcgccataatcctctctgtagtaagcgcctgtcatctcacggcctaccatcagggttctcaagtcttcctcggtaacatctgctgaatttacagtgtcgatatactgaccgtcacgaagaactgtgatcctgtctgacttgtcgagaacttccggcagatcgtgcgaaatgaagattacgcagccgccataatctctgacacggttcatatgcttgtagagctcttcacggccttcctgtgagagggctgtggtcgtctcatcgactacaagaaccttcggtttaaaatatgtagcttttacaatctcgacgagctttctgtcctcgaaattgtagttgtctatcatgtcgccggccttgatacggtcaaatccgaattctttcagaagcttgtttgcttcacggttcatggcgcctgtgttcttgaagccgccatggatgaatctctgctcatgtccaaggaaaatgttctcagcgactgtcagtcctgaaagagttccgatctcctgaacgataattgagattccctgatcgttggcttcgacctggttctttgcatttacttttttaccatcgaggataaactcaccactgtctatggaatagattcctgtcagcatattggtaagtgttgacttaccggaaccattctcaccgatcagagcgtggatagttcccttatatacgttaaatgatacattctgtacagcctttgtaattccgaaggatttgcacagattttttacttcgagtcttacctcatcactcatttttgtgttctcccttcgtaattatttaacaacctcaccttttcttaccttagttgtgatagcaacgataagaagaagggcaagacctgtgataacgtcctggatagctgtaggtgcaccaagagctatgaatccatagaaaataatgttgatgacgaactcaccaaggaagatagctggaagtggaattccatactttctgaatgcgagtccgaagaagcatcccatcgtaggtacgaagttacggctcatagaaagcattcctgtctgagcttccattgatgatccgaaactgatagtaaggatagcctcgattccgaagaatgcgccgctgataacgaatgcgagaaccttgtacaggtctacattgatacccatgttcttggcgacaaactcatctgaaccaatagcgtatgtgtaagttcccaacttagtgtaattcaataaaatgtatgcgatgataaatgccatagcagcaacgatcaggttgcccggcatttttccaaggcctcttacgtttgatggaagggtctgaagctgaccacctgcgaagtaacttccgagtgcctcgtagataagagcaagacctgtagtaacgatcattgaagggatgtgaagctttacatagaaaagaccattgcaaagaccaacgagagcgccggtaacaatacatccgattacaaatcctacatatcctaacccggtgtttgactgcaccagtttattagcaaatacacaaccaacaatagcagaaagcatgatatttgcgccgatcgagaagtcgaacattcccatgaccatgacgaaataaaatcctacagctcctgtagctgccataagtcctgcattgaagtatgtcatcatctggctcggtgaaccgaagtttgacgggctcagaattttaaaaatcagccacgcaacaaagatgaaaataaccagcatgccataacctgcaggcttgcctgtaaatttcttttttgctgctggtttagcagtagcgtccatacatttacctcatttctgaaagatttttattaagttgacaaaaaaggttttcaaaaagaattttacaaaagtttgaccggagcctcccggctccggccctttaaaaatcaaagtattgatttgtataaaatctgaattactttccagatcttgacttggcatcctcgatagaaacagatgctgccttctttacaagatcgtcatagcttaactttgacatctcaacaagctcatcatctgtatatgggagctgctttacgaagtacttatcatagtcctcgtagtccttagcagatgaaacatacagataagggaatgggatatcgttgaacttgccagcgaaatctttgtagttgcccttgatagcgttgtaaacgagcatgaaagcgataagaggatcgcagtaatgtccgcctgactcagctgccattgaaccattagcaagtctctttccaaggtctggaaggaagtctgttgaaactacatcaacatcctttgtcttgccttctgactcgagctctgcgatagcaccctgaagaggatcaccgccgccgcctgccgggataatagcatcgatctttggatctgcctgaaggagggcctggcaggccttagcaccaccatctgaagatgtaccagcgtactgtggttctgagagtttagctttatcgttaggatgtttcttgttccattcctcaacaccctgcttataacctttccaacggccgagccatgtagcatcaccctgctcccagccgataagacctatatcacgatcgcccttgtcaaggaggatcttgacgagcttatttccgttctcaacttcgttctcgtgaacggcgcctacatagtaaggtgaatctgtagctgccttatagatgtccgggctgttctccttgctgattacacggaagaactgtgcgagatataccttgttctggttgcatgtctggatagctgactgcatctctgtatctgaagagttgcagatgatgataccctggcatcctgcagctgcaagtgtctcaactgatgctgtaacctgctcagaaacatgtccctgatcgacgtactgaaccttaacaccaagtgccttggcagcctcatcaatgatcttcttacactgagaaccaagtacatctgttgaactccagatagaaacaccgatcttgatgtctccgctcttagctgagcttccggaattgcttgtcgatgcagcagaaccgctgcttgagctgcttgagcttccgccggacttagctgcggatgatccgcatccagcaagaagtgtcacagacattgcgccacagagaatggcgcttaagatcttctttttcatgtttaaccactccttttctccggtaccctgactgaaaccttttctgtcgggccctcgatcaactatgtataatttacatttttttagacaaaaaaggaatggacttatttttattttttggtaattttttcacaacttggttgtaatttgttcacaatttggtaaatttttcaccttttggctgtttcttcacagctcttttttgtatttgctcggcgaaatgccctcgacttttttaaacaccttcgtgaagtaaaagtagtccgagtagccagactgctctgccacttcctgcatcgagagggaggttgtagaaataagctcctttgccttctgtatcctaagcgaggtgacatagtcagaatatgtcataccgagcttttctttaagctgtgagctcaaagaagcagcgcttacgccgtactcttcggcgagcactgatagagaaatatctttaagatagttctcctggatctcaagtatcgccttatccgctatgcttaccgcactctcatgtgcgatctgcttgacttcctcctgattttcctcagaggtctgttccgggtttatctcctttattatcctctcgaggacattttttaaatcttcctcatgaatcggctttacgatatactcgtaggcgtttcccctgatggcttcctgggcataagcgaaatctgcataacccgatatgattacgactctggtatctggcgagagttcccctatatcctttaagagctcaagcccattctcacccggcattcttatatctgtaaacacgatatccggtttcagtttaccgatctcatctctggcagtcagtccattgttggcggagccgactacttttacagccagtcccgttttcttaagctgcttctgaaggccgagaacgacccagacctcatcgtctgcaatatatacggttaacaatttttcacctccgatttgctgcttcagttcatactgtccatgactttttttgtcacatggtcaagtaccgatattctaattgtcgtacctgccccttcggtgctgtcgatcataaatgtataggaaccatcgtaaaaaagtctgagcctttggataatgtttccaagcccgattccattgtttttctgcttcctgtttcgcgcggtatcgacctttatatcagttcctgtcccctcgacctcatttacaggctgcatgaaacggggcactttgtcctggttctcttccacaggagaaatgtaacccatcttctcatatgaggctcttagttcgtgcagtttctcccgcgggattccgacaccgttatccgatactgttatccgaagcctctcaccgtcgtgataaattctgacttttacatagccttctcccatcttctgctcgagtccgtggaagactgagttttcgacaagcggctggataagaagtttcgggagctgaatattttcagcatctttgtcgacatcagctatgatgtgcatcttgctcctgccggtttcaatgtcctccataaacctggcctcgatgatcttgctgtattttttcagattggcgacttcatcagctaccgtcacgacattggcccccttgaccgcatacctgaaaatatcagagagcgccatcgttatatcggctatctcctcttcgtcgttcatcagtgccataccgctgatacatgagaaggtattgtacaaaaaatgtggatttatctggtttctgtaggcgagtatctccattttctgtttcgagatctcgagctcatacagaaggatcttgttctccctgatctcatgtatgtttctctcgttctcatcgagcaggttgtcgaggctgttcgacacctttccgatctcatctatcctcttaggcctaaggcgcgctgccttgtttacggtcgcgctctcgataaacgtctgcaggttgtgtatcggaagagccatacgcatgtagctgaaaaggatcagtatggcaaaagccacagccatgactatgagcgttaaaaatatcagattgctgtactgctgttcctttccggcattagcctcgatcgaaacggcagtaacgatcttccagccgttttttccaaaatatcctgtagtcgaattgtagcggccactctggacaagcttgtctatgctcttctggttcagctcatcggtctgcatataggtcatgatgttgccattctgatccagaagctctaccgcagatgacattgccgaaagagaattcattatcgtatcgtccaaggctcttctgtcgagaaacagtacgcacattccgaccagttctctgtaccttccgctctttacgctgtactcaggcaggtaaaatgcataggccctgctgtcattgttgccgaaatagtagtccatattcatctcaacgacattcctgagcctcatttcaccttcggggagctggtaattctgtccaaatgaagctataaggttcatgtttgtgtcgtagagcttgatgccacggatatggtcctgcagaaggatcgtatttgaaaatacagtttttaaattgtcgatatacctgatcctctccagaggcgattcactgaaaaactttgtcacttctgaagagtatccgaacgattcggcagtaccctcgagtgaatcataatacgacgccagtgaactctgagtctgagtgagcgttgtattggcgagagtattggcgttttcattctctacacgctggaagtatttaaaaatctgctgcatcataaataccatgaccagaagtatcagcactatgatgatggccagctgaagagtaatgctctctcttatttttcgaataagctttttcatttttttgcactgcttttcttacggttggctgacgtattaaattctttcctgtttttttctatctgggaatttaaggcattcccaaggtcattattacgcagagacgagtaattttcaagcatctctgaatacagcttcttaaattctcccttcgattgggcagagagaatatcggagataaaatccgtcgtatcttcgaaaatactgttgtaattatcttctagcttctggtgatttttaaacattccgacaggtaatgtcagaagcctcgggtcgtatgtcttgagcccgggttctttggagtagacgccccgtaatttatgcagttttttgtaatgattggaattgatataagactgcccgataagtgttctgtcccacatcggatttgaaaaaacggcgaaagggatcacctgcgaatcatttgtcacatcgtcaagcatcttcccacctataacataatctaaaagctttgctgtgcccggcagatcgttgcagcttttgcttacaaatgtatttggcagagtgtatgaagaactgctcagattctgcagcactggagcggctccggtatcgcttcttactgcgccgctcgatacccagttgtcaaaatctatatcgagctcattaatatttccgatgtagcagaggacggaggattcagccatcatcttctggatctgcggcaaatcgtaagcgagatacgacgggttcagtattccggtctcaagcagtgtgtttgtaaaatcaagcgcttcctttccgccctgagtcgtccagatattctggtatctgcccttactgtcaagctcagatgctccgaatgaatatgccataaatgtaagcgagccgtctttgtaatgtgtaccgtcaaaaagaatcggtatcatctgaggatggtgaagtgtcctgtaatcttctgccttttttaaggctgaaagcatcccggactcagtctttacatcggaaatgtttatcccgatcttttcgaggagcgctttgttccagatgatcgtgttgttgttctctttaaagtcgtcatccctgtagccggtaggcagggcataccacccgtcgtctcgatacataaggtctgaaagtgtgccttccggaatattttttaaaatatcagaatcggacttgtactctaagaaaaattcccgcagattccagaccttgcccgaagagataagctgcctgataatattggaatctcttacggtaataatgtcagggagcttgttttcgacgagaaggagtgagagctccttatctgcgtcctgggcaggaatattgaatgtaagagacacatcggagtggtccgagatggctttcgttaacgttccatcccgaagagaccactccggagcattccaatctgagatatctgagaaaagagtaagatttaccggcttgctctttgcactctttgtgctcttttctgcgtcgccggaactgccagcactgttcgaatcgtggtaccagacagcgtacccgatcaaaagcatagcgcagaggattataaaagtcagtacaggtatctttaattttttcttccagtccattaaaaaatcccctttgtctattttacagacccgtgtgtcgggcagagatcgtacagaaaacactcagagcactttggagactgcgacttgcagatagtgcgtcctaaagtgataagctgtgtgtttataatgatccagtggtcctttggcagctccttcatcaggtcgaattcgaccttcttcgggtccttttctttagtaaatcccaggcggcgtgaaatacggcctacatgcgtatccacgactatggccggatcatcgaaaacgtgtcccctgataaggtttgcggtctttcttccaactcccggaagtgtcagcagatcgttaaggtcccgcggcatctcaccaccgtagacatcgagaaggcgtctggccgatgcctttatatttttcgccttgttgtgatagaagccggtcgatttgatgtcattttcaagctcttttatatctgcgttggcaaatgcctcgaggtccggatattttttgtagagtgatctcgtcacctcatttaccctggcatctgtgcactgggctgagagtatagtagcaaaaaggagctgccacggttcctcagagtgaagaaacaggggcagctcagttccataagttttatctaatctgtttaaaatctcttttgtgttgctgttcataaatatctccagctttaatctgcaaagatcatcgccccagaaaaccagtgaccaggcaccagatcccggctatgatcagcagtacagctcccgcaatatagaacttcggcctggaattaaatccatatcgatatcctgtatagaagccgagtaagaccataactatagttgccgcgaagataaatccgagcatcataagcggatactgcggaagattctggttcgacgacataaggccacaggcaagtccggcgaacagagtatagatggcgcctgcgagaacgatcctgacgtatgccttaacgctcatctcttcgcgcttttcctcaatctcctcgtgccttacagctttgtggataaggcgccccgcaagaacgaaaaagatgatgcccgcaagctcaactccaaaagagttcggattgtccacggcgttgtgaagcacaagctcgtgcgttataaaatatccacccagaaaaaatacactctgtatcagagtaaaaactaaagccgtaagtatcagcaccttagtcttgatcttggcgagcatagcgccccgtacttccaccgccgcatatacatcaaagctgattcccactattatcagcagatttccaagccagttcattaaagtcctccagaaccatttactttttacagactattatcaactttaatactatagtttaaaagagcctgctcttgaatattcaaaataattttcgtgtaaaaagggctaatacactttggaagttatgtattacttgtaaagattgccgatgatgtccatcagtgaatgagtggcaacatagatgaaaatgtccaccagttcgttcataggaacgcgcatgtcatccttgacccactcaatgatagcgtagcagagtgcctcactgaagtagtctgccacgatctcggcagtcagccattttttcgggagaagctcatctatcttttccctgttcaggcgcgaaagcgcgagttctgaaacggctttcttaagcgtgtcggcaaaagaattctgtccctcgagatacacgactcttgtgtaaaatgccttttcattctgcatagtcgtaagcgctaatataagagcctccttaagcataccgttgttaagcagcggttcagtcggctctataagctcgcgctttactatccactctaaaagctcatatttgtcctggaaatgattgtagaatgtcggacgtataactccggctttatctgtgatctctctgatggttattttttcgatagggcgcttcgacgccagctccttgaagctttgagccagaagcacatctatttcgtttgctccctgattcatcgtttacactcctaaatcagcagtttggtaatagtcaggttccaagcttttctgtcttctgtaaggtctatctcctccccggtttccctgatcttcactttcggccgcatgatagagcctctcctgttcgcaagaaccaccgccctgaatccgttcgaaagctcgacttcacagcctaccggatatacgcagagctcacggctcatcatatgtacgacaacaggatcaaactccatgccgttccttcccatgatgtactcgagaacatcggaaggcagataaggattgtgatagcttctctttccggtcatcgcatcgtaaacatcggcgacttttataattctagccaaaaacagtatatcattccccgctattctgcgcgggtatccgcccccgttgaaccactcgtggtgctggtacacgccctggagaacgtgctcattaaagttgtacttgtcctttaaaaaatcatagcccatcctcggatggtccatcatcttcgttctctcatccggcgtcagttttcgcggggcgttcagtatatcttcactgatgaacactttgcccacatcgtgcagaaaaccggccgttactatatcgcggagatcctgttcgttcaaaccaagcctggctccgagcactcccgaaagaatggcaacatccaccgaatgaaaatacgtgtagccatcgtgtgtccttatagttatgagattttcgacaacatcattgtcggatatcacatcgtcggtaatacggtcgaccacttgagaaagttccttctcagatgccgcctcgtgacgacctgcctttataaaaacgtcgtgaactatgcgcagggcagccctcctgacctcgctccctacgacttcctcagccttcgcatcctccgaaaactcctcgtcgatatagacacctggaactcccgtaaaaatgatgaagctgatgttatcctcgtttagtacagtgtgctttgagagcaggagcctgccatccgagtcgtatatttcctgacccaacaccatgtcaggttctaaatttttaactaaaacgtatctcatctgtactaaactggttcctcgtcaaattctacagtgacataatagcccttaggcgtctccctgacatcggtcacgacgccttctcttgacttaagtctctgcagagtagtgtaattggcagacatggcataagccctgccgagtgtataataatacgaatttggcagctttgattcagtaactggaaggcggtctccctttttaaggaggccggtcctctccattttaaaatccattgtcctcaaaacttaaattctcttttcattctacgatatgtgaatccacaacacccttttcggccctgtgaactctgataagcgaatacagtgatgtaattccatcgtaaataagcataatgccaattattatcatctgaagctttaaaagatcaaatgcgccgaggatacagaacacgccaaaggcaaaactgataatggcaagaataagcgatacccaccatttctcgattccaatgcctctcatcgtgactgcgttgttgattccggaaacaccgtctacaaccatcaccacaccgaatacgacgaatatcagcttcagcacatcgttcggtcttgaaataataaaaagacctatggccacaataactgctcccagaatgatcgccggcagtctgtagctattatcctttatcctgctgaatatcataaccgcaccgactatcacgatgacagctccgatgattcttcctattatggcagaaactccgcctgggttcgctacacagagaactccaagtaccagagcaagtattgcgataataagctcagatattcttgaatcctttgttttatccttattattcatactatcactttccttccttaatcgattcgaagcacagtctctccatgccccttgacacgagacttacagtgccttcctgattccagagagcagttcgtcaaatgtctcaaatgccgggatgtccggatttgctgcctttatggcatctgtactcttaaacagaaatcctgccttgctcgcgcggatcattccgagatcattaaaactgtcgccgctagctatcgtctcaaatccgatagactgcagtgccttgaccgtcgtcgtcttcgaatccttcactctcatcttatatccagtgatctcgttgccatcgacttcgagggaattgcagaagatggtcggccagccgagctttctcataagtggagatgcgaactgctcgaacgtatcacttataataatgacctgagtgatactcctgagctcgtctaaaaattctctggcgccgtccaacggctgaatacctgcgatgacgtcctgaacttccttaagtcccagtccgtgctgcttcaggaggtctatcctgtatctcatcagcttgtcatagtcgggctcgtctctcgtagtccttctaaactcaggtatcccggtcttctccgcaaatgcgatccagatctccggtaccaatactccctccaaatcaaggcagactatattcataatatcctccaaacaaaaactaatttccattttttattataacgataaactgtataaatatcaattgtaaaaaattcataaaaaaagacctcatccagccagggataaggtctaaatttttataattttttgaatattaaagtatatctatcatttctcctgcaagtgccttgttcatagaacgtactgcgcagaactttccgcacatggagcaggtgtctgaatggtcgtcctccggaaggcggctgtcgcggatagccttcgctgtatccgggtcgagagcatgcttgaactgctcgtcccagtcgagttttcttctggcgtctgccatcgcatcgtcctcgtcccttgcgcctgggaggtgctttgcgatgtcggccgcatgagctgcgatcttagaagcgatgattccgtttctgacgtcctctacatttggaagagccaggtgttcagccggtgtaacgtagcagagaaaagcggctccattcatggctgcaacagcgccaccgatggcagctgtgatgtggtcatatccgggtgcaacatctgtaacgagaggtccaagtacatagaacggtgcgcccttgcagatcgtctgctcgatcttcatatttgcagcgacctgatcaagaggtacatgtcccggtccctcgatcattacctgtacattcttctcccaggcgcgatgtgtcagttctccgagtcttatcagctcatcaacctgactgatatcagtagcgtctgcgaggcatcccggtctgcaggcatcgccaagtgaaatcgtaacatcgtgctctgcgcagatgtcaaggatctcatcgaaatgggaatagaacgggttctcctcgcctgtcatcgacatccatgcataaattaatgaaccgccacgacttacgatgttcattttgcgcctgccgtgtttgatctgctccagggttttcttgttgattccgcagtgaagagtgacgaaatcgactccatcctctgcgtgaagtcttacgacatcgataaaatcctcagccgtaagggtattcaagtctctctgatagtggattacagcgtcgtagacaggaactgtcccgaccattacaggacactcatgtgtaagcttctgtctgaacggctgtgtatttccatggcttgacagatccatgatagcatctccgccgagctttacagcctctttgactttctccatctctacatcgtagtccttgcagtcacgggaaacgcctaaatttacgttgattttcgttttaagagcgctgccgattccttccggatcaaggcacttgtgcgccttatttgccgggattacgacttttccctctgcgacgagtttcataagtttgtcctcgtccatgtgctcttttctggctacggtcacaagctgctcagtttttatgccacgtcttgccgcatccatctgtgtcgtatagctttctgacatgattcctttcctccaacaaaaaaagcggtaccctgataaggataccgcaggattaactacctacatgaccttcctacgccggcattgtccggatcaggttctcgggttcttctcaactgcagccaaagctgctccgtgccccgggtcatagtagattgtatactaatatgagatatttttcaagtacaattttaagctccgactttttcgaaaacatccgtgatctctttgtccggagcctttgtaagaagacttacgatcacatcaaatgcgagtgctgttaaaaatgccggcagaagttcatagatatcaaaagctccgcccaacggtcttacgaggaatttccagacgaagatcatgattccgcctgagaccatacctgcgagtgctccattcctgttcgatctcttccagaaaagcgcgagaagcattaccgggccgaaggtcccgccaaaaccagcccaggcgaaacttacgatctggaatacagagctgttcgggttccatgccagaaatacaccgagaactccgatacccacaagggcaagtctcgatatagtcatcagttttttctcagggatcttcgtgtgcagacacttagtcaaaatatccgaagtcactgacgatgacgcacagagcagctgtgaatcggcagtagacatagtagaagccagaattcccgagagcacgattcctgcgatcactgcaaaaatcgtaccgtggcctgcaagcaggtttgagaccttaataatgacagtttctgaatccgagcccttgagctgagggatcaggccgtttgagctcatagccagtcccgaaattccgatgcagactgaaacagccatcgagataagcacccagatcgttgcgactcttctcgaaagcgaaagctttttttcatcctcgatcgccatgaatctgagcaggatgtgcggcattccgaagtatccgagtccccacgcaagcgtagaaatgatgcggacgatatcgtaaggctctgcctttccggtaacagcattgtgggtgtgaagcatcgaaaaatatccggccagtcctctggcgtttccgatgactgcactggcaccgcctgcagacatggtttcaaataccaggactattataagagcggcagacataacgatgctctgcacaaagtctgtggtagaggcagcaaggaagcctccgagcatagtataggcaatgattacgacagcgcttccgatcatagccgtgtgataattcgtattgaaaaggatagcaaagagctttccgcatccagcgaaaccgcttgcagtgtaaggcacaaagaatacaatgattatgactgctgcgataaacgtcaggatatttttcttatcaccatatctgtctgagaaaaatgccgggaccgtgatagatccggtcgcctcggtgtacctcctgatgcgctttgcagtgacaagccagttgatgtaggttccagcagccagtcctattatagtccagcccgcatctgcgattcccgacaggtacgcaagtcctggaattcccatcagaaggtagcttgacatgtcgctcgcctccgcactcatcgcggtaacaagcggaccgagatgtcttcctccaatataaaaatcaccgacggtcttgttcctgttcgcgaccgctgctcccatcagaagcattgccacgagataaacgaccatcgtcacaaacattccgatctgcgctgtactcattttttctccttccatcttctactttaacgcattaaaacgttgatattttatactataaggagtcccctgtcaatgaaatgaatttttttcatgctgttgaagaatttttttcatttttttgaaaaaaaatagttcatttcaatctcagtgtagtataatatgactagtttaattttttcaggaggtaaacagaatgagaccagaagatattgactggggaaacctggatttcaactacagacagactgattacagctttgtctcgatgtacagggatggcaagtgggatgatggcgagcttacaaaggaccacaacatcaccatgaacgagtgtgcctgtgttcttcagtattcacagtcctgctttgaagggcttaaagcatatcacacgaaggacggcaaggtcgtctgcttccgcccggatgcaaacgccaagagaatgcacgattcctgcgagcgtcttgagatgccgccattccctgaggacaaatgggtcgaggctgttgagaaggtagtcaaggcaaacgaagcctgggttccaccattcggcagcggcgctacactctatatccgcccatatatgttcggttacaatcctgttatcggcgttaagccagcagacgagtacatgttcagaatcctcgttacaccagttggtccttatttcaagggagccttaaagccggttgaagttacgatccctgatttcgacagagcagctcctcacggaacaggcggaatcaaggcaggtcttaactacgccatgtcactccacccgatcatggaggcacacagacacggattcaatgagaatatgtaccttgacccagctacacgcacgaagatcgaggagacaggcggagccaacgtcatcttcatcaaggataacggcaagactcttgtcacaccactctcagattctatccttccatctatcaccagaagatcactctgctacatcgctgagaacatgctcggcatgaaggtagagcaccgtgtcgtttacttaaatgaggtagaggataacgagttcgacgagatgggtctctgcggaacagccgctgtcatctcaccagtcggccgcatcaacaaccacggcaagatcacgaacttcaagagcggaatggacgagatgggtccgacacttacgaagctcagaagcacacttaccggaatccagtcaggcgagattgcagatcctgataactgggtacacgagatcaagtaattctctaaaatcatagcaataaaatcagcccgtggctgccgtagcgcatcttttcttttcaaggtgcgccatggcagtcacgggcttctttttgtgtatgaataaccgcttccgaaaacagcccggaataaggcaaaaaagccaatctggtgaatagtttgcggcactcctgtattttctgcaaagcatttattatttctggctccgcgtttacggactctggcgtggctttcactctccgtccgtaatcctaagcttgcgtttacgggctcatgcacgtttttcgctcacagtccgtaatttcctgatcacttttacggactactgctcactttccatctccagtccgtattccctggctctcttttacggactactgctcactttccatctccagtccgtattccctggctctcttttacggactactgctcactttccatctccagtccgtattccctggctctcttttacggactctatcacatctttcattctcagtccgtaatttccttttgccttttgtaaatttccggctccgcgattgcccagattgaaaaaccaggccacattttccggtaggaggaaatcttttaatatttccggctccgcatcaaacccacattaaaatcaagtcaatgcatccaaaataaaactatttattaattttaacagcagccaattctatgactactgcaggcatccgccgtatgcgctggttgcgaatgcaacgttttatactgcaggtcaatgaacgcatccgccgacagcggtacggcgaacggatccaatgttttatgatgccagtcaaggaatgcattcgccgccgacggcacggcggacgaatgcgcgttttccgttgtgagggagcgcgctagcagcggcccgggcgaccacccgcctgaaacataaacgaatcagaaccatacattggtcggagggccgctattaggcgcgcgcgacagaacaggaaaacgcgtactgagtccgccgtaccgacggcggcgaatgcataacttgcacttccagtcaacatactgagttcgccgtaccgacggcggcgaatgcataacttgcacttccagtcaacatactgagttcgccgtaccgacggcggcgaatgcggaatttaccctgccagtcaacgaaacgagtccgccgtaccgacggcggcgaatgcagaatttaccggacatcagaaaataatatgcagcacaatgaccaccgcaaacgccccgaagatataaaaataccccatcacatcccgccttctatagtgcagcggcttcatacttgtccttccctcaccgccatgatagcacctcgcctccatcgcgagagccaggtcattggcacggcggaaagccgaaacgaagagcggcacgagcagaggcaccatggccttcgccttattaacaatgcctttgccgtcaaatgacgcaccgcgggccatctgagccttcatgatcttatcggtctcatcatttaagatcgggatgaagcggagcgcgatagacatcatcatcgcgatctcgtgcaccggcacatgaatatagttgagcgcccgaagcccggtctcaagaccatccgtcagctggttaggtgtcgtcgtaagagtcattatcgaagtgccgatgatcaggtagatcatgcgcacgagcataagaattgcggcgcggacaccctggatcgtaatctgaacctttccccattttacgatggcgtcacccggagtcaggaacaggttgaaaaggccacagatcaaaagcaggataattatcgacttgaggccgcgcaccataaaagaaaacggcacttttgagagcgctataatagcgaacaggcagacagtcaggaaaataaacccgatcggatcatctgcaacaaatatacttattatgaaaaaaagtgtggcgaccagttttaccctcggatcgagcctgtgaatgaccgaatctacctggtaatactgacctaaagtaatatcctttaacataatctattatccaaatacccgaagaatctcttctcttgcttcctctaccgtaacagcgtgttcatcgaccgggtagccctttttgtgcaggtcatggagcaggtaagtcactgaaggaactgcgagtcccagagactcgagctcgcttacatgtgaaaatacctcacgcggcgtgccgtcaaataccgggtgcccgctgtcgataacgatcgtcctgtctacatactccgcgacatcttccatgctgtgcgatacgaggattacagtctctcccgatttgtcgtgcatctcctttataaggccaagtatctcgtcgcgtcccgcaggatcgagtcccgctgtaggttcgtctaagattatgacctgcggcctcatcgcgataactccggcgatagcagctcttctcttctgtccgcctgagagctcaaacggagaagcgtcgaaagagtcctcaggaaagtggactttttttaaagcctcataggctctgagcccagcttccttgtcatcgagccccatatttttcgggccaaatttcacatcgtttaagactgtcgtctcgaaaagctggtgctcaggatactggaagaccattccaacactggtgcgcagagccttcttgtcgaagtctttttcagaaatatctctcccgttaaaatatacgtggccgccggtcacgggaataagcccgttaagagtctggataagcgtcgatttaccgcttccagtgtggccgatgattccaatgaaatcgcccttattgatctggagagagacgtcattcagtgcgtgtgtctcagtgcctccttccttataagtaactgaaacatggtcgaggatcaggaccgcgtcctcaggcgacttttctgcctttttttcctcgtgggaaggtgtcatttcaggcgcgccggacggagcttttatacgtgaaagtgaatcctcaagctcaggtcgcgtcaggacgccatccggcaggtccattccgtcttcctttaacctgaaagcgaggtcagtgacctgaggcaccgtaagatggtagctttttaaggtatttacctgagaaaaaatttcccgcggcgttccctgcatgacgaccctgccgtgatccatcacaaaaacgcggtcagagtagacgacttcctccatgtaatgcgtaatcaggataatcgttacgcccttctttttattcagttccctggccgtatctataacttccctgcggccatcgggatcgagcatggctgtaggctcatcgagtataatgcacttcggctccatcgccatgactccggcgatagcgacacgctgcttctgcccgcctgaaagacggttcggggattttttacggtattcccacatgccgacgccttttaaagccttctctgctctctcccagatctcatcggtcggaacgccgatattttcagggccaaaacccacatcctcctcgactaccgaggcaatgatctggttgtccgggttctgaaagaccataccggcctcttttcggacaggcagctcatttgcggggtcttttgtatctttgccgtcgacaatgaccgtcccctcggtcgggataagaagcgcattgatatgctttgcaagagtcgactttccggaaccgttgtgcccgaggatcgaaataaactgtcccggctcaacatcgagattcacatggtcgactgccgtatcgatcgattcgacattgccttcctcgtctcttctatagtactcgtatacgaggtcttttgtctgaataacaggtttcaaaatatgcctttcccgtcacttcgcaagtgacttgatgaacttctcaatacgattcagggcaatctttaaattttccatggaatatgcataggaaatacggataaagccctctccacagtctccgaatgcagttcccgggacgactgctactttttcggtattaagcagcgctgtcgcaaattcgtccgaactcattccggtgctctttatagatgggaacacgtaaaatgcgccgtaaggctcaaaacaggaaagtcccatgtcgcggaggcgctcgagcacatagatgcgtcgctcgttgtactgcatcttcatatcttcgacctcgcggtcgcagtgctttacagcctcaatacctgcatactgcgaagtagtcggcgcacacattatcgcaaactggtggatctttagcatctgctttaaaataggcgccggagcgcaggcgtatccaagcctccagcctgtcatagcgaatgcctttgaaaatccgttgatataaactgtcctctccttcattcccggaagagaggcaatagacacgtgatctgtctgatatgtgagttcagagtagatctcatctgtcatcacatagatatcgtgttctctgatcacctcggcaatggcctcgagatcctccctctccataatggcgccagtcgggttgttcgggaacggaaggataagcaccttagtcttcggcgtgatcgcattctcaagctcgcgcgctgtaaggcggaactcgtcagactcctttaaattgatgatgacgggaactccgttcgcaagaatagtgcagggctcgtatgagacgtacgatggctgcgggataatgacctcgtcgccagggtctaacatggcgcgaagtccgatatcaatggcctcgcttccaccgacagtcatcatcatctcagtctttggatcgtagtgcaggtcatattttctgtcgagataatctgacagagcgatcttcaagtccatgaggccggcgttcgatgtgtaaaaagtcctgccctgttcaagtgaatagatggcctcgtcccttatcctccacggcgtctcaaaatccggctcgccgacgcccagggaaatggcgtcgtccatcgtatttacaatgtcgaaaaattttctaatgcccgagggctttatctttgagattttatcgctgacgggatttttcatgaaagctccaccctttcatccttcttgtgctcatcgaccatgatagttccgtggtccttgtatttctcaaggataaaattggtcttggtcgaaagaactgagtcgagtgtcgaaagcttctcagaaacgaagcttgaaacctcacggagagtctttccctcgacagttaccatcagatcgaatccaccggaaataaggtaaaccgagcttacttcagggtagttgtaaatccttctggcaactctgtcgaatcccattcccctctgcggagtcacacggacctcgatcaaagctgtgaccttctcaatgccagccttatcccagtctataagggccggatagccgcagataacgtgcttttcttcaagttcggtgatgtttttctttacagcttcctcgtcctcaccagtgagcattgcgagctccttggtgtcaatctttgaatttttctctataatattaagaatcttttcctgcatgatgtctcctaatctaatacttttaacccaaaactttgtgaaattcgtcagcggctggcggctttaaatatctcgtctgtccgtcgtagtggacgactctctgattcgtgtcgtcacaggagccgatcactgcggcatgaattccctcttgttcaagagccgtgacaactttcgagccattcggcgccgctatgagcattgaaccacttgaaataagacagtacggatcaattttaaaatagtcgcagatctcaactgtctcctgtctcaaaggaattttctcgatgtccacagaaagaccgactcccgaggcttcgcccatctcccagagtgccccgaagatacctccttctgtgacatcgtgcatcgcggcagctcccgcccccgccgcaataagtccgtcctttacgacagaaagcatcgtattaaaatgtatcgcgttatctataaaatcttcaggaaatttctgcagaagctcttcttttttctctgaggcgatgatcgcagtgccctcgagtccttcatacttggtgactacaaggtccatcccaggcttcgctccggatgtcgttatcatggcatcacgctttacttttccgactccggtaacagagaggaccgggcggttcacgacatcggtcacctccgtgtgtccgcctatcacggacagattcagtttctcacaggaggcgtttacatcgctcataatggtcttcagctccgcctcattcgactcctcaggaagcagaaccgtaagaaggattcctatcggctctgccccggcgctggctatatcatttgcagtgatatcgaccgcaagatgccctatgtctatagcagtccctgtgatcgggtcagtagacatcacgaggacttcatccggctcacagagaactgcgccacagtcctcgcctacgccgctgcccagaatgacctcgtctctttttactctaagcggagctattaccgaccgctttaatattttttcaggaattttgcccggttttagtattgttgcttgctgcaggcttagtgtttttgttcccattatccttagaattctgattgctggcgcttgaatcacctgtgctcttctgtgtagcgttctgactgtctgcgccctgcttatccgtgttcttgctgtcagcgtttttactatcggtgttcttatcgccgctgtctgtgtccttgctgtcagtatcgtctgtgtcctgtttgccggcatccttccactgcgccgccgcagcttttacagtgtcgatatttccggaagctatagccgccttcattgctgaaacggcatccgccgagtcagacatggtcccgacagtgtactgttcatccgtcgctgcatatctcgaattgttaaagaccgtgcggctctcttctttgccgtttacctttacgatcttccagaggcgggccttaaggccatcttttccatcagatgtcttcgttactgtgccgacaggctgtgaagggtctgctgtgatctttgtcttcttcggtatggtatcaagcctttcagtctgaaactctaccgtcctcgacgggtcgcgcgtctccttaccgtataccgtaaacgttatgacgccgccactcgcgatcccctcaatatagacagggtacttcgtgctgttctggaacttgaaatccttataaaatccggcgatcgctgcgtcatctgaaggttctacatagtggaccatcatggagtgcgccgatctctcgaggactttaagctcagaccttatgaccgcattgtaaagtgtggtcgacacctgacagataccgccaccgtaggtgtctaccgtcgtgccattctcataggaaggagctggagcgtaaccgttctcggcagtcataggattcagggcctttgcgactgaaaacttgtctcccggatagaggatcgttccatttatcttcgaagcaccgttccttacattctgcgccctcgcacttgtcgaggtggcaaaactcgtcgagaactttcctaagacatctttcaccttagaaagctcctccttggtacctttcggcttctttgtcttcgtgacaagctttacagtatcggtcttgtcgtattttcccgaagagacatagttcataacggccgcaaccgatgcgtccatatcgagcctgtgtcctgcttttcccgctacatatgaaaattcaccgttttctctcttcagtgaaccgtcgacaggttctgtaacaagcttacattcatttttctttaaaaaatccctgatcttcgactcatcggccttcgtcgagagtgacaggcactttttctcccctgcttctatatccttaacggatttgtatctctcgatcagattgcctttcctgccgtactttatcgccgattcgaccgaatcgcccgagtccacggaaaatccaaggtctgaagcgctgacagtgatcttttgatcctctgtcgcaagtgtgatctgcttcttagcagcctcggccacgtattcactgatcgcattctcggcttccttcgatgtcatccccgagacatcgactttgccgatctctacattatctgctattctgctttctgctttcgcgtcatgagccccaaacaatgaaacagcgaaaagcgcccccgctgtcaaccccattgccataaactttttcatgtaaaatcacccgaaaagtgttatcatacctgtggggtcatcgccgcaataagagtgatgaccatggttcctacgaggacagcggcaatgatgcctgccagtatcctcgaacgtttctgacgtttacgcatagattctccttattagaaagactgacaaatgatactaacaattatatttatcgcactcgttctctggctcacattcgcaatcaggcactcccgcaaaaaaagtgaatccacctggaagagctactacgaccgtgagcgcgatgccgacatggccgaaaaccgcgatatacgtaatctacaatatattaccattccattcgaaaaatttccattaaatttttttgaaaatacggataatgaggactacccgattataatagatgagctgaaacagctcggaaagacccgtcttctcaacttaaacggcaagtcaaacaccgacttgaagctcgaatacggtcccgcaaacctcactgaaatgcaggagatcggcgaccgcttttcaagagtctgcgtccttttaaccgacctcgcaaagtgctttctggaagagggcaaccccgccggagccgccgcagtcctcgaatacggctctgaaataggcagtgacatctcgacaaactacacgcttcttggcgagtgctatcaaaagctcggtgagtcagacaaatttgacgcactctgcgaccatgtaaggtccatggattttttgatgagggatgcagtacttaaagaactttcggacatgaaaaaatgagcggcgcgatgcgcattcctcttcgctgcctgctcatcaatgacaaaaggaaagaggtaccgcctgtccctctttcgacaaccggtacctctctggtttgttttcgctatatctctctctgaatgatctgcatttataatatatcccttgcaatcaggcattcattaacaaatgataacattcatcgacgcgtcaaatgcttccactctctgttcttataattcagcctgcactaacttaaaccactgaaatgcagacttcaaatccgcgttaatagtttatgacctgacagctcttctgatgtgccaagattctgccaaaacttccgaccttttctcttctcggatcttcttctcactaattgtagctctacttaaagctcatccggtgagagctgaaataggtgtttgttttaaagaatttaaagtatctcatactttttaaaaacctaaagttttctgctcaccgccttctatgtgctgtgtgtataggaagcttcctctgtttctctatgtctgtatgttagtacaattttcccgtgatgtcaacagaatttctgatttttttgatttttgttggaagtgcacaaaaattgtcagttacttttgtgcatgattcccagctgactttacaatatctgcctcaaagtgcatttttgcattgccgctttgaacaacatgcggatttcgtgtataatatgaatgttactttttgcaatttaaaagtatctgggagttgtaaaaatatggcaaagagaagatcggatcttagtgtgatgaggattactgccaccctggctgtcatcctccttcatacatgcagtactatatctcagaatccggacatttttaaaataaataaggggcagtatctgctctttactacaattgtgtgcctgatgaactgggcagtcccgttgttttttatgataacaggcactctgatgctcaatccaaagaaaaaattgtctgtaagagatgctgtctttaaatatgcaaagaggatttttctggctttaatgatattcggaattccaatggcctgggtcgtggtgctgatcactcaccggcagatttcgctgaagctgatactgctcggcatattagataccatcgagggaaaaagtttctcgcacctctggtatctctatgcgataatcgggctgtatctgatcattccgatgttaaagccctatgtcaacagcacatcgataaatacgaagcggtatatcctgatcgtattattcgcgtttaatttctgttttaccctgatcgacaggcttttcaatatacatatagcctttgagctgccgatcgcaggcaactcggtcttctaccttctgacgggagaatacttgaacgagatatccgcagacggtgatattgacagaaagctgaatgcatttcttatcgctgtagtcgttggtaccatcatcgcaataaatataatcgcctatccaaaagcgccattatttctcggttacgacagcccgtttatcgctgctctaagcattctgatatacaggcagcttttcggcgtaaagtgcgggctgagacacctttggggtatagaccgcctgacatttggcgtgtatcttatacacccgatctttatccatctggcctataatttcctcggtataacgcctatggacttcaagcctcttctgctctcgatccttgtcatctgggcagtagtggttacactgtcgttcgtatcgagctatatcctgaaacatataaagtggctcagagacaacatcctctaactcttatcaataactctccagtcgaggatcagtatttttgaatctttttcgtaaaatgcaccgaaagaatgtgacgccttagtcagtttatttttcataaaaatcagtagtcgatacgcacaagaacaagcccctcgggcggtgccgtagggcctgccgcctcgcggtccttagcctcaagcgccttttttatgaagcctcgttcccgctgccctgaacctgcgaggataaggcttcctgcgatgatgcggacctggttgtagaggaatccattgccctcgacatggatggttattatgtcattttcatctcttctgacactgatggagtgaatcgtccgaacgaaggtgttcgtctgcgactttacagaggcaaagctcgtaaaatcgtgctctccaacaagcgcctgcgcctcttcatccatcagcgggacgtcaaggtttctgtgaaaaaagtacgtatacctcatcagaagcgggtccgggaaagtccggtttaagatccgatactcgtagaccttattagtctttgcaaagcgcggatgaaaatccgctgtaacctcctctgacttctggattacgatgtcgcgcggaagccgctcattaatcgcaaaagccattttttcggctggcatccggctgtcggtgtcgaagaccgcgacatttcccaacgcgtgaactccggaatcggtccggctcgcgccgatagtcttgatttccctcccgaacagatccgaaagcgcctgatttaatttttcctgaatggtgactccattcggctggacctgccatccgcagtagccggtcccgtcgtaggagactgtaagcttgacccgcatcagattccggcgtctttaagaactgatttcagtgtatctgctgacttgtgaagctgggcaagctcctgctcagagagctcataaggaatcagtgtatcgactccatcggctccgacgatagtaggcattgagaggcatactccatcgagaccgtattttccttcgatataggtcgaaacaggaaggatagacttctcgtctctgacgatcgcctcgcagatacggcggacgctcattccgatgccatagtaagtcgcaccttttttctttatgatctcgtaagctgaattcttgacttcctcggcgatacgggtcgtctctgcgtcgtgatccgtgtaacctctcatctcgcagaatttgtggataggcacacctgaaacatttgctgaagaccatgctgcgatctcggaatctccgtgctcaccgataatgaatgcgtgtaccgaacgggcatcgacaccgaggtgctgtccgagcagatacttgaatctcgctgagtcaagagtcgtaccgcttcctaaaaccctgttcttcgggaatcctgaaagcttcaatgctacctgagtcagtatgtcaacaggatttgcgacaacgagaaggattgcatctttattgtactttacgatctgaggaatgatcgatttaaaaatagccgtatttttcttcacaaggtcgagcctcgtctcacccggtttctggttggcgcctgcgctaattatgataagaccagcatcggcgaggtcaggatagtcgcctgcgtaaatcttcatcggcttcgcaaaaggaagtccgtggctgatgtcaagagcttcaccctcggccttgtccttattcgcgtcgatcagaacgatctccgaaaaaaccgaaccctgcatcagtgaataaaccgatgcactgcctacaaatccgcatccgatcatagctgcttttctaaaatttgctactgccattgtaaaaacctcctttgttgtatatccctgttcacgattatatagtatacccttctggggtatcttttctgttgtatttataacattttctattaaaaaatgcaaattattttcagagtctatccgcgcaagttccttctgacgcgattgatatggcgctcgaactcaccggaattcaaaagttctctaagtaccacctggtcaagcaccggaactgtgcaggaataaaaggcgacctttgataacagttccccgctcagttcatttggcagcaccagatatccgactctcgtcgcatgtgagatcgtgcggctgaaggtattaatatagagcacatgcctgtcaggctccattgaaaaaagagtgtcctcacgcctcgtctttacagtaaattcggaatcgtagtcgtcttctacgataaacgcgttcctgtgcttcgcccagtttatatattcggcccgctttgtcgcgtccgcggtagctcctgacgggtaactgtgaaaaggcgtcacatgcaaaatctctgctccagtctcctgcagtgcagatgacctgattccatccggttccatcttcagtttctcgactgagacgccattctgcacatagaccttctctatcatctcgtaggaaggatcctcgactccgtagaccttatcccgacccagcatcgcgacgactataccgtaaaggtactctgctccgcttccgagaagaatctgcgcaggacttacttccataccacggcttctcctcaaatacgaagcaatggcctcgcgcagatcgagcctgccctggttttcagacttgacaaaaagcttctctccctcatccgagagaactttcctgacggtcttcgcatatgtcagaaacggaaaatgctcgacagcaggtactgcaaaaatctctctggaatctggtgaaatcccggaagtctccctggcactgccgtcctcttcgtaattcccattccccgataaaaacgggtctgagtcgtcgtagctcacatagtagccgcttctctccctggcttcgacatagccctcctcggcgagcagatcgtacgcgtgagagatcgtaatcaccgaaagatgctcggtgtcagcgagctgccgtttcgaaggcagcttctggccgaatctgtaagccttccccgtgatctggtcttttaatttatagtatattttaaggtaagccggctgtctggtcatataaaaaatcctctaactggatattcacataatatcatgtaatgattataatgtccactaaaaatagaaaagaggtacgatcatatgcaatcaaacacaacaacgaaaactgtatcatcaacgaaacttaaagtgttagtccttgcagcactgtttgcagctctgacattcgtagggacattctacattaagatgcctgccggaaagggatacattcatccgggcgatggcttcgtcctcctgtccggaatcttcctcggacctctctggggcgggcttgcagcaggctttggctcaatgctttccgaccttgtcggcggctacataatctatgtaccggccacatttgtcatcaaggcactggtcgccgcaatcgccgcaggacttacatcccttatagaaaaattaatgaaatcaaagaaaaatgttgttccagtcattgtatccggagtcgcaggtgaggcctttatgatcatcggatatttcatattcgaagctttcgagaatgccctcgcagcatcgggcggattcaactccaaaacactcgccgcaggcattgctgcatcagccaccggaatcccagccaatatcgttcagggagtcgccggagtcgcaatcgcagcagtcctctacccgatacttcgtcctatcttaaacaggttcaatcagaatttataacatgatttggcggtcaacccttttaccaccagatcataatataaaaaagccgccggcccaaaagcccggcggcatattttttactgtgctacttttttaactacaaatacatctggcaggaatcttcctaggcttgaagcactcgaaggcttggtgatctgtttgcctctgtagatcatgatagaggagcttcctccgtctacactctgagcctgataggccttgtagcgaagcaggatgttcttgcactcagccactgtagtgcccagcgaatatccaggctggcggccatcgatctcaagcatcaggaaatctccagtcttggtctggcctatagctgcgcggggctggattcccatcataaacttaccatcgactacatccttgccatctacaacaagagacgggagtgactcaattccccacttgtagtctgaaatctttgtctggtagtaattgctgatatacagctttccgtcgttcttaagacctacaaatttccagtaacctctctgtggttctgccgtctctttgccatcgataacgcatgcgcctttgatcctgccgccgctgccgtgtccgcctgtatcaaagaaatagttacagttgatgacgacctcagcattgtatctgcttgcgtaattggctgctacttcgccatgtgaaccgatatatctcgacttctgtatcgagacctgattgatgtcctttacgactgcaagctttccgacatagccattgccgcttatgcctaagataatagtattgtttggagcatcgacagccaggatcttgtcgcccttcgagcttgtaatgtctgcagctgaattcaggttgtcaatcttaagcttattaagtccgtttgcagtaagctccggatgctgcttcagatagttcttaaacgaatctgtgtctagttcccagtatttcgtgtagaaggagttcttcttctttacagttttctttgctggagtcgtcttcgtatctgtatcccacttgctcgcaagcttctgctgatcttcctcatccttctgcagcttggacataacctcgtcgataatgtcatgaggtataaaagcctctgcaagccacttgtgcgaatgtgtggtcatcgcggtctggatatagagatttctcaggtttcgcaaagccgggatcgggctgaacacaaaaagtacatagcaggcagcgagcgccgcagctatacctacaattacatttcgaacgacctttccgcgcctgcgttttcttccactcttcatcgggcgttttcgtacgagtgcccccttgtgtttctttgaatttcttgatgagtctgccataattttccttaatttactttccttttaatattatctctgcgacgtcccctccatttgtcacaaagtatatgcattattgtaatttctttgtaataaaattgcaatcaattttttctaaaatatggtataattatatggcaatttttttaaggaggtaaaatcatatgtcttgtacgacattattagtaggaaaaaacgcatcgtggaacggttcgaccatgatagccagaaacgatgactccggttcgggaaaatttaccccgaagaaatttacggtagtagagccggaagatcagccgaaagtatatgagtccacaatctcgcatgtgaagatcgagctgcctgacaacccggtcagatatacggctatgcctaatgccttaaagggtgaaggcatctgggctgcctgcggcatcaatgagtacggggtcgctatgacagccaccgagaccatcacctcgaacccgagggttttaggcgcagatccgctcgtagaatatcagaagaaatgggaatctgagaacctctattttggcaccgattcggttatcgaagaggaaggctcagatgaggagaaagccggcggaatcggcgaagaggaccttgttgtcatcactctgccttacgtaaagaccgcccgcgaaggtgtcaggcgtctcggcgccctccatgaaaaatatggcacttacgaggagaacggcatcggaatttctgataaggacgaagtctggtggttcgaatcagtcggcggacaccattggatcgccagaaaagtcgacgacgacggcatagtcgttatgccgaaccagctcggcatagacagtctcgatatagacgacgccctgggtgaccaggagaccaacatgtgttctcctgacctccgcgaatttatcgagaaaaatcatctcgacgtagaaaaccacgattacgacgatttcgattttgacgacgatgatgatgaagattacgaggacgatgacgacgaggaaatttctgacgacgattacgacgatgacggcgagcttatcgacagcgactacgtcataaatccgcgcctggttttcggaagccacgacgatgcagaccacgtctacaacactccgagagcctggtttatgctccgctatttagacgatgacaagtcagcatacgacggtgatgacgccgactacaagcctgaggacgatgatctcccatgggaaattttctcagacagaaaggtaacccctgaggacgtcaagtaccttctctcctcacactatcagggcacgaagtacgacccgtacctgacttatggtgataagtcctgtgccggtgcttaccgttcgatcggtatcaacagaaatgatttcttaggttttgctgagctccgccctgacgcagagcctctcgagtggattgccttcggaagcaacgccttcaacacgatggcgccgttctacacgaacgtctctaagacacctgagtatctgtcgaatacgaccggccgcgtctctaccgataacttctactggtcttcccgccttctcgcaggcctctctgatgcgacctacggcaagtgtttaaacgtcatcgagcaatacactgactccgttctctcgaagtctcacgctctcctgaacaagtgggacgccgagctcgccaaagcttctgacgacaagaagcaggacctttgcgaagaggctaacgaagagatcgccgatatgctcaaaaaagagaccgacaaggccttaagcaaagcgctcttcttcaggtccaatgacatgtcgaacagctacgctcgttccgaccactaatgggacagtggggacggttctttttgtcccattttcacaattttcagataactttatccagagctggcacggtagtgccggctcttattttccggcttttttcgtgcccgctctggtattttttctgaatgccgcttcaatggcggcaaaaagcacggtggtgcgatggagacccgggatcgctgccctctcgatactttctgcagcattcctgtttacaaaaacatcttatcacacggttttggtattctggttttgctgatgtcgtaaggaatgactgttaactcgcatctgataaaacagggtaatctcacgccaggaaaatatctcacaccccctcgcagtcaaagtccggaataaagctctccttcgcaacgtcaccctcctgcataaaggcgttttctatgcccaggtccagtgcgtagtcgagcacttcgttgtactcgttttccgtgacttttctcgatagcgtcggatggccgctgacctgcggcattggcgtgtattgattcataatgcttaagaaaatcgaatcgccataggtctggtacaaatatttgatcacatttttggaatcgtcggcgcagcctggcagaagcaggtggcgtacgattgtcccttttttcatcagaacctccctgccctcgtccataatctcttcagcacactcattgtaagtggccgcatccatcgtatcctcggactcccaaagcccgagctgctgatcgaggcgcgccttcttttttacaaaaaaagcaggcgcgccagtctgacgcaccatctcatccacagcattttctgccacctcaaaatagtccggtgccttcgaaaaatccccagaaagcctgctgcttacatatttgaaatcaggcaggtaaatatcaacaagtccgtcgagctccctgatctgcgcgaccttctcgtacgacgaagtgttgtagacgatcggaacgacgagtcctctgttcttcgcgtcctcaagcgcagggaccacctgcggcagaaaatgtcccgccgtcaccagattgatattgttcgcccccttctcctgcagctcaagaaaaatatccgacagcctttcaacgcttatttccctgccaacaaggccgtctcttattttttcattctgacagaaaatacactttaagttacatcccgaaaagaaaacggccccagacccggtcgtccccgaaatgcacggctcctcccagaagtgcagcgccgcacgggcaacttttaaattttcacccctaccgcagaagcggcccatgccgcagtttctagggcaaagagtacatatttccataaaattctcccgaatttattacagtagattctataactttaattgactgaaaattctaaaaatgggacaaaaagaaccgtccctgctgtcccatcaatccgcatgcacttccgccggctcaccaaaaatctccgcaagcttctctttaccaagcttctccccaatcacgatcacaatgtcctgcccattctcaaccggcgccaccgtgaaatcatccttcgtgacattgacttccatccagcccttttcagcatctttgaaaaaacccttaatacgaatgatgccaccacactcaggatcattgatcgcagctgaggctttctcttttatctggtcgagcgaaaacttcttctccatgaaatagagcgactcgtatttgtgctcgtccatgacctgctgcttctcgaagccgtacgttttgaagccagcagactcgatccgcttgaaatcttcgtcggtaagatcattccaatccttagcaactgtttcagaagcctttaactttctgcggcagctgatcgaagccagagactcgttcaaatacttaaggatatttgaaggagcttcaggattattcagctgagtcttggaaaaaacaataacaccggcgttggctgcttcagaggcgaagacataccgtgatgtgtccgagagcggaagcctgagtccggcatcgactatagtgatatgcgctccggccttataccagcggttaagcggctcctccgaaagactgtcatagaactcgtcgacgtcgaaaactccagacggttcgaccagaacatgggtgtagccgatcatgcccatctctataagcttgcttttgaaacggcgtctgtggcagtcgctgtcgcagccgccggaaaccatctccatgtcgcagtgatcgccgagaaggtcggagatcagcatcatgtcaacattgacagcaccgtaatcattctcaaggatgcagatattttcgccctgtgcgagaaggtactttacatattttctaagaaaagtagtcttgccggagccgaggaaaccagtgatcaggtcgatcgttatcatagaaacctcctgagcctgtcacagaaactcttctggtctgtgacgatctcagagtccattccgaagtcgacagcgccctggacattttcagcccggtcatcgaagaaaatcgactcggccggatcgatactgtatttgtcacagagagcggcgtaaatatcgcggccaggcttcgtcttgtgaatcatgtacgagaccatgattccatccatatcttccatgaaatccgcatactgagtgtgtttatggaaaagagtcttaggataatttgacaggatgtagagatggtagccggcctctttcagctgatgcacgatctcccagacctgcgggcgtgggaccatcatatactcgccgtgcgttatgaaccagcggatgaccttgatgtcgtccgggtaaattttttcaaaatctgcaatgatctgctcgtcggtctcatttccgacgtcgtacttcgaccagatcttgagcgggcagtcgaacatctcgcgcccgatccgctctgcctcgtcaggagacagaccgtagtcctcaagcatctgcttccagcggtaggaaagaaggacatccccaacatcaaaaattatattcttatattttttcatgaaactattcacctcgcatatggaattataacagaattcgtgttaaaataaaaatctgaagagactattatttcgaggaggtgtttctatggctttaggtgctgtctcgggagccggctattacgacggctaccagaatttttctataaatggatatggcgactcgaagaataacgacgattctaagaagccggtcgtaaatcccggcgagtctgaaacaaagaagcctggcaggaaatcatctccggcggagtgtgagacctgcaggaaccgcaagtatcaggacggttcggatgaggggaacgtctccttcaaggccgcttcacatgtaagccctgaagccgcagggcctgcagtcatggcgcacgaaggcgagcatgttgcgaacgcttacagtaaggcatcccagcgcggcggcaaagttctcgcagcaaacgtcactatcaagacttctatctgcccggagtgcggcagagtctatgtttcgggcggagtcacgaatacgatgatcgcatacccgcaggcgagcacccagccgtatcaggcgaatgccaaatcactcgatgcagcgaacggagctatcggcgcgaatgtaaacgaagtcgcataagagtgacgatatggcttccaaagtatttcaatgaattttaaagattttaaagcaaaattttccataaatctgacagagcagcaggaagaagcagtacaggcagtcgaagggccggtactgcttcttagtgtacccggaagtggaaagactacagtccttgtaacccgcattggatggatgatctacggctgtggcataaagccggaatccattcttgtcctgacttataccgtagcttctgcccgcgatatggagcgcagattcgcgtcaaaatttggtgaggacctcgggagcaaggtccatttttccacaataaattccatatgccagcgcataatctactggtacgcgaaagccaccggaaatacagttttcgacttttcggactactccccaaaacaggccgcttttctaagccaggcctacaccaggacttccggaggttacgcgacagaatcggatctgcaggatatccgcacccagatcacctacatcaaaaatatgatgctctcaaatgaacagatcgatgcgatgaatgaggacctcgactacgatatcgcaaaaatctaccgcggctacagggagtttatgcggcagcagcatatcatggattacgacgaccagctagtctacgcgctcgtcatgttaaaaagcgacaggagggtcctagagcatgtccagtcgagattttcgtatgttcttgtcgatgaagctcaggacacctcgaagatccagcatgtgataatttcaatgatcgcgaagcgaaatgacagcgacaatctctttatggtaggcgatgaggaccagagcatttacggtttccgcggcgcctacccggaagctcttatgtcctttggcaaagtacataaaaattcaaaagtccttctgatggaggagaatttccgaagtgacgcacatatcgtgcgggcctgcgagcgagtcataaatcacaacgtgctccgccatccgaaaaagcttaaggcaagccatgcggcaaaggtcccggtaaaaatggtcgaagtttttacaaggggtgcacagcttaactatctgctaaaggccgcgtccgacttaaaggaagagaccgctgtcctttaccgcgacaacgagagcataatccccttcgtcgacatgcttgaaaagcacggagtcccttaccgcatcagaaaatctgaactcaatttttttacaagcagaatagtaaaagatctgacggacatcatacatttcgcctacgatccgaccaacacagaggcctttatgaacatctacttcaaggtccggacctatcttaaaaaagagaatgcccgcgtcctgtgcggtgtcagccagtcgagcggatgcacggtttttgacgcggcatacaacagctccctcttaaaaaggcggcagctgtcttcgatagaaaaggtggattcggatttcaggcatatagtaaaactatctggcaaagacgctctaagctgcatcctctactcgatgggctacctcgactatctggagcgttcaaagatggatacccgcaagctttttgccctgaaaaaaatatccgaaggtactcctgatctcagaggatttctgacgaggcttgattttttgaataagacgataagtgagaaggaaaatgatccgggtgtaccgctgatactctcgactatacattcgagcaaaggcctcgagtacgacaacgtctatctgatcgatgtgatggacggcgtatttccgaaggctgaaaagcctccgcagaagatcaccgatgcagataaagtgactcccgaacaggaagcatacgaggaggaacggagaatattctatgtcggcgcgacccgcgccaaaaagaggcttacgatctttacattcaaacacgcatcctctacatttgcaaatgagatgcttaaataatcacgctgttctcttatttttctttaggaaggtaatgtattcatcctttggaagaggtttgctgaaatagaagccctgaatgtagtcgatattcaggttctccatagcgtttaaatcctcagcggtctcgactccctcggctacgaccttgagagaaagcccctttgccatatggatcatcgagtccattataagacccacgcggctcgattcagtgtacttcgtgaccatcgatctgtcggcttttatgaagttaataggcatatccaccacataattcagattgctctcgccgtttccgaagtcgtcaagcgagcagctgcagccggcggccctgaaagcactcagattcttcaggagactgtcacggtctactatcatcgcggtctcggtgatctcaaagcagaacatctgaggaggcacatccgcctctctcatcttctgcagatacctgtccgagagagtgtcatcttcacactggagcaccgaaagattgatgtcgataaacttcacgccaagatctgcgagcccgccattctttatcaggtcgagcgtcttttcaaacatgatatcaccgatatttgtgacctgtccggtcttttcagttacaggaataaacatgccagggggaacaatagagccatcctctcttctgatgcggaccagcgcctcagctcctgtaaatgcgtcctcgtttgtcgaataaataggctggaaaaatggctcgatccgatcctccgcaatggcgttctcgacttccttcgccatgttcctctcctgcctcagccgttcgtacatactgtcagtcataacgataatattggaatctgagtactctccgttcacagagagctgtcctaaaagttcgaggatctctgtaacagaatcagcccttcgcccctgtgtctcaaaggcctcaatgaagtttatccctttctcctcacagaatttgtgagctctatggtttatctcctctgccttcccggaagcagccacagggtctctgaatacaatgatatagccggactgtccatcgtaaaaagtcttggaatgcggcagatttccaaaataattcgctgcgctcatcataatggcgctgtatctctcggatgttgatgccaggtcgtcgatgatcttcacataaatataggagaactgtaaatccttcttgtagaagtcctctatgtacatctggaatgtgcttaagttaaaaagtccggtagttcggtctatcctgatcacagggttctcgagttcaaggaacagaacgaaaagccccagcgctgttccgaaaccgacgagaagtaaattcggatggaagaactgaatccccgcagtgagacttccacacaacacccaggagatcatagatatggtaatattccacggcactctttttcggtaaatgagtaccatcacaaatgtaattatcaaaaaatagaacgagaataaatacgtaactatacaggaaggtccaaaggagaatgtgatattcgtgccattggtgtaataatcgatcggtacaacaaatgtcacagccgcaccggtaaggtagataaaaaagctcgcccgctgaatgatgatctcaccgtgctgggtgaccggcatcagagtcgtcgtataggcgaagccaaaatacgccataaacatcagcgcgatcaggtagagcttgcagatgatatcgacgacaatcgatggagatccaatactgccgccataaagcctgtcagccattatcgcaaatacagacacaacatcgagtatcagacagaccagtccaaccataagagccctcccaaaatagcggctgctcctcaggtcgaccttcttctgccttttataaaaatatgcaattattatcagcagcgcaatcccgcagcactgagtgacaatattcatatcattctacctgctaaaaaccattcaaataacattcaagtacataaaacattataacatagaatttggctccgggcacatttttcagataaatcggtcctgtcgcaaccgttttaccaacaattgttcctaatattattacaaaatgtggtagaattcttttataaaaagtcaggagatacagagacagattcatgaacgacaagattaaaaaacaggtttttactcatatcccggtttactcgggcgacgtgtccggagcagcttcagcgctctacgagttcggcggactcactgtaatccacgatcctagcggctgcaactcgacttacaatacattcgacgaactcaggtggaataagctcgagagcgccatctacatctcaggtcttaaagagagtgacgcgataagtggaaatgacgaaagacttatcgaagatatcgtatcagccattgacggccgctccagacgcccgaagtttatcgcgctctgcaactcccctgttccggatatcatcggcactgatttcgcagcgatctgccgcctccttgaaaaaaagaccggaattcccgccttctatgtccgcacaaatgctatgcacgattacacttctggcggcgcgaatgcttttctcacccttgccgaaaaattcctgggcggcccggatccatctggtacgaagtcagatcagctggattctgtcggcaggaatcaatctggcaattgcagtctccgggtaaatcttcttggccttactccgtttgaatatcccttcgatgcacagattgacgggctctatgagattataaaaaatgccggctttagtgtctgtgcgaactgggggaaaggcactgcagatcaccctgtcacctttgacgacgtggctatggctgcgacagccgacgtctcgctcgtgctctcttcctcagggataaaagctgcggagttcctccaccagaaattcggcatcccatacgtgatcggagatcctcttgcctcggatgaatttgcttcagttatatttaacgatttaaaagcacctttttccatgaaagtagttaaaaattcttatctgaatatactggatgatggaaagagcgattcaactgtatttatcggagagccggtgacaatgggctcagaggccgcagcatacgcactttcccacggtcatgcctcacttgtctgcacgacagagatgacggattctcttgtaagtgagaacacttcctgcccacgcggtgaggctgagattgccgagtctctaatgaaggccaatgttatacacggggatccgatacttaaaaacgccacgtctcatgggaaacgtggctttgacaggcggcaccagacatgggtggacgaaccgcacctggctatgtctggcagaatgtttttcaggaaataggttaagctgattttttattttttctaaggaatctgatatactcgtctttcggaagaggtttgctgaaatagaagccctgaatgtagtcgaccttcaggtgtttcatggcgtcgaggtcttttacagtctcaactccctcagcaacgatctttaaggagaggccgtttgccatgtggatcatcgaatccattatcaggcctacacggctcgactcagtgtacttcgtgaccatcgacctgtcagcttttatgaagttaataggcatatccaccacatagttcagattgctctcgccgtttccgaagtcatccagcgagcagctgcagccggcatccctgaaagcattcaggttgttaagaagactgtctctatctactatcatcgcagtctctgtgatctcaaaacagaacatctgaggtggaacgcccgcctctatcattttctttaaatatctggaagagagagtgtcgtcctcgcactggagtaccgaaagatttatgtcgataaacttgacaccgagatcagagagttcgccattttttataagagcaagagtctgctcaaacatgatgtctccgatgtttgtgacctgtccggtcttttcagccacaggaataaacatgcccggcggtatgatggtaccgtcctctcttctgatgcgtactaaggcctcagctccggtgaacgcgtcttcatcaatcgagtagataggctggaaaaacgcctcgactcttccctcttcgatggcattttcaatttcctttgacatggatctctcctgtctcatccgctcgtacatgctctctgtcagagtgattatccctgaatctgagtactcgccattcacggagagcagccccagaatttcaagtatctctgtgacagagtcagctcttctcccctctgtctcaaggccttccaggaagcttatcctgttctcgtggcagaatttctttagttctctgttgaccttatcagctgtctcttcagccgtcttcggattatggaatattatgaaaaatccatgctgtccgtcatagaatgcccttgaatgcggcaggcttccaaagtatgaagcggctttcatcacagtagcgttgtatctttcagatgaagtcgacagatcgtcgataagctttatgaaaatatatgaaaactgtagattttttctgttgaaatcttcgatatagagctggaaagtgctcaagttaaaaagtccggtaatcttatcgatctgagttcccgggttctcgagttcgagatagatgacacagagtccaagcgctgatccgaagcctactacaagcacctgaggaaaaataaactgaatcagagccacagccaggtcagttgtagtcagaaacatgatcgtcgcaaagactgtcctcggaatcctcttccgataatagagtgccatgataagtgtcgcaaggatgaaaaaagcggcaaaaaagtaagtcgctatacatgccggtccatatgaatatgtgatatccccgctgttccagtagtagatagggagaaccgctattaaaaccgcgataaagatatacagtgaaatagctgcgtgtgctatctttttctcaccctcctgcgttatcggcatctgagacaccgtgtagtcaaagccgatatacagcataaagatcagtgccatcagatagagcttgcatatgacagccgtcacaacaccagcgatctgtccgccataatagttgtcgtgtattatggcaacgattgagaggatatccagaaacaggcagctcagatcggcctcaagagcaatattgaacagataactgctcctgaaatcaaccttcttctgtcttctgtagaagaatacgacaacagtcaataacgctattccgcaaagctgagtaataatattcatatgattctctcctggtattatttctcactcactacctggaaaataataaatttcaaatagtagctcgtatccagtccccagaggatcgggtgatccggagcctgagtgctgaacgatacctgtctgagccgcttgtgtgctgcggtcgcagcctgccctatgacttttttgaataagtcctcagtcataaaatgagagcaggaacaggtggctagaaatccgccgtctctaacaagcatcattccctcgcggttgatctcacggtaacctttctcggcctgctttacggtatttttcgacttcgtaaatgccggcgggtccaggatcacaaggtcatagagcctgccctcccgcctgaattccggaagcgcatctaaaacatccgccacttcaaagtgtgctgcagaatccaggccgttaagcttcgcgttgtcagccgcctcctgaactgcaagctcagaaatgtcaaggccgagcacgtcctttgccccgcccctggcagcatttaatgcgaaagttcccatatgtgtaaagcagtcgagtactgactttcctctggatagattctgaatcgcaaggcgattgaatttctggtcgaggaaaaacccggtcttctgcccgttctccacatctactttatattttacaccgttttcgacgatttcggtaacaggattttcaggtctgtcggggaaatttttgtcaggattccactcccgctgcatatcgttaaacggcttttcaataaagccgtccttttttgtgtaaagccagcctttaaaaggcttcatgccctctttttttctgacaggggcatcgcttctctcatagatcccacggatggtaaagccgtcctctttcaactcttcaaggaggagacgaaggatcacaggctttaacctgtcaattccaagcgaaagcgactcgactacgagaaggtcattgtacttgtctacgaccattcccgggaagaagtctgcctcagaaaaaatcaaccggcaggcgttcatatcgactacatttctcctgtaatcgacagctgctcttactctctccctgaaaaattccaggtcaggtttttcttttctgtatctcgagagcatcctgactctgatcttcgaagcggaattgtaaaaaccccatcccatgaaatagtcatcgaagtcgaggactttcacaagctctccatcagctgtatcatcagaagtctcactgatctcattgtcaaagatccacgagccaccgctctttaagagacgtccctcacctttttttatctttatatacattaagcgctccatttaatatatcggctgcaccggtccaaataatcagcagatcctcggaagaagctcgtttcccggctcaggaagataggtctcggtgccgatcggtgtctttactgtcacatgtccctggtgctcgtcacttacttcaccaatcacagccgcgccggccgtatcgtcatagtcccgaagtatcccgacgatctcatccgcatcagatgacggtgctgtgatcaccattctgccctcgcaggcgaggtagagcggatctaatccaagcatatcgcagactcctcttacagctgagtccaccggcactctctcacgtgagatctcaatccccacaccgctctcgtggcagatctcatagagcacagtaccgactccgccgcgggtcgcgtcgcggactgcatgaatgtcatggactttcttaaagactgctgaaagcggcttccagagcggcgcgcagtcacttgtaacatcggcttcgattccatattcatctctcgaaagtaggatagcgcagccgtgtcttccgacatctcctgtcacgatgacggcatctcccggcctcgcaaaagctcccgaagtgtgtgtcccatatactatctcgccgacaccggctgtcgttataaagcacccgtccacctgtccttttccagcgactttcgtatcgcctgcgacaatggaaacgccgcattttcctgcggtctccgccatcgaagaaactatcttttccagaagagcgaccggatacccctcctctatcacaaaagagcaggtcaggtacagaggtctcgcgcccatacaggtgagatcatttaccgtgccacagacgcttagttctccgacatttcctcccggaaaaaatgccgggcttacgataaaaccatcagtcgacatggctatctggccatcaggctgcggcagaactgctgcgtcgtcagcagtaaaaaactgattttcaagatgctttttaaatacgtttgtgatgagctcagaggtctgtttgccaccagcccccatcgcaagagttacatagtctgtcataaattaaatattacactaaacttgtagaaagagcaataaattgctgatatgataagaacttcagcctgtcaggaagatgcatttgcaaagccaatccccgccgagaccagaagaagcgccagaagcgtcagccagttgaaagcctgcgcgccctcatttaaaaacagcgccgacagcaggacgccaagcaccgggttcataaatccaagcactgtgatcctgctgacatcgttatattttaaaagtatgctccagatcgtatatgcgccagccgagataaatcccatgtaaatgataaggacgatcgccgacgcgccggtcggctgcagctttcctcccgcagccaggccgataagcatcattaccgtgccgccacagaggaactgccatccggaaagagctgccgggtcgtcgtgggatgaaaatttctttacaaagcatccggcgaaagcactcgacagcgccgcaattatcatcgctccatctcccgctatcgaaaaatggccgaatgtctcgcttccgcctcccactataataaagactccgagaaatcccaggatacttccgagcacttttctgatattgagcttctcgaatctgaatataaaaacagccaggaatattgaaaagaaagttccagcggcatttatgatcgagcccttgactcctgaaatgtgggccagcgccatatagaaaaatatgtactgtattatcgtctgaaagcacataagcactgcgatatatcctgccgaggtctttttcggatggaaaaagtgcctgttcttcgcgctgaaaaaggctatgaccatagctccggcgatcataaatctgaccccggcgaaaagtatcctcgatggcgtgtcgtcggctggaatctgaaaaagtgcgtacccgcttttaatagctggtgaagcggaaccccagagcaggcagcagataaaggctgcaataaatacgacaaatgggttctgccaggcgatggttttatttttatcaaacataaattatcttctctgagtgggacagaagggacggttctttttgtcccataatcagacaattcagattatgggacaaaaagaaccgtcccttctgtcccatttcaaaaatgtctcgtagtctgcttcgttctggtcggcatagctcttcgcaaaacggaccatggcgtcggtgaatttttcactctttccaatgtaagccgcaatcgcgtggcggtcgccggtttttgcatgtgcgtgggcaagcgtcctggcgcatagcgcacaatagcctgtgaaatcctgctcatcgatcttcgtcaggtcgaaagctcccttgtaatcccagtactgtctgatgtaataatcccgcgttccatccggctcaggcaccctgacccatcctgtcaaaatatcaccataagtctgtgctgccctgagaccctctacaactctgcggctgtgctcgataaaatcggactttccagcgtatggctccagagcagactctcctgcctctttgacctgaaggaccagcgtgccgtgtttatcgccttcctcaagaagcagaagccagcagcgtgttccgacactcccgacgcccacaacttttctcgctgcatcgatcagccgatactggtccaacagatatctgcgctcccgcggaagacttaatctgtattctttcagcaccagcgtcagtaattttataaatttatcctgcgacatgtccagtttattttcgccgatcatatccctgacaggaactatcgtaggcggatccgaacggaaacggagctgaccgtttattttttcagtgtattttgtaatagccttctggctgtttttctcaagggccttttgcatggtctttctaagcagcgcctgactcatctcggtgatattttcaggatgacttctctgaagagtctccatatccagatgatcgtaccacacgtcaagcgcactcctggaagaatattctctcatcgattcacggtaaatatccgccgcttctctgagcgccatagttttggtctcttctgaaaaatttcggtcacgtccgcagacctcaatgctcgccatcatacgcttgacatcccactcccatggtgccggcagcgtctcatcaaaatcattgatatcgaagaccagatgcctctccggcgatgcaaatattccaaaatttgaaatatgcgcgtctccgcagtcctgcacatatattcctgtgtttggcatcgacccgaggtccgacgccattatcacgtcagtcgcacggtaaaaggaaaaagcagatgcgctcattctctcatggcggacaggtatcaggtcctgcaccctgctcttctcctgctcaaagatcaggttcactttgtcagtcctgttcttctttaattcccaattccccagagccgtgcgcgtgaccttttttctcgcagccttcccgcgctccctgccatcatccggcagatatctctcactctcagcaatctccctgcgaatcccatcgcgaatccttccaacaacagtcgataccacactcttcgaaatcagattctcttccatagttctccttcgcccgaacagcatttgatttatcacccattttacacgtttccgctcccacgttcaactgggacaccggggacggttctttttgtcccaaaatctgacaattcagattttgggacaaaaagaaccgtccccactgacccactcgggttgacttataagcgcattttatctaatatagggtggatgagaattcaacctgaaaaggaggtcattataaatgaaagtcacagatacagtgaaatacctcggcgttgatgacaccgaccttgacttatttgagagccagtacccgatcccgaacggagtcacttacaactcctatcttatcgaggacgaaaagctcacggttatggacactgtcgataagcgcggcagcgagcagtggagaaaaaatctcaaagacgcacttggcggccgcaagccggcataccttatcgtgcagcacctcgagcctgaccactccgcaaatatcggatggctggccgacgagtacccggagatgaagctcgttggaagcgccaagacaaagcagatgctcccgcagttttttgaaaaggattatactgacagattcatcgctgtaaaagagggcgatgagctttcactcggaagccacacgctgcagtttttcatggctccaatggtccactggccagaggtcatggtgacatacgagaagagcgagaagacgcttttctcagccgatggctttggaacttttggcactataaaaaaatacgaagatggtcattttgacgagtcggcagaaatgacagagggcttctggatctgcgaagccagaagatatttctgcaacattgtaggaaaatacggcggtcctgttcagactcttctcaaaaaagctgcgactcttgacatcgcgcgcatctgcccgctccacggcccggtcctttctgaagacctcggatattacatcgacaaatatcagcactggagcacctatacacctgaagagagtggtattcttctcgcctacgcttcaatccatggaaacacaaaagatgcagttctccagtttgcaaaggagctcgaggcaaaaggagagaaagttatcagatgcgacctgaccagagagcatgtttcgtatgcagttgagaacgcgttccgctacgaccgcatgatcctcgcagcctgcacatacgacggcaacctgttcccgccaatggaggatttcctctaccacctgaaatgcaaagccatcaagaaccgcagggtcggccttatccagaacggctcatggggtcctatcgctgcaaaatacatgaaggaatacattgacgccctgcatcttgaactcgtcgagccaatcgtcacgatcaagacaatgcgcaagccatcggacgacgcccagtttcaagcattagcagacgcaatctgcaagtaataccagaaataaccacgccaggagaggacacaaaggacgtctcgctcatatctcgcattttggcttgcaatgctgcgccaaaaagctcgcaaatgtcgctcgacgtccttgtgtcctccccggctggaattgctttatcttttttcctgccctggcgtggctgttaagtcgagcgcttccgcggagccggaattcactgtgcgctctgccgggttttcaatatatcgcctcagcacttcgagaatcaacaggcattatcaagtcactacattattttagtatttgtttatcaacatagcacttccggagctcaaaaaaattcattcaatttcaatattgagaaagcccggatacatatcaaaaaggggctgttgcaattctatttatatgcatttagcttttctggagctgcggggttttgtgagtgagaaacactcacaaaactatatcatgatttggtggtcaaccttttgaccaccaaaccatttatatgaaaaaaactcgtccgaagacgagccttttcataaaaaggggctgctactatagtagttaaattttcaacagccccatgattcgcggcggacgaatagttattactcaaagaaaagcttcaggtcgtcatcaactgttccgatacctgagataccgaagttgtcgaccagcacctttgtcacattcggggaaaggaatgccgggagagttggtccgaggtgaatgttcttgacgccaaggtataagagagcgaggagaacgataacagccttctgctcataccatgcgatgttgtaagcgataggaaggtcattgatgtcgtcaacaccgaagatttccttgagctttaaggcgatcagagcgagtgagtaggaatcgttgcactgaccggcatcgagaactcttgggataccgttgatatcgccgaggttcagcttgttgtacttgtattttgcgcagccagctgtaaggataacgacatcctttggaagcttcttggcgaactcagtgtagtactcacgtgacttcattctgccatcgcagccagccataacgacaaatttgcggatagcgccggattttacagcatccacgatcttgtcagcgagagcaaaaacctgctcgtgagcgaagccgccgacgatggagccggtctctatctctgtcggaggcgggcacttctttgcctgctcaatgatcggagtgaagtcctttttctcgccgtaggctgcgtcgatgtgtctgcatcctgaaacgcctgcagcaccagttgtccagagacggtccttgtagcctgcagccggaggaacaacgcagtttgtagtcataaggataggaccgttgaacttctcgaactcactcttctgcttccaccatgcgttaccatagttacctgcgaaattaggatatttcttgaatgcaggatagtagtgagcagggagcatctcggagtgagtgtaaacgtcaacgcctgtgccctgagtctgctcgaggagcatctcgagatccttcagatcgtggccagagataaggattccaggattcctgcgaacaccgatgtcgacctttgtgatctcagggtttccataagtctcagtgttggccttgtcgagaagagccataccatcgacgccatatttaccagtctcaagtgtaagagcaacgaggtcgtcaacagaaagagaatcgtcgagtgtcttggccagtgccttctgtacgaaagcatcgacatctgcgttgtcctcaagaagggcattcgcgtgctttgaataagcggcaagacctttgagtccataggtgatcagctcgcggagagatctgatatcctcgttctctgtagcgagaacgccgaccagatcagaagcagccttagcttcgaaagtatcacgggagccgtcccatgcagctgcatccggaaggttgtccttatttttaagctttgcgagaaggtccctctttacagaaagagtcttctcgatcgcgcttacgataacttcgttgtcgaagttggcgtttgtgatcgtcttgaaaaggttgatcgttacaaggtgattgacttccttgtcgatatctgctccctcttcgcgaagcctggttgtgacaactgaaagacccttggtcacatagatcagaagatcctgcagagctgcaagctccggcttctttccacaaacacctgaaacggtgcagcctttaccaccggctgtttcctgacactggtaacaaaacatcttattctccatctttacgcctcctgaatagctccaaccgggcatccgtccatagcctctgctgctgcgtctgcctgatcctctggtacctcgatatcctttgcatgggccttgccatcgtcacctatcgaaaaaatttccggacaggttccctcgcaaagtccgcatccgatacaactatcatcaactacatacttcattgaaaatactcctttcaaaaatactttcacattttatttcagcgtcagcaataatgccatcttaaatttgccatccgcaaataccgcatgctttccgcctgctgcaaagcggaaattctcgcccgctttgatcgggtgatctttgccctcgtagcggataactccgctgccatcgagagcgaaaattatcgcatcgccaggagctgcatgctcagcgaggcctgtgccctcgtcgaacgccattaccacgaacttcatattgtcattcgagacaatgtccatatttacgatcctgccagcctgatacggaacaagatcggccagcctgaaaacttcaccagcttttacaacttcattcatctgatcattcctccttaacgtaatttctgtataaacagacggctcctcagtcctggttccgaccggagtatcgattggagtaaggatcgcctcgcccgcctgcggcgaaccgaaaacgacgtccctgcccgaagcgtccctgccgtacacctcgacctttccctgatttacaagcacgatcttgtgactcgagtagatctcagcgctgatatcggtatgtgctccaagtgaaaaaatcaccaccggattttcaccgccatagaccgcatccgaaacagtgcatcccggaaccggctgattgtctccttctatcgaaaaaacttcaccagcatttctcttcatctgcctgccgtcctttcttttgtctccctcatttcgaatatgagtatacaaaatttagcagggggcgtatgttgtcaaaacaacattttttattttttcacaaaaaaggccagcactttttaaaaagcactgacccttatatctattgcacgcgtttctttcgtctgaacagaactatccccgcaagcattatcagcccagccagagaaattatcatacccgtgcgctttcccggcgcctgataggtgataacaatcctgtgttttcctgtatcccagtctccagacagtgacaggaaaccgagctttgtcttctggactgatacaggttttccgtccactgcggcagaaaagcccttgtcatatgggatggaagtaaaaatatcctgtccattggaaagactgccgtctgcgattattacatttcctttcgagcgcttcgtatcgaaattcagcggctgcacgctctttactttttttacaagtgtgttggcagggacctctgtcagcttgatgttgtcgagctcgtagtcaccgtgccttagttcccagcgaagcctggtctcatgagccgggaaatatatcgaatagctgaataccttgttccagttgtcgtagatcgcattcggggaagtccttgcgttcattacattatccactaagatccggacatcaccacgatggtctcgaagcatccctcttctctcccagattccaaaccacttcctgtagcgcttgttgtgatttatcatcttaaaggaaacccggatgatccggtcgtgatcagaaggattgatgtagagagtcttgcgttcggtaccgttcgtgcttacattaaaggatgttccaagccctggaactttaagcggctttctcttttcatcgtttaaatcgggctcagatcccgcggtgtagatgacaggcagtacatccttattttcatacagacagtatttcccctgcttgtcgatcagtttgtaattgagctcaggctcaggctcatgctttttcttaccatccgtaataatatagtggactcccatctgcgcattaaaatacggattgtaaggctggcagagtgtcgcggagtttctgaagcgtatctcatttccactcagcttatggtagtagacattgtaattccaatttgagacagatgaatagatcgtcgccagattttccctgtccgtgatcggcagattgaccggggtatgctttcccatataatatcctgtcctgtattcacctgaaatctgactgaactcgggcaggtcatcaccccatccggccggcgccagcttccctgtatttttcagatcgcatgataccagaagagctggaataataagcagagagattaaaatctcccgatatttttttgccggcccgtataaagcaatgagcagaacgattgccgtaaagcagctgtcttttagaaaaatccagcgcttgtctgatccgaacgtcacgaaaaatatcaccgtcatcggaatcgcagcacaaagtaattttttccatggcacttttctggaaagcgcatcgtcgagaaactgcgcctccatcagtgacatcatcggcaaaaatggaaaaaggactttgccatggatatacatcccgccgttcatcacataaattggcaacgcaaaaaatgatacgataagaaataccgcaccaagccatttccagctgcgcccaatttttataagcatgtaagccagaaccacaaccagcagtgccgtcgcaccgaatgaatccacctcatacatcatgtattcgccgtggaagaccggtatcacaagtgacgaaaatgatacagtcctgtgcccgccgcttcgtcccagaagagtgtaaatcgacggcagccagagcactgaagtgatcattactaccacgaccgcatccagtatcagtttaaaaaccgcagatatcacaccttttatcactctgccgccatggtcggattcagtctgacgaagccccagaaaaatcgcaaacactcctgccgcaataaactctgccactgcaaaaaaatagcagcagaacaccgcaagcgacatccatatgataaagcctgccgcacttctgcctctctctatctgtccctcgaacgagcgcaaagccatgataaaaaacggcatatacagaacgaacattatgtggtagtgaacgtggtgggaaaaacccgcagcaaggcagaataacagcgcagccgtaagggccggcattatacgatatgatcttctcagccactggtagataagacaagctgatacgatctgcgcgcagactgcggcaattatcagataagtgcgcatgccaagaaacggaaacagatacgacagcagcacccatggactcaggataccgtaataagcaaaataaaatgcgttctgtccgcctcctgcggaatatatgaaatccgggatcagtttccctgtcttatagaattcccgccgcaggagttccggaatggctgtgtgctgttcgctccagtccccgagcgccccgtacagcattctgccgcctcttgtaatccataacatgactgcaagggcggcaaagatgataacaatatacgggacgaattctgagattttttcagtacttacatccttatttttctgcatgagagacctttcgatctattattgcattttttataattattgctgctaataaaatcaggccaatcagggatatacccataccagagcgtttgcccggagcattaaatgtaatgacgacacgatgctttccagtgttccaattgcctgaaattgacagaaatccgagcttagtcttcttaaccgccactggctttccatccactgcagctgaaaatccattgtcatacggaactgaagtgtagattgccttattgctgtcgagactgccattcaaagtcagaatgttctcttttgagctcttcgtatctacaggcacttctttcacgctgtgaactttttctacgaccgccgacacaggaacctgggtaacctttatattattcagctgatagtctccgtgatgaaagttaaacgtgagctttgtactgtgggcaggaataaccattgtatatttaaatgtcttattccagttatcgtagatcgcgtttggtgaagtgcgtacgttccgcacatgattgatatcgatcttcacatcaccttgaagatccatttgcatcccttttctctcccaaacaccgaaccactttttgtaagttcccccgttatttttcatagcaaaagaaacccggattatccggtcatagtctgaaggctcaagatgaaagacctttttctgcgtctttttcgttttaatccgcatagaagactgcagtccctttactgaaatcagctcgcgtttttcatcattcatattgcactcggacgtggctgaataggctaatggaaggacattgtcattttcatataagcagtacttcccctgtctgcttaccagatgataaattttctcaggggcataatctttataacaatccgtgataatataacgaattcccatctgcgcacagaaataagggttgaatgcctgaaacagctttgctgcattcctgtaacgcatttcattaccactcttgtttttaaaataatcactgtaatatggattttcaacagaggaataaatcatcggtatataatcattgtctgtaattggcagattgattggcgtatgttctcccatcaggtagctggtacggaacgcacctgaacttttctggaaagttggcagatcttttccccaacctctaggaaccagatttccattaatgctgtccggtcttgctgcaacaagaatcgccggaattacaagcagtgtcataagcataccaggatattttttccagtgtttaagtaatagtgaaataaatatcaagacgataagtgctaaacaaaaatcccaggcaaaccaccttcgtttgaaatttccgaaagagataaaagtatagactgccaaaggaattgctataataagcagctttttccatggaatattttttgagatcacgtcatctaaaaactgtgcgtacattattgacatcagtggcagaaatggaatcaggacttttccatggaaatacatcccgccattcataatatataccggcagggcaataaatgacagaatcagaaatatcatactgagccacttaaagctgtggcccttctttatcagcatatacgtgagaactatgattagaatagccgacgcgccgagtgaacccgtaccatacataatgtattcactatgaaatacaggcacgaaaagtgaaataatggtaacatgagtctgttccgactcacgccccaggagggtgtgcagcgctggcagccagagcacagctgttatcaaaatcacaactatcgcatcaaatatcagttttccaactgccgaaaatatttctttccaagcatttccaccattactatcagcctgtctaagccccaggaaaatcgagaacacaccggctgctaaaaattctgaaactgaaaagaaataacagcataaaaccgcaagcgacatccagataataaatcccgctggacttttccctctgcttatctgcccttcaagtgagcgcaatgccataataaaaaatggcatatagatgataaacattatatggaaatagacatggtgtgaaaatccggaggcaaagcagaaaaaaagagctgccgtcagagcaggcattatgcggtatgatcgtctgagccactggtagatcaggcatgaagatatgatctgcgcagagattgccgctatgatcaggaatttacgcatgctgacaaatggaagcagatatgaaagcagaatcacaggactgagcaacccgtagtacgcgaagtaccaggcattctgcccgcctcctacttgagggaagaaatcagggagcagatttccagtcttgtaaaattctctgcggaaaagttccggaatagatatatgctgttcgctccagtctccaaaagtcccgtaaagatactgtccgcctttggtatgccacatcaccaggaaaaaaacgccaagaattatcagcagatatgggacaatctcagctatcagattcgttcgatcatccttattttccttcatcagaagttttctcctcattagaatcttttccttcattttctgaatcagagtcttttttaaacacaaaaaatttctgaccaatgtagttcattcctacgaaaagcaccataccaacgagcattgcagcatttcctctgaccttctcgcccgcgccacttaagaccagtttgacaagcggctttgcaaggccatatgccaccaggtagcagattgaaatatttacaataaagcggacgatctccctgcccgatttcttattgctcttaaatgtgaaatatttattcagaaaatagctgacaatactcccgactacatagttcatagccgttgaaaaccagtaaccgcagtgcagggcattgtacagaataaacatggtccctgaaccgacaagggtattaataagcccgacaatgataaatcgaacggtcgacccgtcgatcagtccgtgcagataagaatgcttattcttctggttttccatctgtaattcctttctcttttacaagatattgcggacggttcatatcctcttcatatatgcgatagatatagactccaaggccacgcagcataaaacacaaaattccactgcagaacaggatcaggctgaagacggcatccggcatcgtaaaagcgtgatgcagaaggcgaagcactatgattgatgcgatccagcccagaataaatattataccgacatatttcggcagcttaagagtccagtccgaatagctcgtaatgccgttcagtgcatatgagagcagcgacttcagatgccatttgctctcacctgcagcccgctctatattttcatagggaatccactcagtgtgaaatccgacccatgaaaaaattcctttggtgaacctgtggtgctctgtgagatttctcatcgcgtcacagaccttgcggttcatcatgcggaaatccgtggcgttaggcctcatctccacactggacatattattcatgacaccgtagaatcttctcgagaggaatgcacgtatcttactctcaccctcgcggtcttttctgaatgcagccgcgcagtcacactgcccactcgaaaccatctcgtacatcttcggaatcagagcaggcgggtgctgaaggtcagcatccatcagcactgtgtagtcggcatccagattctggaatccggcatagagggcagattccttgccgaaatttctggaaaaagacacatattcacagcgtggatctatgctgtggagctgccggaggatcccgagagtgttgtctcttgagccatcgtcgacaaacattatcctgaaacggacactgctcatctgatccattatcttatgcatctctttataaaaaagttcaagtacgtcttcttcattgaagcaagggactataattcctattgtatccattctttcctcatcctatcatctatcattccaaaaattcattataaagcaaaaattttctatttcatatgtgaaactttcacaaaaagccattcaaatattacctcatttttgacagcagttattaagaaagaatttatttaaaagtcaacttttagatgttacaatgaaatgaacaattaacaaacaggaggtatctgtatatgaaaaacatagtccggaaaatactgatctgcatgacgagcgctacccttggcctgtcgcttctgccatcggctgccctcgcttcagagcttccttcggatactgctgtcaccgaacagccgtcagctcctaccgaccaggcatcttccaacgcaacgaagccgtcggataataaagattcgaagccgcagatttcagccgcagaggccaagtataattcagcaaagaaagcatataattcagcaaaatcagccaggagcaaggctaaagcagcacttaccaaggcgaatagttctttaagtaaagagaagaaagccgtaaaaaacaaaaagaaatacgctgcccgctatttcgtcgattctctgatcaaggacaagaagtacagatttgacgcccagtacaacagagccagaaaagataaagacggcaataaaatttcaaagtactttggaaagaactcaaaagacaaggttcttctcgcatataacaaaaccaatttttcaaataccatcaggatgcttaagaaatgcaacaatctcaggaaatccgagggtgtaaaggcattaaaagtcgatcccgagcttatggtattaagctcgatcagcgcttatatcagccggtcatacactacaggccatgcatttgtcacagacaataacgcttcaatgtttgtagtcggagaaaacctggcctggggatacagcgatcctttcaaggggtggtatgacgaagagaaaaaggcctacaaaaagaacaaggacagatatgctgccggtcattactttaacattaaagaaaagagctataccgttaccggcttcgcaatggctaatccggataacagctggctggtttctgagcagagtttcagctttgacgacgaaggcagcaaaaacgccatgtctgtcggcgattttgaaaaagcctacaataagtatttaaaatccggtatcaattcccagctgaacaaggcaaagaaggctcaggcatcagcatccaaagcctacaagaaggccagctccaaatacaattcagcacgggatgccctgctcaagctgagccagccgaagctctcaggcaaggccggaaagaagtccgtcacccttacctggaccaaagtcacaggagccacgaactataacatttaccgtgccgcctcccaaaagggaaagtacaagaagatcgcaactgtaaaatccgccaaatacgtgaataagaagcttcgctccggaaagaaatatttctacaaagtccgcggatatcgaaaagtaagcaggaaaaatatttacagtaagtacagcactgtaaaaaatttcaaagtaagatagtctgatataatggccagaagtacggcctgctattaaggagacaaaagccaatggatgcaaagaaacgaaccgaaaaagcaactatgaagaaggcgatgcacggtctgagccgaaaggtgatgcttcgtgtgattcccgctgttgcggcagcgcttgtcattgtagtatcagtgctctcagtaaacgtcgcaagaactgtcgccggcctgtcttcacatgctcttcagaatgaatcagcgaaggacgccctggagattgagaatcagcttgccagtatcatgggatcattcaatgccacgatcgacggcgttgccaattctgaattcaagaataaagaggccgctgccgcagcactcaagccgtaaatgaagctcacaccaatgtctactagtggtgtttacatcggacttgcaaacggcatgtggatcgacccaagcggctgggtgccagattccgactatgtgatcacagacagagactggtataaactcggcattaactccgacagcttcgttatgggagagccttacgtggacgaagacaccggcggcattgtagtcactatctcaagaaaagtccacatgtttgattccgatggtgttgccgctgttgacttaaagattggaaagattgtagacgacgtatcgaagctcaagcctatgaaaaccggcggctctgttttgatctcaaacaagagcgttatttcatatttccataaagaggacaacggaaagactattgccgaggttaatgattcttacctcaattctttaaagactttggctgatcagaatccaaagggcgacaggttggtaaaatcatacgacggcaattcgtattcctgcgtattttcaaagattgccggaacgaactggactcttatctcttcagtaaattccaacacggtgtacagcgatgtttcaaagatggtgactcttggagtaattatctgcatcgttgctatcatcctgatttcgttactgctttacttcttcatcaataagctgatctccaagcctgtcgagaaactcaccagcaatattcttcgtattgcaagcggcgactttacgaagtcagaccgtgaagaggtagagaagaaggtaaacgacgagatcggtgctatgaacggctcgatgggcaagttcgtaaacggaatgcacaagactctcctcgatatcacgggtgagaccgaccagctcgctgacgctgcaaggaacagtgcaaacgaatccgctgccttaaatgaccaggccgctgagcagtcgagatctatggatcagattgccaatactatgaatggcatggctcaggctgtcactgagctcgctgagaacgccacgaacctggctcaggaagtagatggtcttacaactcagggtaatacgacaagcgatactgttcagaagcttcagagcaaggctcaggaaggccagtccgccatggcaaatgttgagaccgagatctcttctctctcccaggccatgactgagatgaacgatgccgttgaagcagtcggtaagagtgccgagcagatcacatctatcatcgagatgatcaattcgatctcatctcagacgaacctcctgtctcttaacgcttccatcgaggccgccagagctggtgaagcaggaaagggctttgctgtcgttgcttctgagattggtcagctcgctaatgattcagccgatgccaccaagcagatttcaaatatcatcgatgaagtcactgtaaacatcaccgctctcgccaaaaaggcccaggagaacatgaccaatatcaagaacggttccgaggccgtaagcaataccggcgagacattcagagagatattcaagactctcgatgagacaagcgagaccgccaatgatatgatcgcccgcgtcaacaaagtaaacgacatcgcctcctccgtagccgccattgccgaagagcagagcgcaagcaccgaggaagttacagccacagttgacaacctgacagcaaccgctcaaaacgtagccgaatcatcgaagaaggtaaacgcaagcgccgagacagtcaacaagtcagccgagagcatcgaaaactacatcaccaaattcaagctataatattgtgggacccctcattctcttcgtcccatttttgggacaaaaagaaccgtcccttctgtcccacttacatctcgacccaggttgatccgctgtccgcactctttactgcggcgttaataaatctgataccctcaaggccgtcttcgcctgtcgggaaatcgaggtcggctgctgtcggcttctcaccgttctttttcttgataagagttgtgataatattgcggtaatgatttgcaaatgcaatcgtcaggccttcaggatgacctaccggcagacggcttaaatttgcagatttctcagtcagatattcggcaccgcgggaaataatctggattggtgcgtcgaccggagtgtacttgagataatcaggagtctgctgatgccactcgagagcacctttatcaccaaaaatcctgaccgtaaatccattcagatatccggcagccacttttgaagcccagtaagtgccatgtgcgccattatcgaattcgagaagcatgttgtcgtttatatcaagcttatgaccgaatttatcagagatagcgcagatttttttaatatgaagtcctgtcacataccttacgaagtattcaatatgcgtgcctatatcaccaaaaacatgtgagatgccggcctgttttgggtcctctctccagatgcttccatccgtcgcgccaatctggtcgagcatagaatcctgaagatattcagcatctacattgataacttttccgatcttcccttcctcgatcatttccttcataaccttgacgacagcataacccggatatgtgtatgtgactgcaaatacaaggtctttttctttagcgagctttatcagctcctcagcctgatcaacttcaaagcaaagtggcttctcgcataccacatttatcccatttaataaaaattccctggcaatctcgaagtgagtgaagtttggagtcgtaattgagacaaagtcgattccatccttgcgggcggcctctttttcagccatctccctgtaatcgccataaaccctgtccggctcaacattgtagtaatctccaacagccttgtttgtatcaccgtttctgctgaagcatccagccacaagctcagcgcgctcatcaaaattgatagcgttcttgtgctttcttccaatcgaagattcagtcgaaccgccgatcaaaccatatttaattttcctgttcatatataacctccgttcaaatttgggacaccggggacggttctttttgtcccaaaatctgacaattctgattttgggacaaaaagaaccgtcccttctgtcccattatataccaattttcaggagaattgttaaagtctcgtaaaataagtgccaggctgggtgattaatgatataattgtaccacatggagggttttattttatgcaatcagggaaacacaaggcggggttaggctcgcagatggcgtatggcacatgcgaatttttcaatggcggagcctttgtaatcatcaatgctttttttacggtctttttgataaaggccataaaaatgaacccggctctggcgggaaccgttccgcttatagggcatatctgggacgcagtgactgaccctatgatgggaaatatcactgaccggacgacttcgaaaatgggcgccaagcgattttatatgttgataggagcggttgccaccggtattacatttgccacgctctgggtgccatttcacgcaaacggttcagttacgatgttcattttttatgtcatcatgtactgcctgttttcgacaggttctacgatccttatggttccatacaacggacttctgcccgatatgatcgatgactatgcgacacgttccaaattttcaaatgtccgcatgatctggtcgacgctcggttcgatggtctgcggagtcgtgccgacaattctcattacagatacgagaaataaaacagtatatctccagtgcggaatcattttcggcctgttcttccttatcacaagtcttatcacggtagccgggacctgggagaagcttcatcccgcaacgaaatcaaaattatccgacagcttcaatcacggcggcagcgccttcagaagccgttcgttccgcttgttcatcggtatctacctgacaggacagtgcgccacggatttcgtatccggaatggcagtttactatgtagacgatgtgataaacggctacaagaaccactatgtgacttatctgatggctgcgatgatcattgcgcagctgataggaatgctgatctggggaccagtaatggcgaagacttcgaagcgcacgacgatccttatcggcgcgccgatccgtatcgcaagcaccctgcttctgattccattttcacacgagggtgcaagcatcgttccaatccttatcctcgcaatgggcataggaatcggaaatgcggcaacgcttacaagtatttttgcgatcatggcagatatgccggatgtcgacgagctgatcacatccgttcatcgcccgggcgttgtctctggaatttcgaccttcgccagaaagatctcttcagggctctcttcatggcttattggaattcttctcgccgcagtcggatacagtgaaaaaattgcaaacgcaggcgacaggcagtcacttttcacacagagaggcatcgctggaatctatattttcatgccgataatcctctgcatactgttgctcgtcttcgcttaccgtttcccaatgaccggaagggaattcaatgtcattaaaaaagaaatcagcaggcgcaaaggcgaggactcgtccaccgcaacccctgaagaaatcaagatctgtgagaaagtcactggtatcaggtatgataagctctgggacccagccaatcagtgggtcgggaatcatcattaaacagaataaaaaagcaggcacgtaagtgcctgtttttttacatcacaactaattccataataaaactccaaattcagtcatttttcttagccttcactctgattgaaattctcccaccgatcatgtagatggctgcgacaagaattgcgatttccgtaagctgtggaagtatcagaagtccggcaacaagaccgattactttgatcaggatatctaccttcagatttttttcagccatggcaatatatccgcaggctccagtgccggcattatccttgttcagactgacataaaggccatagagattgagcgttgtgacaatgacgatcacgccatatatgaactggatcgtgcgctctgcattccatttgaaaagaaggctcgtcatatacggcataaacgatgcccagaatagaagcaagaggctgatccagacagtcctctgtgagacgcgctcgatcctgtcccaggcgatatgcagcgcagtccacatgcttccgagccagaaaaagctgatagcataggcggcgtatgccgggagcaattttgcaaaagctgcaaaagtcggttcgtcaggcttgccgagctcgaggaccagtatcgtcatgataatggcgagaattgcgtccataaaggcgccgagcctgtctttattgaaaaataatttcttatccatgatctacacctctcattcttttttgccgagctttttccattttacaatgaagtaaataatctcaagcacgcaggtcgtcatccagccgaccggatagccgaagccgacgagctgagccgtgtttgaaatataatgtgtcaaaacgaagaggtaaatctggcggatcgcgacgaagccaataagcataatggccattggtccgatcgaatctcctcttccacggagtgcggcggcaaggacatggtttacggcgttaaacatcagaaagaaacagttcgtcctggtaaacattgtccccatcgcgataacttttgcatcatttgtaaagaggttcatagcggccggcgcaaaaatccagatcacgacgccgatgatcccagaaatcgtgacagaagtgacaacagaatccacagttcccctgttgacacgtttttcatttcgcgcacctgcattctgcccgacaaaagtcgtcgcagccattgccatactctgtatcggcaggaaaataaacgagtcgatcttgttgtagctgccccagctggccatgcagattgagccaaaatgattgatgtagccctgcacaaaaatatttgaaaccgcggtgataaccgactggataccattcggcaggccaatgctcataatccgcccgaacgtattgcgttcgatctgcatatctctccatttgaacttgtagatcgcatccgtgtggatcagaaggtacattatcatgaccgcagagattgcctccgaaatgatcgtggcatatgcgactccggcgattcccttatggaaaacaagtacgaacagcaggtctccgaaaatatttaaaatgcttgtaaatatcaaaaagagcagcggcctttttgcgtcaccaactgcgcgcagaattccgcttccgatattgtagaggagcagtccggacacacctgcgaaatagataacgagatatgtgtgtgcttcaccaaaaacatctttcggcgtcgccataagattcagcagaaagtcagtgccaaaaatcccaaagaacgtgaaaagtgcgcacagcacaaaggtagtcgtaatcgtagtttcgacagcggtgtgcaggcgctttttatcttccgcaccaaaagcattgctgataactacagtggcacctactgaaaatccattgagaaaaaatactgcgatatttacgatcatcgtagtcgcactgatggcagcaagcgcctgcgtaccgacaaaatttccgacgacgatcgagtcgacagtattgtagagcatctcaaaaatatttccaagcataaggggaagcgcgaacgcgagaatatgcttctcgatcggccccttagtcatgtccctggtcttttgcattctaaattcctttcgggacaagggggacggttctttttgtcccacttgattctaaatttctttcgggacaaggggacggttctttttgtccctactgacatatatatgagaagcagcgccacagatgaccgggctcgcggccttaggatttttcgtcgtgaacgtgcgcgctagctgcggcgcggttgtccacccacctgaaccataaacatatgtaaaccatacattggccagagcgccgcaattaggcgcgcgcacgcgaacagaaaaatcctactgagcgggcccgaccatctgtggcactgcttctgacaagtgggacaaaaagaaccgtccctaatgtcccattagcagatttcgatcttgattgcacagtccgagagcggatatgtcgagcaggcgtgataatagccgaatttcttgtcggcgtagcgtcgcccatctccgactgacggtacgaaaacgtcgcctttcaacagcttgcagcggcagaatccgcaggctccgcttctgcagcgggtcgggttcgggatgccggcgcgctccattgcgacagctaacggctcgagacttgaggctttgatctctgtctcctcgagtccgcgcattactttaagcttgtaaactgccggatcgcgcttaggatagtcaggatccttcgtgatgtcacgaggagctccgaaaacttccatacggatgcggcgctttggaacattgagcttttcgagctcaccattcacgaaattgtacatcggaagtggtccgcagacgaagtatgtcgtgttgccatccgctggatcaccttctgaatatttgcggatcagatcagcgttcaaaaatcccttttcgccagggtagtcaggctcccctgaaattacgtttacaaaacgtacccgcgggctctggattgctgaaagctgtttttcaaggatgatatcctttgtagagaccgagccatagaggatagtaagatcacaatccatcgttccgtgagcaatttcctgcgccattgaataaaatggcgtgatgccggaaccaccggccagcgctacgaccttttttgcgtcgcggagcggctcatagtaaaactgccccaatggcagatggaatgtaaaagtgctgccctctttgcagttggcgtacatccagctcgatacaaatccaacgcccggctttccgtttcgaatagtcagctcaaaaaatgacttgtcgccctgtctggcctggaatggcgcagaactgatggaaaaaggcctagtagtctttgtcacttttccatcctcaccagggatttcaagctctacagaagcgtactgccctgccataaacggaggcagcacgtctccgtccgtcggaacaaaagtaaatttacgcgcagtcggactgacatcctcgaccttcgcacattttacatgagttaccttaggatgcacttcctgtgcgacttcgcggatatgatccttgtaaatattttccggattgcctgactcgatcagctgatgtctggctttcgtaactcgtgaggcaccggttacatctttaaaaaatccattaaccttcatctcatgcctccttcttcatctcggccagaatctgcatcgcagcaattcgcccgttatttatatttacagccattccatctccggcaagctggtggcttccacagctcacaagacccttaatatatgtagtgcgctcaatgtccgcaagccgcgcaacgatagagttctgcatattgtgctgataaccgtagacaccgccgcggtaactgcccacatagtgcgagatcgtgacaggcgtctcgacctcgatctcgacgatatggtcgcgcagatttacgccgagtctgcggctcacctgatcgatcatctgaccggcaatccttctctttgtctcgaaatagttgtcagccgttaccccgtcaaaacattccggaagcggaagttctgtgatggaaagcgaagtcatgccatcaggcactccctttggattggcataattcaggcagatagtcgtgagatagtcccagttgccaagcctgctgccctgtttccagaatttctctgtatccatcgaagtctcggctgaaaataccgagtaggagtggatattaagatcctccggcctgctgtctagaagcataacgacagagaaacatgaaaccgacatcggcatagcattggcatagcggcgtgcctcctccggtacctcggactgcggctctatcatacggccgtataccacattcggataaggacccgacgcaatgtaatcgcagtggatttcctcgccgtgagccgtgcgcacaccgtaaacttttccattttttacaagtatcttctcgacgttctggccgtactcgtactgaactcccatcgcctcgcagcgctcagccatcgccacagccatctcatgtgaaaaaccgcgggcgacgtagcttccgcccatcatgtaatcgcccatcagaaatgcatagatcgtaaaaggcagcgaatcgatcggctggccgacatagatccagtaagccgagaggatgcgcttcacattcagcgaaagcttcgggaacattttgtccataacttccttcgcagtgtagccggctgtcttcacgagctcctcgtggtcttttaacatctgaaatttgctcagcgtgtggtcatttaaatagttaaccgactcgtacaccttacggcacagctcaaaaagagcattcacatcgtccctgctgcccgggtactgctcctctatctcgtcagcagcgatccatgtgccgtcatcacggcggccggcgtgcagttcaatgtcgatgccgtcttccggagaaaccagatcatatgcctccggtacacgcagccactcaatagccaccttcatctcatccagatattttctcatcgggagcggatcatccaccggcccgatcgacatcatctcatgcagcgtagcttcgatctccacgccacccctgacaaaagaagtcgcaaccccgcccggaagattgtgacgctcgaggatcaaaacatccttaccctcagacgcaagcttaagcgcgcagctcataccagccagcgcgcctccaatcacaataacgtcatatttatctttataaaaagccatcaataaaccccttcactgggacagaagggacggttctttttgtcccaaaatctgaaaattctgattttgggacaaaaagaaccgtccccgctgtcccactaattaaaatactggtttgtaatcgtcagaattgaagaatctgtaaaccagttcctttgagtactcactggtctcgtccatgtcgccgaatcccatgatctcgccggcatagtaggtgttgttctgaccctgcatagactcgactttctggtaccagccattggcgtagtcttctgagaaaacatgcgggaaataataccaggacttctcgttaatgactttgtcgacttcagaaccacagatcttcatgtcgtcgagaaccatctgctttgcggtgtcatatggaatctcttctctgtccttgtggttacggagtgcgtaagtcgtgatgacctgatcctcttcgcctctccagcggcagtaataaaccatcagatgtccaaggcgctttgcctccatgttgtcaaacatatagtaagaaataggcggatactgccccttcttaataaggcatgcaagtacatcgtacctctcataatcgatcttgccaaagagctccttctccttgtctgatgcgtcggcatagtccgggaagaactgcagcggagcggtaacgatcagcttgtcgtactccttcgtctcgccgtttgccgtcacatagaccctgccgtctttacgctctaccttctcaatgtctgtagaaagctttgccggattcttcagatggtcattcagctgctcccagatagactgagttccgttcttccatgtccagaggttgcactttacgaagttcatggtcgtctggaaatccagatatttcagaacatatgcagctggaatctcgtcaaaatatccatatccgaatgctgtaaatggtccgatccagatatcctgaacaagatcaattccgttcttcgcacagaaatccttaaacgggagtgcaaggtctttgaggttctcattcgttcctgaaatccacttgccggtgccgttcgcgtcaaatccctcgtatttgccgtccgaaacaccgcggtgtccgtttatatcgtagccctgatacctggtctcgagaagtcttgccagcttcttggtctggttcttcatcttcagaagacgaggaatatttgacagcttcttggtatcaaaaggatcatataccttaccatcgagcgtcttgtaatttcggttcagtgacggtccatcgtgtgtgatgccgcagaattcctcgacatcgtgcacagcatagtaacttggaactcccatgatggcgcccatctcgtagcgctttccgtgatattccggagagttgcacttgcctccgacccatgcattcttctcaagaatctcgtaattcgtatacccggccttctccaggtacattgccatggaaagtcctgccggaccgcctccgataatacagattctctctgatttctcctgtctcataattatagctcccttctttgctattacttaagcattttaacagtataataattatacgacattgaggccaagtgtaaacattattgtccacccttaatatttatgataaataaaaaaacatggaacatgattttacttcttttctcgaccgcatctgtcgggaatatgcatatcgcccggccatctgtgagacaccagatgacacagcaaattttatcacatatgccgggctgcggcagcgaatcaaaaaccgcatagaggactttaggaccagaagacagtcgtcatccgcgcggtgccatccgcagcatggggattgacatgtttgcagcggtagaaggtggacatcagaccgtattagaagatataacggcaccggagattcccgcctcagtctttgactcagcggaggaatatcacccgggatgcctgctttttttcacgtcaggtacgaccgggagcagcaaggccgttgtattatcacaggcagccctgctccgaagcgcatggaacggcagcagatgctgccttgtcacaaggaagacaggctgctttcgatgctgccactctcccacgttttcggattatctgtacgcttatctggcctctttcacagggagcgtggttcagatcggacgcggcatgaggggatttgccacggatccgcgcgcctacaggccgacggttcttgcagcggtcccatcgcttcttggctttctcttaaagaccaacgccctgaatccggagcttcgcgtaattcttatcgggccggtccgtgccgccacgaactgcttgagtcggtcaaggcgatggacataagcgttttctttggctatggtctcaccgagacagccaggacttgcgaaagccagccgggtctcgacccatacgcgatggcgctctgcccggacacaaaggtgcgaattgctaaagacggcgagcttcggtgcgcacaccctgcatgatggacggatattttaacgatccagaggagacccgctcccgaatcgaaaacggcgagcttcacaacggagaactggcagagattaagaatggcgcattatatttaaaagaggaggaagagcgatgtactcgtacttgaaagcggggtaaaaattttctgtccggaagctgaggaaaagctccatgccatgctcggacgcgatctggcccttacgctgcgtcacaatgtcctgacttgtggtcaatgcgccgcagagcgactatgacgccatcacctcgaaactaatgagtacaacagagaccagcctattggaaaaaagataggtgcttaaactttgcgacaagccactgccgcgcacgtccaccggaaaactccagcgctggaaaatataaaaggaatggaaatttattatgacttacaccgaagatgagatctttgaaaaattaaaaggcatccttaagattgcatgcctgaagcagacctctccaagatcagagggactccgttataatgcgacctcggtgccgattcgatgaacttcatcatgattatggcaaaggttgaaggggcctttgatatcacagttccggacgagctctggggaaaactttcgacatcccaggacgtgatcgacgtcgtaaagaagctcacagatgaaaaagagctgaggaagctgcaaaagatgagcgatactttataaaaagtgaaaacggcggagaagtgaaagccgcagcgcagtcatctgttcgtctgacgcggacagctacagcagctgaggatgagccggcttttttcgatgattcaggagatttcgatcgctcacacagaatcccttggcttcccgcgcgagaccacacttgaccgcggcctgctctgggtcatcaccaggatgcatcttttacttacgcggccgattctctacgatgaaagaatccgcctcgaatcctggccagagcctatgatccacatggtctacccgcgcgggtaccggatttttgacgccagtgaaaaagtgatcggcgagtgctctgcgctctggaccataatcgatgcccgaaagcgcaccattgccctgccatcacagacaaatgtaataatcccgggatttgacagagaaaatgagcttccgcttccacaggggctctcagctcctgatggcggacagaccttagagcgccaggtacagtattcggaaatcgaccttaacggccatgtaaacaacaccagatattttgactggatagacgatctgtttgagccggcggctcacgagggcggactctacagtgagatccagatgaatttccagcacgagatcacccccggtgccgtgataaggctcacttcacagaccgtgcctgcgccggaatccgcgtccggccagcagattctgcatgtctccggcacgtctgacgggatgacagcttttgtggcggaagccacattgaagaacaacgtttaattgttcatggacagtgatttcataaccccttatcgtctgccgcaaagcgtttttttacatcgcggattacatactggtaggcgatggcatcgaagattcccgttaccacccaggcagccggatccccggctacgcctaacagatagctgttgaagtgaattgagagcattgctgtcgtaaatctggctgcaagctctaagactccgcccatcatcggcaggaagccgtagccgcagccctgcatcatatccctgtatataaagaggattcccaacggcatgtaaaaaataatcgacatatatgtgtaggtctttgcccacggaagtatggtatccatatcgacatttgatccgaggaacagcgggattgccggctttagaagcagcagcgctgtgcctgcgcctgctaaggacgcgatgattgaaatcacgattgctacgtgtgagcccctatttatcctgtcgatatcattctttccgaagttctgtccggtgtaggtagccatagcctggcctaaggccggaaaggcctgcgtcagaaggtttccgatttttgatgaggcgttgaatcccgcgattgctgtagagccgaacctgttaatcgctgactgcatgatcatggttccggatgctgttatgccgaactgcagagccattggaaatcctacgccgagctgctttttcgcgtagctgcctttaagcctccactcatcgcgatgtggaacgagaatttttacttttacaaggatgtaaaaaagacagccgacagctgagattccctgcgaggcgattgtcgctatcgcagctccccttacctcccatttgaagcaaatgataaagagcaggtcgaggaaaatgtttaatatcgctgacataataagaaaaaacagcggagcctttgagtttccgactgcgcgaagcagtgatgaaaaaaggttgtagaagcagactgcagccgttcctcccgtaataataatgatatagtcgtaggcataatggtagatgttcgacggggtgttcaaaaggcgcagaagccctcccatcgaaaccaccgatagtattgtcatcactatcgaaactatagctgaaagaattattgcattcgatactgactgcctgatccccttctcatcctttgcaccaaagcgctgtgacgtaagcacagtaaaaccggtcgaaagtccgttggcaaagccgaggactaagaacattatggttccggtcgaaccaactgccgcaaatgcctcttctcctacatatctgccgactatgattgagtccaccatattatagaactgctggaacatatttccgataaatatcggcaggaaaaatctcaagatgatcggcattggccgtccctttgtcatatcaagctgcataactcctaacactccttttctcaaagcttgcagtttttttactcatgcctatagtttaagataacctgcaatttatatcaataggaatcagtaccagttgaaaaatggaatccgctggagtagggatatcaaccagatccagccttcctatagtatacttatgcgcggccgtcgtgatcagaagtgggatcggatgaatctacgtgaatattttatgggaattactcaggcggcactacggacacactaagctaaaagtttcagtccgatgattccggtcgcgatcagcgcgatgcagatgacctgcgcgaggcttagcgcctccttaaacattaaaactccaagcaggctggtaccaagtattccgattccggtccagatagcataagcagttccgagcgggatttttttaagagccatcgagagaaatatcgcactcgcgatataaccggctattgtgacgatagaaggtacgagttttgaaaatccatttgacatcttcatcgccgtcgcccagatgacttcaagcacacctgctaaaatcaagttgatctactgcataaaaatcctcctaaaaataaaaaaataccagtgctctgtatcttctaaggcctaacgatacagagtctggtattaacatgagatttatttctcaatcaaaccacccggcggcggtaatttccagcaactataataaagcattcgatcagtaattctcagcgcgtacttcgaaatatgactgcggatgcttgcagacagggcagatgtccggtgcttctgtaccaacgacaatgtgtccgcagtttctgcactcccagaccttgacctcgctcttcttaaatacttcctgcgcctttacattctgaagaagcttcctgtagcgctcctcatgagtcttctcaatagcggcaacgcctctgaactgctcggcaagctcgtggaatccctcttcgtccgcttccttagccatgcggtcatacatgtcagtccactcataattctcaccgttcgcagcggcctccaggttctctgaagtatcgcccagaagtcccagagccttgaaccagagcttagcgtgctccttctcgttatcagctgtctttaaaaataaagcggcaatctgctcataaccagctttcttggcaactgatgcgaagtaagtgtacttgttccttgcctgcgactcacctgcaaaagcctccatcaggttcttctcagtctttgtaccagcatacggattcttcccgttcatcggaacgaaaacatctgtcttgtggcacttagggcactcctttggtggctgatttccttcatagatatagccacaaaccttacatacatacttcattgaagttcctcctttcgtaaccagcctttaatatcagccggtcattaacccttaaacattttttaccttagtctatattttatcattatcagacaattgaagcaatctttattttggaaacggcagcttggccaaatattgacagccttttaccacaggcctaaaatgaaaacgaggtaaagattatgaataaaagaagatccaaaaataaaaatataataatagcaggcatctcagctgtatttgcagtaatacctatagtcctcttctgcatattttcaggcagggtaaatacaggaaaaccgaaaaacacctggcgcacaaatatcagtaaaactgatgagaataaaaataaaacagcagccaggaaaaaatcgaaagagacaaaaaaggttcaaaaaactaaaaagacgactaagcccaaaaagccggagatcactgcggacattacaaacctctgcacacggctctcctggactccggtcaagggcgtcaacacctattcagtgtacagaaaaatggaagattccggatgggagcgcattgtcactgtccataagacctcatacacggacacctactacaagacattcagtcaggctgaaaaaagaagatattttacatggggaaaatattttatagacatgtcttcgcataccatttcctacaatgtccatgccgagataaactataaggactcaaatccgcagagcaaggcagtctatggaaaagacggatatttcaaactcaatgcgccgataatagttgaggcaagaagctataacaaaaatataatgcttacattttcaaatgttccctgtgcctcttattataatgtctactgcgcaaaactggacaccagcggcaaatacacttacaaaaaattaaagacaatcccacagaccgtctcacagtttacgaactgcagtataaaacccgccgaaggttacgactattttgtagttacggcatttggaaaaagaaatggcgagactgtaaaggcaaagtctgacagctttacattgaaaaactctaaattttcaaataagaaaatcttgtttataggcgattccattacatatggcacgccttattacgctgtttccggaaggaaggtatattcatatccgtggcgcatccatgagctcacaggggcctactgcaacaacactgccgtaggcggcgcgacgcttgccgacaacccgcagaccagaagtgcccgcaacagagtgataataaatgtcgtcccgcagatcaagaccggatacggcaccgggcttacgtttaaagattatgatgctatagtcatctgcgttggtacgaatgattacaccgacgggataaggctcggaagtcttgattcaactgataaaacgacatattgcggagctatgaatatcctgcttcgcacgatagcagacgccaataccgcccgtgtaaaagaaggcaaaaagcccttgaccgtggtaatgcctgatttattttacagtgacaactaccatgttccgtcagtgccagagagcagatacgacacaaagaatggcttcggcaacacccttctggatttcaatgacgcgaagaacaacatagctgaaaaataccagaaaaaaggcctcaacatcatcagatttaaaaccgacagcatcgtaaacaaaaagaactgcgcttatgccactgttgacaatcttcacatgacaaaatatgtctacgagaaaataggcgacgcactggctgacgtgatcgtaaacgattgggaaaaataaagccaatttggtattgaagcaaataaaaaactgcattataattttaagatatgggtgtcaaaagcactacaaatacaaaggagaagtaaaaatgtcacagaaaacaagccttaatttctttggaaagataactgctgtcactcttctcagtgctgcagctgttttttcattaaatgtaaaagacgcaaaggctgagacaagcagccagacaattaacgtctcttcaagcgatatcgaagataggggagcataccgggcaattcaggctgccttaaatcaagctgaagaagaagcaaccagccagaccccgtaccgcgttgttgtagccccgggaaactatgaattaaattcgactctccgtgtctacagcaacaccgatctggtactcgacggtgtcactttacaggagagcaaagaaccagaatccggtacgaatatgattaaagtcggcgactcatacgatcagaattccggttattattacaagaatataaccgtcgaaggcggtacactcgataagaatggcagcaatgccactgcattaaaggcagttcatgtagagaatttcactctcaaaaatatgaccattgagaatacatataattctcatcttatggagaccgcaggagttaacggccttaatatcaatagctgcaccttcaaaaatcagactattgatctcagcaataattccgacatagaaaactcctacgaggctatccagctcgatattcttatccctgagcatctgcagggatatcttccagaggcactccagacgaagaatgtccagatcacaaactgcacatttgacagtgttccgcgtggagtcggcagccacactacttttttgaatgttccatttgacaacattcagatcaaaaataatacattcacaaacatgggcagctgcgccatagagggaatgaactggataaactgcaccatttcaggcaacactatcagcaattcaccacgcggtatagccctctattccgtccgtgattttaacacctatcttccttcgtcagcttccaaagaaggtggggttgcatcatcctactccgacaaatacaagaaaccttcgacgaagcagaatatcacaatttctggcaacattatttccagcagtggaaaagataagtacgctccatatgaccctctcggcattctgctcgaaggtgtaaatttaaaaaagagtgtaacaaatccaaaccatggagatgtagtaccgagaggcaattattttatcagtggtgcaacaataacccgtaacactatcacctccgatagtcatggtatcaaacttattgatgcaaagaattctacaatttcttcaaacaagattacctgcactgcaaagaagggctctaatctccacggtattctgctgataaaagaaagcacttctaacaatataaataataacacgatcaaaaatgccccaagcaacggaatctacgtaaacaccaagtcgtcagcttcttcgatcaattcaaacacgataaagtccgctggcaagtacggtatagatgtagagggagctagtgcttcgactatcagcagcaacaagatttctaattcaaaatcaaacggtatctttattttcaatggttcaaacgttaaaaaaaccattaagtctaataccataaagtccgttggcaagtacggcattggcgttgatactaaggccaaggttactaccattgagaagaataatatctcctctcctaaagcaagtggtatctatgttcgtaataagagcgtggtaaagaacattaaatccaataccatttcatccccaaaaaaatacggtattggtctcgatcacgcaacagttaatctgatccagtcaaacaagataacaaagccttcacagaacggtataaatgtctacgtatctaccgccaaaaagatttattcaaacaagatttccaaaggcaagaaatttggcatcggcatttatagctgtaaacataagccaaagctgaaaaagaattcgatcaagtcctgtaagaaaggcaaaatagaaaagtaaaaaagcggcgagtatcttgacagaagatggacagaaatggctgttgagggcgctgattaagaattttcgttactattttctcacctcaccttccactcatcgatatttctcttgctgcttgagaagttcgctcctatctcaatgatctttcgtttacctgagctatacttctctgcgtagcccttcgcctctatctgctctatagcttcctgtgcactcccgtctaccttcagctccatgatatatacatagtccggcgtctccataacgatatcgctcctgccggccgaagtatgctgctcacatgctacgaattcgcctatcagctcgaagatgaggaatatctgatttctccatacctcctcatatgaagcagcttttgtagtcatatatggagccgaggcaaaaagtgacttaagctgtacaaaaagagcatctgtgtcgccttttctgatagtaagcaccagatcccgcacagaaaatcccgtctgcgcatcccgttctccaagcacagatggcaccagagctctgtaaaagccatactttatctcgctgtttggaaagccaagagtataggtaaaaaattcctcatcatacgactttatcgtcaggtatcccgactgatagaacagcggaaccggatcagggtcatcaatccgatagtccatgatgtcagactcagctactgtaataccactttccatttgtgcaggcgttataagcgagttttccattctatttatgatcagctgtggtgaagcagaaccgaaccagtagtagccaagtttttgatcggacaaagcattgatcacactgtaaggattgtacactcccttagaattccctgaaaaatgatatccgtcatacttttccttcatctcctgcaggcatttttccacagatatacccttgttttccgccatctcctctatctcaggcgcaaaggaatccgttatctcttcacccgtgaacccgcagatccctgaaaactcatcgagcagtgagatgtccttcagctgatttaaatctgagaatacagatactttcgaatacttcgtgactccagtgaaaaatacgaactccaggtatctgtcctgatccttgagcaccgaaaaaaatgccttgtaaagctccctgttccgcatctcctgttcagggtcttctgccttaagcagcggattgtcatactcgtctatgagaacgactacagggctttgagttttctgatatagtttttctatcagattaaaaaatctgaccgagaccgtatcccctgtgacagagtactctcctgtcaatccatatctatctgcacagctatcaaggattgcaccgagcttatcctcgagaccgatccgactgttgaactctccgctcgccaggtagaacgggatcaccgggtatgtcttccaggcgccatcaccttttttctcctctatctcagagatctcaagtcctctgaacagttcttttttcccgagaaaatatgcctccagagtagaagtaaagagactctttccgaatctcctcgggcggctcaggaatatctcccggctttttttgcgcagtttctctatatatgcggtcttatctacatagaccattcccttgtctcttaaagtctcaaatgtctgtacgctggtcggaagcagtctctccatagtatcagccgtcctttcagaagcttgctctttgtctcgattatagcataaagaaagcggcctgaaaacaggccacacaaacgattgattgtatttgtctttggcaaatactagtctttatcttcaaatcctgaaatagtatacacattctcctggtcaatgctcgattctccctctgttagaagatctatcgcgtatatccctacagtatctggatcattcacatttgcagaatatacacatatatcaagaatgtattcttgaccattttctgtttttatatggcgcagctcccaggcatcgtactctttttctaattttccttcactgacagattttgacaacacctcttttgatgtcatctgccatttgacaatatctgatcctaacgcatcaatcagctcttttatctgctttttgatacctttttgttttttaagcttaggactgagtttctcgtatataggctctacatccttatccactatagcattcataactattagcaatcatgctcactgctacagctgcaccgattcttttcttattcaatgccatcatctcctgttgtatactattgtgtaacaaagcagcttcataaaggcaaaagcgtattgcggtttatgcgaccggcaatacgcttttgctggtaaacatataaccctatgctatgattggattccatggatttcctcgtacttattcttaaagtttaaaaatgctgctgttaataataatctctccgtcattttgtatcctctttcattcctgttcaatgccttattcccaaaatcagataacgtacaacaggaattttctctatcagcagagctgctaaaggcgtgaggagatatgccgcaaatgcaacaataacatactgcgcgcctacagacagatcactcttttgcaataatgataaggcgatcagaattaccggaatatgcaggatatagactggaaaactgatttttccaagccattctgtaaccgcatttttcttatcaccataggctgcgaacattccaaatattgcaagaatcatacaatacgtgaagagattggcataccaggtactaagcaggctgctgtgaccgtagtagataccataagccctgtaaatgaaatataccccggatacgactgctgtaagtgtgcttacaaagcgccatttctttaacacttcaatcacaatatcctgtgagaaaacataatatccaagcaggaaagcaactgtataaattccaaagcggtaagattcgactacaggcgtattcaggagcttactggcaccccacagcaggaaaaacatcacaaccagcaatacatatactgaactctctttctgaatagattttctctcttccttctgtactgccaatactaccttacgaaccaacagaagcaacaatgaaatcacaaataacatctggctgaaccactgtgcaccgattcctgataatgtataaacaatgtacttcacaaagcccggggctgcctgtagctttgctccggcagaagcccctgctacaatagaaccggggataaatccgaacaccagcactcccagtgtagatggtaccagcaatttgtttctcctgcctgctatgaattgctttgctgctttatgctgcaggtatgataagctgcaacacctgccactacgaacagcaacgtcataaaccatggaacactgcatactgataaactccggcaaggtcatgccatctccctgattatattccgacagtccctcaaatattgcggttactccaatattattgaaaaagaaaaacacatgaaaaaatactactaaaatgatggtgcaccatctgatattatccagataaatctttcgcatcttacctctttccgtattgtttattacttgatttcataattccctactttcgtttcccttatcaaagttctgcaaatctatcacagccttttgttttaagccaaacttctcttccagcttttatatgcttctttacctgttttctttttccggcagacgagtcataagaagaaaaattgctcccaataccgcatactgcctgataatggctatcactgttttgtatttactacatttccatgaaactgcggattgcagtctaacgtttccctgattgccgttataagctcctccggcagcttctcactctccatctcctcaaatatgccacggaacatatgattcttaataagtgaagttccataagtccccggaagatatgacaatgctttctgcaatccagagccaaaactagagattggcatatatgctccacagataaagccatagcatgagctgacaatcgttcctactgcagacatctgcccctgcgtggcaagcggatagcttataatgcttgaaagtgtgcttccaaatagcacaagaagaagctcatcaaaaataatccaaagcacatccacaaagcttaaataccagcccatttttcctatgtaaagaagtccgatcacaagtgccagcccatttaccataagtgaattcagcactgttgcaaggaaatatccaagatatatctttgagcggcttatcggggaaacattgaaatccttccttgcaccattcaccttgtcctgaaccattgtaagattcacgcagaaggttactgtcacacagcttactgccaaaagcgctgcaacaagctgggatgcaactgtcccatcaatcaacttttctgtaatcgtaaatcctttcggaaatgctgatgtaaaagagtccttataaacctttgccaaaaatgttgcatacaatacaatcaaaacaaatggtgtgataagtgcagagaaaaacattcctttatctctgaaaaataattttctgttcctgttcacaagagaaataactgccttcattagttttcacctcccactaccctgcctgttaccgcaagaaatacatcatccattccgccctttactacctcgtaatctttgaatatatcctgatgtgcaactataagctttgttgcttcaatggtatttcctatttttatctgatatccgtccctgattgctttatacttcatacccagagacttcatttcatcttctgtcacaccatagattgatactgtatcctgcacataggtgctctttaattcaaatggtgtgccctctgctactatgcttcctttatcaatgattacgacatatcccgcattagcagcttcctccatataatgtgtcgtaagaaaaactgtaagattctcatctgttcttagtttttcaataacttcccagattctccttctggtctgcggatcaagacctgtggtcggttcatccaggatcagtatttcaggcttatgcaacaaggctctggctatatcaattcttctgcgctgtcctcctgacaatttaccaacaggtctgtttatataatcttcaaatccaagaagtcctgtaagctccccaagcctcacatcaaattcctttccagtgattccatagagcgcagccctgctttttaagttttctcttacagtaagcggtttatccagcacactatcctgaaatactatccccagtttcttgcccagttcattttccagcttttcagcagctactccgtcaatctccacacttccactatccttgccaagttggccacatataatagaaattgttgtgctctttccagcaccattaacgcctaggaaagcaaacagttctcctcttttaaccttgaaattcaggtcattaacagcttttatatcaccgaagttcctggttaaatgacttatttttatgatatctgaccccattttgttctcctttttctcaatctgatctactatgtttagcagcagaagcaacaacatatataaagattttatatatctgttttttatatcatatatttatctatatgtctatatgagcagtaccaagatgcataatatatcaaccaggatgcattaaaacacaaaaaggacgcaggattttactcccacgcccaattactatctggctttatcgaaaatcagaagggaatgctggcatttgttcctccttctgcggcaccgtctttttctaaatctgctgcatcttctttctccaaaaaatgttgatccatatctttttaaaaaatgcagatacgctttgaaaaatcggttgcgcaaacccgtaaaaataaacccggctgccaattgcgcaaccggtattccaatatcttataaacctatacaatctttttggagtttctgcaagatgtcaatttacacaaattttatctcttgattttgtgcaatctgccagtcaagccagttgattgattcccacttccctccaggctgcgtataatttgtccagattccaggcagcattcgcgggactagtagatggcaggcagacagcttttattccagtttttggttcgatatatctcttatagtatttctcagctgttttgccattgacaaaaatcctctttacctccgaatggtccagtatttctgacaggtcattcgcaaccacattgctgatactcgaatccgatgagccctcgatatcgcaggagccgatcacatcccacatagctatgtggtgctttgttaaaaatgccttcttttcagggatagtaactggcacctcgtcatcaaaaacccgggcgatcactttccagaatctgttttgagggtgtccatagaaaaacatctgctccctggattttaccgagggaaaactgccaagtatcaggattttagaatccttatcaaaaaaaggtgggattggatgtaatatatgtttcttcatcatgctaaaaattattatttcgaataaaattcttctcctacttcagccatcacaggatttctggctttctcgatagatacaagcaattcttcatactctcacctttttgaaaaataaacgttcagctatattttatcctttttgaataaagtatagccgaacggcgatatttcatcaatagaattttttaatcgaatcaggccaggctatagcggattgacagagcctctggtttgcattatagtttgaaggcagtctgcctgctttttcagcagcatggtctgcaaaaagtataataaactcagttgatagataacaagttcccacaaaaaggagatatgatatgaaagctgtagttgcagttgattcttttaaaggaagcctcagctctctcgaagccggcgatgccgtaagatgcggtatcatgcaggcagaccccgaggcacaggtcatcgtaagaccgcttgcagacggaggtgaaggaaccgtcgaggcgctgacgattggaatgggcggaaccatcatgacagttcctgtgaccggtccccttggtgaaaaagtaaacgcagaatatggtattctcgcagacggccagacagcagtaatggagatgtctcaggcagccggaatcaccctgataagagatgaagacagaaatccacttaaagcaacgaccagaggtgttggcgagatgatccttgatgcgataggaaggggatgcagacattttatcatgggaatcggaggctctgctactaacgacggcggaatcggaatgctacaggcactgggttttgatttccttgacaaggatggaaatcaggcagctcctggtgcacagggccttgaaaatcttgtggaaataggcagcgagaatgtgattccagaactttcttcatgcagcttccgcatagcctgcgatgtaacaaatcctctttgtggagaaaaaggctgcagtgcagttttcggtccacagaagggagccgactcatctatgatccataggatggacgactggctgtcaaactacgcagaaattgctgaaaagactttcccaaaggctgacccaaactatcctggaactggggcagccggtggcctgggatttgcttttcttacttttacaaatgcagtcctcgaatccggagtcaaaatcgttctcgatgagacaagacttgaggattatataaaagaggctgatatcgtagtgaccggtgagggcaggcttgacggccagaccgttatgggaaaagcaccggtcggagtcgcagaaatcgcgaaacgccataacaaaaaagtaatcgccttcgcaggaagcgtggcaaaggatgccaaagcctgcaactcttatgggatagacgcatatttcccaatcctgcgcggaatctgcacactgcaggaggctatggataaggatacagcggcacaaaacctgagcgatacagcagagcaggtctttcgcctggcaaaggcaatgataagagaataattttttaacggtgtttccgatatgagtattgatgatatcaacagggaaattgatcttatgcgtaaggagtctgatgtatgatttgttatgcggtaatagataccaatgtactcgtatcctcactgctgtcaagcaaggacgactctgctacggttcaagtattgggcaaagtcctgatgggtgatatatcattttagctattttttcaagagctataacctgcataatagggctgtttcatgaatgctcttcgtccgaattcttccaaagcgccataaataaaagcttcctgattatctgtaataaactgttccctgtcatcggaagaaagcggattaagttctatcattttcgtatcttcctttcgccataagtcattttcgctagataggtatcatctccacctattgcgcacagaatcatatcgatctccggatcgcgaaatgcctgcaataaatcctctgctcgtttttccgggtgttctttgatatagtccaactccatacgagcgtgcggcataaactttacattcaggccatattccttcagtctgcgaatacctatatcagtttcaaagctgataaacggttctccgataattccacttgacaggcttacgataccaagtgtattcaatgatatatagttatctaatcgcaaaagacgagtgttattttaccggctttgctgcactttccggaataaattcaagctttaatctcatgccaaggccatttgcaagtcgttttaccatttcaagagaaggattcctcgtaccattttcgatacggcttatatctgcctgtgtgattcctgttctttcagacagttctttctgcgtcaggccttctttgtttcgagcgtcaatcattgcctgaataatatcatattccggctgcagagcatcatactctgctttgactgccggatcctgaagtgccttctttttataattattatagctgctcattgtccaaacctcctctcataatccagtttatattttcttgcctgttcaataactgcgggaggtgtcttctgcgttttctttacgaaaccatttgtcagaatggctttttcccaatggctatgtcacaacaaacagttgataaatagccatttttataggggagtatcagaactcccctacaaactgttatttgcagttatctatactcatttggaatttcgatatgaagtgtctcacacaataacttcacatcatgtgcatcattttcatcaaactcgtatcccagatggaacattacttgactatatggttcaatacaggaaacctctatttcctcaattcttcctttacccgaaaaagtttctaccggaaaacaatccccatcataaagaatttcaccttcgtccgtatattcaaaacaatgcaaatcaataattctgtttttcaaatcttcccatacagtatggttcaatgttgtatattccatcttaatctcataaaagccattagctttcattatttctataaagttctgataatcgttcttttctacaaaaatgtcaatatcattatgggctcttgactgatatccaagaagagcatctacaccccatccaccatcaagaaagactttaatctccgcatctattgcaaattgaagaatctgttttacatctgttatattgaccatcttatcatctccacaaattctaattaggtgtaaggcgagtttcatggggcgcagccccgcataaaaattccacgtccaggaagtgcatcctagatggagaaaacttataattcacacaagattttcagaagaatccggctggcaggcttttatggcagcttcgctccatggcatcagctgttcgagttctgagtctgccatatctgcatgaggacggtgtcaagaaggaaaacaagaatttgtaaatgtttaaatcattggcatgagctgtttcaacaatcgaataaacgcagcactggcttcggctccaccgactgtgtcgcagaacagccagttctttcttccgactgtgccggacgaatcgatctttcggtatcgttgttcgaaagactgcagtggccgtcctcaaggaaggtcagggaagtctccctgcgattctgggcatagttcaccgccttctcgatcgggatccatgaacgggtttctgctgatccagccaggaccagaaggcatccagaacaggtttctctttttcgagccggagttctttccttttgtcataatcgccggcacatgtgctgttgatcacacgttcccgccggaataatcgatacaatcctcaactccctgcacggcaggctgactgtaatcaaactgttcccttcgggatggcgtctatgaagtagcgtcgcaggtgtcccaacaggtacaccgcttgatccccgacactttgttatagccctgtagccgtcggtttccagatatccgttaatcccttcagaaattctttggcacatcgccgcttcttgttggtgaataatggaacagatatcggaggaagcccatcatcgccactacggaaacaccaagaaacgattgcgtctgtgccctccggccgtcttccttcagcacctgcatcctggtctcatcgcccatggctaatcgcggaggatcagcctttggtgcatgtaatctatgaccggaaagaaacaggtctgtgaacattggatgatccagcctgcaagagttgaccttgaaagtgcagctccttactgcttccagtctttctcctgacggtagagcgggacactgttgacgtatttctggtacattgtccatgcgaccgctgatgaggaagcatagcttttctttatcagagcctcagggacctttgatttgacaaagactggtttatcagcatcaccaagcgctttcttgcagttcgggcacacatagttctcgctgtaatactcgatgacacttacctttgcaggaatgtatttaagctcccgcctctggaactccacaccgaccttttccatctgtgtcccgcattccgggcagaccttctggtcatccggaagagggatgacgactttttcgacaggaatgcctttaaagagttcgttatgacagatcttttctttctggtggagctttgaccggaacagattcaacatctgcctcgtggtcgacggtcatctcagcttcattgaaaaggctcatctgacctgggatgtctccgacattcttctcgcttgagcgcccaagagtttctttgtaagataatcgatctgctctttataattctgctcgcgggtgttctgttcggaaatggtggtctgaagtgtactgatcagagattcagcgtgtcgatggtagtgttcagctgttttatagtgtcgcgtaattcgcgtttttcagttcagctgcgctggctcccacggtggatcctcctttcgaattgatacatttatttatcagaaacgggcataaagaaaaccgtgaaagccttgattttactgttttttcggcactttttagtcaatgatctcagaagctttttcggtatcttagtgccagatcatccttctgaagtgctttcggctgatcgaccttaagacctgacatcagccagtcgaactgacgccaggtgaggtctctgacctctgttttgtttctcggccactcataatgacctttaacggtaagacgcttgtaaagaagcaccatcccgtcaggctcatgcagtatagccttgatgcggtcacggcgtttgccacagaatagaaaaagggaattcgaatggatccatgcgcagctgatcttcgatgatagcgcacagaccatcgatgaacgcctcatgtctgtgtagccggtcaccagatagatatggtctacgccggaaatatcgcctacatttgatctccttcagataccggaacacgcgtctgatcgctgctgaacctgcatcatttcggatccggattgttattccattggcaataacttcgatctcatgtgaatgtgcaaggtacgattccaccggctcctttggtacagaaaccagggatgtatgttcatcggatggatcatccggaacatcgaacaggaacaacctcctgtcgacagttctggccggatctcttcggatctcggccggatcagtttttcagctgcactattttttctgcaacgctgacccacatatagaaagtgccggcttaattcctttctggcgacaccattccgcatctgtcagtccggaacgcgacactcattgatcagctcaatgcgcttatcctcagggacgcgctcagctctggaattcattgttttggcctcctaacatgtgaatagagtaaaatgcttacatctcactcttagaaggttttgcctggaaggtatacccgccacagataattcgcttacctaattaggcgaccagaggaactgctggtctgtttgaataatctctgcatttagcagttttcaatgttgccaaaacaaaagttaagaagatgttccttttccatgtcgctttctttggcgtaatttacaaggttattccacacaagatagttgttcagatacttggtagaaacaccgttaaagccacgcataaacctctttagctggctatggagctattgatatgttggatattataaatgcctttcttggctttgccagtctttaactgcacaaggtcaatgcctggcatttgtaaatctcacataggatttcatcttgtccgtaacaagagtggaattggtcttaatcctaccatcataaatatgatgtaaatctcttgtagaaactctaccagtattcgtaatcttggaatagacaagccattcctattaaccgcacaaggaacacataccttttcttgggacaagcctctgatatgtgtagaatgaccacgcttatgagccttgcgtggcatagcaaatgtcttactcttgctatgattgccctggtacgagatggcgaaaaaagtttcgtcagcctcaataatgccgtcaagggtaacatcgtctgccatattctgaagtgcatccaaaatcttgtgtcccaaaggaatgcggtgtttctgtgaatcccacaagcaacagcagtcttacgaatggataagccattcatcatacaatcaatgtactgctcccacacggacaagtcttttcttgtaccagacacaatggagttcgtagcaatcacgaaggacttgccacaatccttacatactatcgctgtgtgccatctttacgatgaccattgcgaacccatggatacagccacaaagaggcatacacgaccatttgcaaagcgttcctttgctacgaaatcttcaatattcaaagactttacaaaggcagacttaaaagcattgttttaggctttcctgctctgcgacagtcacttaccgataatatctaatgcgtctttgatagtaggcatatccaattacctccttcggtggtactgtttcttactatattatacgctatttctcgtcaaaaatcaaccatttgttgtgacagagccttcccaataaagaaaaaataaagaacccgtgtaatgtcagaaccttgttttgtcctcaactcaaaaataccatcgccgagtggtcctgaatatggcaatctaagtgtcgtccattttgctccaaaagatcgattgtcctgagaacttttgccttcattttaggctctaaggaatccaaaaactcctgcacggtgttctcccgtcttcaagatcgtaaaactctatctcatacatccctgtatatccttattttttctttattatatgtcgcattcaacatattgtcaacgggcaatgtgctttaaaaaccaagatgccacagatgacttttgctttgaaccttggcaaaatggcattttcggcatcttaaagcactaaacatcttcattttatgcgggttaggagacagacagtctcgacgtgcctcgagacagtggaaaacataatcacgctgacgcgctgtctgtggaaacatatctaaaatccacctctgtttgcggaaacatagtaaatggtagataacccgtcaccttcaaaaaaaattcttgacgcgttactattaaactttgacctctttcagttccctaagtttcaaattccagccctttcgggctggtttattcttgcttattttttctttcggcagatctccggtattgattctgaccacggcatgagtttttcaagttcatcgcctggaaccttttctctcggatacttgatcagttctgagatcagtatctcatgtattctaaggcttcaggccgttcgcttttgctgtctctgctatgctgtagtagagtgcgcttgctgaagctccattgactgagtctatgatgtgccagttgtgctttcctacgcagaacttccggatgctgcgttctgcatcgtgtttgtcaagtggaacttccggatgatcaaggaaggtcttcaggtagtttcctgattcttggcatagttcaatgcagcgcgaagcttcgtactcgatatcgttttgctgtcaaatgtttttacccacgcaaagaatcctctacgagtggcctgatgttttcctgccggttctttagccttccctcatcagaagattctttgaacttattgtcgaggtggtaaaactgatcgatccgcttactgcctcggcggctatctcttgtgccggtgtcagcttctcgcctttcttgcaccttacgatttctgcaaactttcgtctgacgtggctgtaacacccggctactgtgatatcattgctgtttttcatgatggtgtagacggctgatatccgtccgttaccaggattcctttgtagccttcaaggtaatcctgtattacctcaccattcctcgctcccagatattcataaagatatatcggaggacctccgccttttcccggagaatgaagcacccacatgtactgctttgacttctttggcattacgaatggtgtctccacagtggagcagcttcgatttcatcagctgcttcttcatcgtcgatgtgaacggtttcagataatacctgtagactgatatgagcctccggccatgtcctgccggtcaagaatgacatcataccttctgatctcctcagagaggcgttcagtgggatggcattcacatacttcatgttgaagcatggcaaaaagccctggagtgagtatgctgtgagacagattcttgcaggatgatctgcccttatcacactgcctccatcatggttccaccgtatacctttacatgatgctcaaggatcttaaactttgctggttgcattgcagctcactgtatacttcttcggtgagctcatgccatccgtgcggaaatgcagcatcaagctcttcttttgagcattcgtgtatgactatctcccgctcgacaccacttagattttcctttctctttcccttcttacgggtatgctctttgactttgacacttcatctatgtcttttcaggaggaacaccgttttcagtgagagattcaggctcgtttaaaatgtataaagagatcggactagacatctgtccttcaatctgattctctgtttcaactttctgccaaaacggttctgggtaggatatcgattgctcggtaagatcttcgatctgcttaacaagcttttcattctgtgccagaatcttagtgtcatttgcgctcagctggcgatacgctcacgcagctgaaggaacagaaaaatgatcgtttcctttgggagattattcagttctgagtctgtgatctctggtccgttcatactatatattttatcacaaaaagagcctgaagtccgcataaatacacgcttcaggcaccttgatatgtatgttttcaggtgcataaatatagtaagatcctgttcagtaaatccctggaggagcatctgaaataacttttttctgatcgatattcagtccctccataagccactcgtactgtcgctgcgagatcacttttgcttcggctggagtacggggccattgcagctttccattagtaaaacgcttataacacatgagccagccgttgccttcataaagaagactttcattcggtctgaacggcgaccacagaacaggaagatggaaccaggctctgccggatcaagtccgaaagtattggtgacagttttttatgaggccatcaatgccctttctcatgtcagtatagtgcagcgagatagatgtggtcgtaaacctttagcgtcactcagcatctttcaatccctcaagacttcagctatcagagacttaggatagactcgtttatgcagatctcagagtttcctgttctgatgatcatctgagtattgaacttgccgcttaaatgtcagacttttttatgatatccggttcagagacggcatggcctgtattgaacctgaggcagctcaacaaagcctgagtcttcgatgactttcctcctgagtttgcgcagataatagttactgatttctagtgtgccattctttttgcagaactcatcaatcgtcaaaccactttgatttcgctcctgaattatgtttaactgcaatctttgaggcgaacctgttttacaacttcgtttggattaacatccatgcctgtacctcccgtgaaaatgtttgataacttgaaaaactgagaaaaggttttctgagtttttaaagttattctaacaaagagatccggaacaaggaaggtgacgggttatttaccatttacgaaacatatcgaaaacccgtgtatcaaatgagaaaacatatctaaaagaatcaaggctcaaaactggaagttgtttattaaacctttttaaccttaaccaacaacatcataggtctacgcatttcatcacacattcccggcatatccatcatatctgccggaggcattgcttcctcaatagcctcaatttgaaaaccacattttataagaggattcaatatctgcgttaatgtgtggtgctgtttaattactcgttgaccaagaaaattggtttctctttcgcctgtgtaatagtaattgtcgattggccaatatttaggtttcccattttcatcataaatccaatcctcattaacacctgcggtgaaagtcggatgttcaatattgaataggaaatacccacctactttcaatgtgcaatacaccttttgataaacattatctaaattttcgatatagtgcagtaccaggttagaaacaactaggtcataagtgttttcaggataaatgtattcttcaacaccgcaaactttatacttgattttgtcatcagagttaacagctactgcttttgcaatcattttttgactactatcaataccaagaatttcagcagctcccatttgtgcggcatatttgcaatgccaaccgtaaccacatcctaaatccaaaacttttttcccttgtaatttagggaataacggttgcaactgatgccactctccagcagctttcagaccatatttgcttcttcccatttccgcatatgcggcaaaaaattcactattatcgtaaatatttctcattgataattacctccacaacttccgatttatcgttttcttctaatactatcagtttcatccataccgttcaacaaaatcagtttcatacctgcaggtgccttcttcggatgcctgcaggcttttttcgtttttcaccccatcaaaccgcctcccaaatgtccgtatattgaggagatgaaaccaaggcggcatccggagatttatagcaataatttccgctcaaatgcccttctcatctccagaggaaatcaggaggtgagactactatgtcagacaatcttcagtccgaatatttcacacaagagagaatcatcggtgacattgactatcacagagcgcagcgactggacattcgcaggtctctactatgacgaaggcatcaccgggacaaagaaagacaagcggcccgagctcttgagaatgatctcggattgcgaagccggaaagatagacctcatcgtgacgaaatccatcagccgtttcagccggaatacaaccgactgtctggaactggtaagaaagctcctcggccttcatatcccgattttttttgaaaaagaatccatcaacacgatggacgccaagggcgaggtcctgatcacgatcatggcgagcctcgctcagcaggaatcacaatccctctcccagaacgtgaaactcggactccagtaccgctaccagcaggggaaggtacaggtcaaccacaaccacttccttggctacacgaaagacgaaaacggaaaactggtaattgatcccgagcaggccgaagtcgtcaaacgcatctaccgcgaatacctcgaaggctacagcatgaagaaaatctgccagcacctggaggccgacggcgtccttaccggggcgggcaaaacaaaatggtacgacagcacgatcaacaagatcctccggaatgaaaagtacatgggcgacgccctgcttcagaagacctataccacagactttcttaccaagaagcgggtcaagaacacaggcatcgtcccgcagtactacgttgaagacgaccacgaggcgatcattccgaaggaactgttcatgcaggtgcaggccgaactggtccgccgccgcaacgtccacgccacgaaatccggaaaaaagcgctgcttctccggcaacaactgcttctctcagatcgtctgctgcggcgagtgcggagagctctatcggcgcatccactggaacaaccgcggcaagaagtccatcgtctggcgctgcatcagcagactggagccatccgccgccgagaaaaactgcacgaaccgcacggtaagcgaggacctgctcaaggagatctcgctaaaagccatcaaccgtatccgcgccgacagcgattccttcatcaaacagattcaggagaatgtcgcgaaagcagtcatgaacaacgactccctttcaccggaaggcctcgacaaacgtctcgaggagctgcagaaggaactcatcgacaaagcaaacagcaagcaggactacgatgccatcgccgacgagatcttccggcttcgcagccagaaacagcaatctcagattgacgcagagacacagaaggaaaacctgaaacgcgtcaaggaactgcaggacttcattgcctcccagcccacagaaatcaccgagtttgacgaggatctcgtccgaaggctgattgaaaaaataaccgttttcgctgaccatttcaccgtggaattcaaatccggtgtcagtgttgacataaaagaataagagcaggtgctccgctttttggagtgcctgctcttatgttatctgcaagatgaaagttattagtccggcatgtcgcataagttaccgtctatgtgaactgatcataagactcacttcttctcactaagtgtccgaaaagggcttatattaaatctgcagatagcaatataatcaatgtgctatagcacatcaaatgcacttgtattttaataaaatttcaactataatgagagcataagtaaggaggttttcattatgccaaaaacagaggaaatgacaaattttacattcaaaatggaccggaagactcggaacagctattccaaactttgtgatgatttcggcctttctatgtcatccgcaacattagctctggtacggcaggcagtacgtacgcaaagcatgagtttttccatgcgtgatgagaatggtttcactccggctcaggcggctgaattacagaagcgaatcgatgaaatcgaacaaggcaatgttgtcaggcacgatctgattgaggagtgattatgagagaacttttatggtcagtgggtgcatgggatgactacttggaacttcagacagataaagccgctctgaaaaaaataaacaaactgctcaaagatgtaatgcgaaatggttatcaggcttcttatgggaaggttgagatgctgaaaggaaatttcagaggatacgccagtgtccggattgaccacaagaatcgtttgatcttcaaagcggatgatgtaaccatctacatcgctcaatgcggcggacattatgatgatgagtaggaaatgttaatcgaagactacatgccatcaccgtccgaaggctgattgaaaaaataaccgttttctctgaccatttcaccgtggaattcaaatccggtgtcagtgttgacataaaagcataagagcaggtgccctccaatggagtacctgctcttttcttgtagacaaactggaatcttgcgaaatctctctacatccttatatcaggccggtagaacccaaagctgaatctctgaagaagattttgataatcctcaagatcatactgctccataagactcaaaatcagatactgcgctcctccgtcaatgatccatgcattagtcttgtggtatccatttctttcatagaactcgagccgtttcttccgctgcaaagcgtttgccgccttctcgtctggcatttcgacattcagaaggatatttctgccatttctgcgttcttcaagggcagacaaaatcttcgagccaaatccctttgaacggatggcatcgttcacggccagatacaatacgaatatgccgttctgatcagcagccgtgtaactaatcccgcagaattggccatctttataccatgccaggaaatcaacagtctttcttaacgcaagcattctcagcatccagaatggagattgctcattttccggaaaggctcttttcataagggccttgatatctctgtattcagcaagagatgattttacctgttttgcctgcatttatactgtctcccttgcaatttaaccgatgcgcatccattattgaatcccgatctgccctgacatccatctccaacactcagcaccccgacatccaacttcaagtcgcaagctatgacatctagatgcgagtctcgaccctatcacatattgttcataattcgattttcagccttcttggataagttccctcagtgcgttgccgctaccgatagaaaaagaaagcctgatatcccgaaaacggcttagaatcaggctttcttggcacatcacccttctacccgtgacatcaatactactgtctcaacgtgccccgagacagtggaaataataatcatactgtttcatgctgtctgggaattggtcaaggtagggacacgctgttcgggaatttgtcagaaatatgatgctccattaccttcaatgatatcagcgacattgcaaaaaacattgaactggaaattatctgtgtcttccaagatcatcaaaatttctttttaatgctgcttcagtaaatgggatagcgcagatcatgacaatcatagatcaccgtcttcgccgaccacttcaccgtggaattcaagcccagcatcacaatcgatatcgaggcataaaaagactcctcgccactgaacttaatcagtagtgaggagccttgtccttttttgcttacaatagtttctctacatcctttgccttcagcacttttcctgcagaaacaattttgtcatcaatcataagggcaggcatactcatcaccccatatcccatgattttttccatgtcggtgatgtactcaatctcagcatgaattcctttgtttgctaccgcctcttttacggacttcaagagtgcctcacaacttttgcagccaccacctaaaaccttaatattcattttacttatcctcctgttcgaaaaatttataaaaactcttttaattataaccgtaaatcactgtgctatatactctttcagctctacaattttcgtatggatcttccgaatcgtttcgataaaaacttcatcaccagctcctgttggatcctcaagcctccaatcaaatctctctgtgcagggaagaaacgggcacttcacattgcagcccatcgtgacaaccacatctacgggcgggatatctgacagaagtttgctgtactgcgttttctccatgtcaatgtcgtagatttgcttcatcaggcgcactgcatcttgattgatctgaggcttggtctcggttccggcagaatagctctcaaatacatcggacgcaagatgcctgcctaatgcttcggctatctggctacgacacgagttatgaacacaaataaatgccactttcggtttgttcattgaatttttctccttacaccagtaagtacgccatggcattgaagccgtatccgacgatgatgataccggccgtacaaatggcaataaacgttccaagcaattttggtttaaccactttcttcagcatgatgagagagggaaggctgagtgtagtgaccgccatcataaagctgagaatcgtgccaagcaatgccccttttgacaacagggcctcggcgataggaatcgtgccgaatatgtcggcatacattggaatacccacaagtgtggcgagtatcactccgaatggattattgtcgccgagaacggtctccacccagccctccggaatccagttgtgaatcactgctccaatagccacaccaagaaggatatacggaaataccttcttgaaagtggatactacttgatctctggaataaagcagccggtcctttacggtaagatttggagactctatatccaccttgctgttgttattgcggataaaatcagcaatctgatcttccatgtgcagatgttctatcaatgtcccgccaagaaccgcaatgacaagccccagcactacataggccacggcaatcttcacgtcaaagatactggtgagaagcacaagactccccaaatccaccattggcgatgaaatgagaaatgaaaatgtcaccccaagcggaagccctgcgctcgtaaagcccatgaagattggaatggatgaacaggaacagaacggtgtaaccgttccaagcagcgcgcctattatatttgctcctattccatgaaatcttcccatgatcttcctgctccgctccggaggaaagaaactctgaatgtaagaaatcagaaagatcaacacacagagcaataccgtgattttaattgtgtcataaatgaagaactgtatactgccgccaatccgactatctaaattaagtccgaccatcagcagcaactgctcaatcagggcattcaaccacttcatcccaaggatctgatcctgaataaaagtccacattacgcaaacctcgctttcgttttatttgctattcgcactaacaggagcatgacgggtacctccgtcagaacgcctacagtggtagcgagcgctgcagggcttgtcgtaccaaatagtgcaatcgccacagctaccgcaagttcaaagaaatttgatgcgccgatcatcccggcaggagccgcaatatcatgcggtaatttcagcagcttacatactccgtaagcaataaagaagatcagaaaggtctgaatggtcagcggcaccgcgatcagcacaatatgaagcggattagacagaatcacctctgcctgtgaactgaaaataataaccagcgtcagcagcagacctattgttgtggcattgtcgaacttgtggacaaacgtgctctcaaagtaatccgcacctctttgcttcgtgactgttattctcgtgaggatgccgcccacaagcggaatcacaacgaacagaaaaatgctgacgaacagagtactgtagggaacaaccacattggaaacacccaaaaggaattttacaatcggaacaaatgccaccagaataataaggtcattggtggccacctgcacaaccgtataagcagggttcccttttgtaagtgtactccacacaaacaccatcgctgtacatggagcagctcctaaaagcacagctccggcgaggtattctgttgccagtcccggtgatatgaaggctttgaatatgacaaacaaaaacaggtaagcaattccatacatagtgaaaggcttgatcagccagttcgtcacccatgtgaccagaagtccctttggattcttcccaatctgttttacgctctgaaaatctactttcatcatcatagggtatatcatgacccagatgagaacagcgataggaatcgaaatgccggaaatctgaaatttgccgagtgtggcaggaatggccgggacaaaatgcccaatcaatactcctatagccatgcagagcagtacccacacagaaaggtaccgctgaaatgtattaatgcctttgtttttattgttcataacgttgcctccgttagtttgatacattgcaatgtatctatgtttatgggttttatataggcaatcccaaaggactgcctatattaatgaaagatattgattattcctttttcttgcatccgcaggatacgctctcgtccgtttcgcagtcacatcttgcgtaggaaccgatcatgtcccggaactccctgaccccgtctgcggagatgaagtaatgcatccattttccctctttgtagtaatctacaagtccgctgtccgcaaggatcttcatgtgatgcgaaagagtcggctgtgtgatattcagttcctccagcagatcacatccgcacttctccccatgctggagagcaagcatgatcgcaaggcggttctcatctgtgagtgcctttatttttttgacgtcttctctgaatcccatgattttcacctccgagagatgtacatattatatcgcacacatttacagttgtcaatgtatgaatataattttgcttcaaaaagctccccgcctctgatggcagtgtgggagcctttttccgacatctatctcacagccacaactccccgacatctaactcggcaactcaactctcacactttttgacccggattgcccttggataagttaccgagaagcgttttgtctgtccgatgcaaaattgcccgattgcctggaaaccgcagtattactgggctttcgcggctatttcccctcgacccttgacatcttttgactcggtgcgcccgcagatcaccatcaacgaataaaaagcaggcgccccatctggagtgcctgctcggttgaccttcagaaatgaatctcactttgtaagttcgaaacttctttggacatattccataatcatcctatcctcaagataatcactcaacataatcgaaatccatgttttatgattcatatggtatcccggaaataccactccgggatagttgctgatatcattctccaatgtatccgttttgagatttattatatcaacagtggtcctatctttatccttaagtagtttttctctttttacattcatgataagggcaaaccattttctggtatctgcatgcctgaaagttccgtatgactggtactgcgctgtctcccatggaaaatccggctttacgtcatactgattcaaaatcatttccgtgattctgtttgcctgctctgaagcaaacagaacttccctgcagactgcatctccaatgtgctcaagcaattgcctgtatgcatcacgaacagtgttcacataggctccattgaaatgttctgacctgagttgaacatattcttcgttattcatcttatcaatcacttcacttgtcacattgccttcttttgaaacagataagattacatgaaattccccgttcataaaatctgtttcataacaatactgatcaccggatttctgaaacccaaaactatccatcttggatggcacaaatcttcttttcctaaaaacttcatcctcaatcatatcctcaccagtctcttcgtccttgtagaatttgttcccccaacatccatcccctaccctacatctaatcacgagtcgcaacctgcccgattatttaatcgcgacacacaaccctgtaaaaaacgccctggataatttccctatgtgctgtttttcagccagatttcaaggacgctgaaattttccacgattcccgaaacccgctgatttcagcaggttccggcctcgtcttatttcttcttcgacatcaacgctaccgtctcgacgtgtacacttctgggaactggtccactggcgtgtattttttcattcgtaggtgccgtcctcgcaaaggatggcgaggtcgcgggcgagcgtcgccgggtcccatgagacgtatacgatgcgggatggagctacagagaggatcgtctcgaggactgacttctcagctcctttgcggggcgggtcaggactatgacgtctgccggacgtccctgtgcaacgagtttcggcagacatggcaggacatcctcggtctttccggtgtagaagtttgtatttgaaaaaccgtttagtttcgcattcctgacagcgtcttttacggcgtctggaacgacctcgacgccggtcacatggccggctttttttgcaagaaaaagtgagatcgtaccgatgcctgagtaaaggtcgtagacgttctcagagcccttcaggtccgcgtattcgagtgcacgtgaatagagcttttccatctggacagggttcacctggaaaaatgacttcgctgaaatatcaaatgtaatatctcctaccttgtccgtgatcaccggctcgccccagatgcactcggtgcggtcgccaaggattacatttccggtgtttttatttatatttacacagatgcttgtgatatcagggcaggcgaccgtgagccgctcgacgagattgtcgattgccggaatagactttccatttataacaaggcagaccatgacctgtcccgtgtggacgccgtgacgaatcaggatgtggcggatcaagcccttatgcgtagtttcgtcgtatgcacggactttgttttcatacatccaggacttgatggcatctgtaatattctggttttcaggtgcgccaataaggcagccgactgactgatccggctctattatccggtgcgaatggtgcgcataaaaccccatgacaataccgccatcaggctgcatcccgaccgggatctgagctttgtttcgatagtgcagcgggtcgctcatgccaatgaccggctcctggatttttctaataaaatcgcggtcaaagccaccgatgcggacgagatcgtcctctactatctcctccttcatccgaagctgcgccctataagaaaaattcatcaggctgcagccaccgcagcggtcagaaaccgggcacggaggctcaactctgtctttcgatggttttaaaattttaacgactttagcgtagccgtaagtctttttcagcttggtaacatgtgccatgacaacgtcacccggcagtgctccgaccacaaaaaatgtcatcccctcgaggtggccgattccctctccatccttgcctaaaccagttatctctacttcaaatacatcatttttcttcatgggattattatacttgctgggaggattcttcacaagggctttcttgagggattactccacatgctggtgcaatactctgttacgtagcagtatttggtacttatttctccggctgcaattactgtaatcattatgatgtcggggtcgaaagcccctgtgcaccttgaaaatttcatatattgtcgtagtgatactgccaatatttgagccaaccatggtataataaaaatatactttatgggaggaatcagacaatggcatttaaagaaaattccagccagcaaatgacgctcacggacagtttctgggggcttaccgaacgagagaaaaaagccctggagaactcatgggccggaactttcgccgaggaaatttttccctcgattgatgaaagccgtttttccgttttatatagcgacaaagcttccagacccaacacgccagtcaatgtcattattggcgcactcctgatcaaagagcttttcgactactctgacgatgagatggttgaaaatctgatgcttgatcttcaccttcagtatgcgcttcataccaccagcttcaaggaacaaccattgagtgacaagactctcagcaggttccggaaacgctgctatgattacgaatccctgtataatgtcgatttgtaccatgactgtatcaatgacctcagcgaaaaaatcaaaaagctgatgaaaattaacgggcgcatccggaggatggattccatgatgattgaatccaacataaggaagctcagccgggtggaactgctgtatacctgtatttcaaggcttgccgccgtgatagcaaagcaggacgaaactttcctccctgcggaactgaagcactacgcagatccgaatgatttcaatcgggttatgtatcatcagagaagtacggataccgatgaacgcctgcaaactatcctgaaagatgcagacacaatcctccttatttcttccggaaaatatgacacgctgcagacatatgaactccttgtgcggtgcctttccgagcagaccatcattgaagatgggaaacgccggcttcgtgaaaagagtgatggcaggatggattcagcaatgcttcagaatccctctgacccggacgcaactttccgtataaaggcaggaaaaggacacagaggatacgcagctaatcttgaagaatccgtcggcgaaaccggatccgtggtaacggattaccagtatgatgtaaatactcacagcgacagtgctttcctgaaagagaatctggaagcccgaaaaaaatcagatgaaacaacaaccattgtaacggacggtgcttattacagcgatgaaaacaccaaactcgcaaaagaaaaaatgtcgatctgatcacaacagctcttacaggaattgccactccggacatttttgctgattttgaattcagcgaagacggaaagaacgtcacaagctgtccggccgggcacgttccgggaagctgttgctataggaattcaaacggaaaatgccgtatttcatttcccaggtcaacatgcgagaattgtcctcatcgtaatgaatgtaatcctcattttcataagcagacggcaagcctgaacatttcccttaagggaagaaaccgggcaaaatgtcagcggaaaatggaggaagaagttttcaaagactactgtcggctaaggaacggagtagagacactgccatcaaatctcagaaggaattttcatttggaaacacttccgaggggaaagcaacgaggtaaattcttctttggttccaaaataggtgcattgaatatcaggaagctcttcaattatcggaagggctggattaagtgtgcccagaatccgctgtatgcataaaaacacatactccgtaagcaataaagaagatcagaaaggtcgaatggtcagcggcacgcgatcagcacaatatgaagcggattagacagaatacctctgctgtgaactgaaaataataaccagcgtcagcagcagacctattgttgtggcagtgtcgaacttgtggacaaacgtgctctcaaagtaatccgcacctctttgcttcgtgactgtgattctcgtgaggatgccgcccacaagcggaatcacaacgaaccagaaaaatgctgacgaaacagagtatgtagggaacaaaccatggaaaacacccaaaggaatttacaatcggaacaaatgccaccagaataataagttcattgtggccacctgcacaaccgtaaagcaggttcctttgtaagtgtactcccacacaaacaccatgctgtacatggagcagctcctaaaagcacagctcggccgaggtattcgttggccagtcccggtgatatgaaggctttgaaatgacaaacaaaaaacaggtaagcaatccatacatagtgaaaggcttgatcagccagttcgtcacccatgtgaccagaagtccctttggattttccaatctgttttacagtctgaaaatctacgttcatcatcatcgggtatatcattgaccagatgagaacagcgataggaatcgaaatgccggaaatctgaaatttgcgtgtggcaggaatggccgggacaaatgcccaatcaatactcctatagccagcgagcagtacccacacagaaaggtaccgctgaaatgtattaatgcctttgttttattgttcataacgttgcctccgttagtttgatacattgcaatgtatcatgtttatgggttttatataggcaatcccaaaggactgcctatattaatgaaagatattgattattcctttttcttgcatccgcaggatacgctctcgtccgtttcgcagtcacatcttgcgtaggaaccgatcgtcccggaactccctgaccccgtctcggagatgaagtatgcatccattttccctttgtagtaatctacaagtccgctgtccgcaaggatcttcatgtgatgcgaaagagtcggctggtgatattcgttcctccagcagatcacatccgcacttctccccatgctggagagcaagcatgatcgcaaggcggttctcatctgtgagtgccttattttttttgacgtcttctctgaatcccatgattttcacctccgagagatgtacatattatatcgcacacatttacagttgtcaatgatgaatataattttgcttcaaaagctccccgcctctgatggcatgtgggagcctttttccgacatctatctcacagccacaactcccgacatctaactcggcaactcaactctcacacttttgacccggattgcccttggataagttaccgagaagcgttttgtctgtccgatgcaaaattgcccgattgcctggaaaccgcagtattactgggctttcgcggctatttccctcgacccttgacatcttttgactcggtgcgcccgcagatcaccatcaacgaataaaaagcaggcgccccatctggagtgcctgctcggttgaccttcagaaatgaatctcactttgtaagttcgaaacttctttgacatattccataatcatcctatcctcaagaatatcactcaacataatcgaatcatgttttatgattcatatggtatccggaaataccactccggatagttgctgatatcattctccaatgtatccgttttgagatttattatatcaacagtggtcctatctttatccttaagtagtttctctttttacattctgataagggcaaaccattttctggtatctgcatgcctgaaagttccgtagactggtactgcgctgtctcccatggaaaatccggctttacgtcatactgattcaaaatcatttccgtgattctgttgcgcctctgaagcaaacagaacttccctgcagactgcatctcaatgtgctcaagcaattgcctgtatgcatcacgaacagtgttcacataggctccattgaaatgttctgacctgagttgaacatattttcgttttcatcttatcaatcacttcacttgtcacattgccttcttttgaaacagataagattacatgaaattccccgttcataaaatctgtttcataacaatactgatcaccggatttctgaaacccaaaactatccatcttggatggcacaaatcttcttttcctaaaacttcatcctcaatcatatcctcacccagtctcttcgtccttgtagaatttgttcccccaacatccatcccctacccctacatctaatcacgagtcgcaacctgcccgattatttaatcgcgaacacaaccctgtaaaaaacgccctggataatttccctatgtgctgtttttcagccagatttcaaggacgctgaaattttccacgattcccgaaacccgctgatttcagcaggttccggcctcgtttatttcttcttcgacatcaacgctaccgtctcgacgtgtacactttctgggaactggtccactggcgtgtattttttcagttcgtaggtgccgtcctcgcaaaggatggcgaggtcgcgggcgagcgtcgccgggtcacatgagacgtatacatgcgggatggagctacagagaggatcgtctcgaggactgacttctcagctccttgcggggcgggtcgaggactatgacgtctgccggacgtccctgtgcaacgagtttcggcaggacatcctcggtctttccggtgtagaagttttgtatttgaaaaaccgtttagtttcgcattcctgacagcgtcttttacggcgtctggaacgacctcgacgccggtcacatggccggctttttttgcaagaaaaagtgagatcgtaccgatgcctgagtaaaggtcgtagacgttctcagagcccttcaggtccgcgtattcgagtgcacgtgaatagagcttttccatctggacagggttcacctggaaaaatgacttcgctgaaatatcaaatgaatatactcctaccttgtccgtgatcaccggctcgccccagatgcactcggtgcggtcgccaaggattacatttccggtgttttatttatatttacacagatgcttgtgatatcagggcaggcgaccgtgagccgctcgacgagattgtcgattgccggaatagactttccattataacaaggcagacatgacctgtcccgtgtggacgccgtgacgaatcaggatgtggcggatcaagcccttatgcgtagtttcgtcgtatgcacggactttgttttcatacatccagacttgatggcatctgtaatattctggttttcaggtgcgccaataaggcagccgactgactgatccggctctattatccggtgcgaatggtgcgcataaaaccccatgacaataccgccatcaggctgcatcccgaccgggatctgagctttgtttcgatagtgcagcgggtcgctcatgccaatgaccggctcctggatttttctaataaaatcgcggtcaaagccaccgatgcggacgagatcgtcctctactatctcctccttcatccgaagctgcgccctataagaaaattcatcaggctgcagccaccgcagcggtcagaaacgggcacggaggctcaactctgtctttcgatggttttaaaattttaacgactttagcgtagccgtaagtctttttcagcttggtaacatgtgccatgacaacgtcccccggcagtgctccgaccacaaaaaatgtcatcccctcgaggtggccgattccctctccatccttgcctaaaccagttatctctacttcaaatacatcatttttttcatgggattattatacttgctggaggattcttcacaagggctttcttgagggattactccacatgctggtgcaatactctgttacgtagcagtatttggtacttatttctccggctgcaattactgtaatcattatgatgtcggggtcgaaagcccctgtgcacttaaaatttcatatattgtcgtagtgatactgccaatatttgagccaaccatggtataataaaaatatacttatgggaggaatcagacaatggcattaaagaaaattccagccagcaaatgacgctcacggacagtttctgggggcttaccgaacgagagaaaaagccctggagaactcatgggccggaactttcgccgaggaaatttttccctcgattgatgaaagccgtttttccgtttatatagcgacaaagcttccagacccaacacgccagtcaatgtcattattggcgcactcctgatcaaagagcttttcgactactctgacgatgagatggttgaaaatctgatgcttgatcttcaccttcagtatgcgcttcataccaccagcttcaaggaacaaccattgagtgacaagactctcagcaggttccggaaacgctgctatgattacgaatccctgtataatgtcgatttgtaccatgactgtatcaatgacctcagcgaaaaatcaaaaagctgatgaaaattaacggggcgcatccggaggatggattccatgatgattgatccaacataaggaagctcagccgggtggaactgctgtatacctgtatttcaaggcttgccgccgtgatagcaaagcaggacgaaactttcctccctgcggaactgaagcactacgcagatccgaatgatttcaatcgggttatgtatcatcagagaagtacggataccgatgaacgcctgcaaactatcctgaaagatgcagacacaatcctccttatttcttccggaaaatatgacacgctgcagacatatgaactccttgtgcggtgcctttccgagcagaccatcattgaagatgggaaacgccggcttcgtgaaaagagtgatggcaggatggattcagcaatgcttcagaatccctctgacccggacgcaactttccgtataaaggcaggaaaaggacacagaggatacgcgctaatcttgaagaatccgtcggcgaaaccggatcgtggtaacggattccagtatgatgtaaatactcacagcgacagtgctttcctgaaagagaatctggaagcccgaaaaaatcagatgaaacaacaaccattgtaacggacggtgcttattacagacacgatgaacaccaaaccgcaaaagaaaaaatgtcgatctgatcacaacagctcttacaggaattgccactccggactttttgctgattttgaattcagcgaagacggaagaacgtcacaagctgtccggccgggcacgttccgggaagcttgtgctataggaattcaaacggaaaatgccgtatttcattcccaggtcaacatgcgagagttgtcctcatcgtaatgaatgtaatcctccttttcataagcagacggcaagcctgaacatttcccttaagggagaaaaccgggcaaaatgtcacgggaaaatggaggaagaagttttcaaagactactgtcgctaaggaacggagtagagacactgccatcaaatctcagaaggaattttcatttggaaacacttccgaggggaaagcaacgaggtaaattctctttggttccaaaataggtgcattgaatatcaggaagctcttcaattatcggaagggctggattaagtgtgcccagaatccgctgtatgcataaaaacaggatggataccatgcccggatagacagattcagacattaaagctgtacaatcactacaaaatatgaaattttcaaggtgcaccagaggtctggcccgatttaattacgagtttcgaccccgacatcttcttattttacattttcggtccagggaccatataataaaaatacggtactggaatgtgcacatcgtagagccaaggtcacaagaatatgtaaaaaaatctgaacatatgaaaactcactgattaaagtttcaattacaattaaaagatattaaagggggattgataaaatttcaaacacaaaataaagccacatctttcttttacagggaaatgcgatacacttattcggcgcgatgaaaaatcagcgtatattttttaatctacatataggagatgttattatgaaaagaaaaatgttaagccttatactttctgccgttatagctgcatcctgctttggatgtggagcatcaaaaagtgcttctggagatgtttcgccggaagacaactaaggcagaaactgaagatgaaacagagaataatgaatcggaagaaaagcctgaaacatctgtgacagatactgaagaaattcagaatccgagacaaaagaatatacagatgatcagaacgcttctgacagcagtgataaatctgatgaggtcgataaaaaagcttttaataaccttctgaatgatataataatctcgaagttggaacagccggaagctcgttaaaaacagcggcaacaacagccgccttctgcgattttctgtactcaacacctgaatcagctggtgacaaactcacagcggattttaagaattatgtttcttcggctgacaaggatacatttcttgccaattttgagatcattgaaaacgaatacagggagttcattgattcatccgaagacgaatcgtctctcttagacgacgctggagtctcaactcgaaatatccctatgatcatagaaaatcccacttatggaaaagctctgtgaaacggcaaagtcgcttaaaaacagtggccagtctgatattttctgcctatccctcccacgttctttcttgcggtccaccccttccggtgttataatttttcccatgaataaaaaagtactacacacactggaatttgacaagataattgaaaggcttgccgcatttgcgacctcggacaagggacgggaatatgaggcttttaaacccgatcagcgacattgacaagatccgcgtcagacagaaagagaccggagatgcactgcagaggctctttaaaaagggcgacgtgtcattttctggaatccacgatccgtatatttacaagaagcgccttgagattggaagctcgatgaatacggctgagcttctctctgtggtgagcctcctcactgtcgcctcgcgaataaaaaaatacggcgagccaggcagaacagagactaaagcagattcgctgactcactatttcaatgagctcgatgacatagagacactcagaaatgagatcagccgctgcattgtttcagaggacgagatcgcctcggacgcgtctccggcgcttcgggctataaggcgccagatcgggctgatgggtgaccgcatccattccaaaatgacagagctgctcaattcccagaagattatctgtctgactccgtgatcacgatgcgtgacggaaggtactgcctgccggtcaaatccgcacaagagctcggttccgggaggtgtcacgacatctggatccgtgctactcttttcatagagcctgctgccgtcgtgtcactaaataacgagctccgcgaacttcagctcagtgagcaggaggagatcaagaaaatcctcaaggagctttcagaaaaagtctacgaatatatcggtacgatagttcaggatttctgatctcctctgctcactgagctgaagttcgcttttcctcgaggtcgttatttagtgacacgacggcagcaggcttataaaagagtagcaccgaccagactggtctgaaccatgcccggaaccgagcgcgtgtgctcggatgaacggcaggcagtaccttccgtcacgcatcgtgatcacggagtcagacagataatctctctgggaaatgagcagctctgtattttggaatggatgcggtcacccatcagcccgatctggcgccttatagcccgagcgccggacgagacgcgtccgaggcgatctcgtcctctgaaacaatgcagcggctgatctcattctgagtgtctctatgtccatcgagctcattgaaatagtgagtcagcgaatctgctttagtcctgttctgctggtcgccgcgtatttttttattcgcgaggcgacagtgaggagcttacaccagagagaagctcaggcgtattcatcgagcttccaatctcaaggccgcttcttgtaaatatacggatcgtggattccagaaaatgacacggtcgcccttttaaagagcctctgcagtgcatctccggtctctttctgtctgacgcggatcttgtcaatgtcgtgatcggtttacaaagcctgcaagtattccgtcccttgtccgagaggtcgcaaatggcaagcctttccatatctgtcaaattccagtgtgtgtagtacttttttattcatggggaaaaattataacacggaaggggtggaccgcaagaaagaacgtggggataaggcagaaaatatcagactggccactgttattaagcgactttgcctttcacaggcttttccataagtgggattttcttatgatcatagggatatttcggttggagactccagcgtcgtcaagagagacgattcgtcttcggatgaaatcaatgaactccctgtattcgtttttcaatgtctcaaatgcaagaaatgtattctgtcagccgaagaaaacataatttaaaatccgctgtgagtttgtcaccagctgatcaggtgttgagtacagaaaatcgcagaaggcgggttgtgctcgctgtttttaacgagcttccggctgtttccaacttcgagatatttatatcattcagaaggttataaaagctttttatcgacctcatcagatttatcactgctgttcagaagcgttctgatcactgtaattcttttgtctcggattctgaatttttcagtatctgtcacagattttcaggcttttcttcgattcattattctctgtttcatctcagtttctgccttgttgtcttctcgggcagaagacatctcagaagcactttttgatgctccaaatcaaagcaggatgcagctaaacggcagaaagtataaaggcttaacattttttcgtcatataacatctcctaatgtagattaaaaatatacgctgtttttcatcgcgccgaataagtgtatcgcatttcccatgtaaaagaaaggagtgtggctttatttttgtgtttgaaaattttatcaatccccctttaatcttttactgttaatgaactttaatcagtgagttttctctgttcagattttttttttttttaacatatttgtggacctggctctacgatgtcagcaattccagtaaccgtatttttatttaatatggtccctggaccgaaatggtaaaataagaagatgtcggggttcgaaactcgataattaaattgggccagacctctggtgcaccttgaaatttcatattttgtcgtgattgtacagcttgtaatgtctgaatctgtctaccgggccatgcgtatct

SEQ ID NO: 5 - DNA, 3324 bp, Unknown
  Metagenome-assembled genome
agggcagcacagctcgctgtcggcaatctcgcgccagtcaggatcggcactttcgggatagaacacaacaccagacgcggtgcctgctcccgcgaccacggttctcccgctcccactgctttttcttctctgggtccttgaaggcatgaaaaaacctccctatttgggaggtcacatctcgaaatctctcacgcaccggttatactcaatggtggtgctgatacgagtcgtgacctcgtttatcggcgttctaagtgctgagaacacttagaaccttcggccaccagtataaacccgcccgccttattccggtaggcgggcttttcctttctaatcgcagtgagcggcgcgagtccttgcggattacccctaggaagtcctcaggctcgtaggcatcgcatcagccgtcaatcatctttcggttatctcctggccgttggcggcgacccacgtcttctcgctcatcgtacctcctttcagtagcctcttctctcttgcaaacttcctctgcactggcgccatagcgtgtatcacaagccaaccagagaccgtctcggccgctatcagctcaacgtccctccccatcggccagccagccgaccatgagccatctagggggctcctgagggctctggcgcataatgctcttccactttaagaacacaaaaccgtgaaaaccctaacgaacaaaacccgttgggagcggtgcggcgtcgcaccacccccaacggtgtgcaagatgtaggaagtgtggccacaaattccactaaagtggagtttgtggccacacttccatcttgctcacggaaggctttaggagccttccgtgagtgaaaagaaaccgctattttccgtggcggaaaattccggagtcggcattctgccccttcggattcgtgcatctagtaaacggcggcggcgccgtttttagatatttgccgtcatgcaataatttccttgtctcaaacgcccctgctgccgccaagcttgctggggcttttctttttatctacgcctgtaaacctcgcgtctatgtgccacatcgaccacaagaatgacgagccttccgtcgtttatatcgcacagaattcggtagtcaccgaccctataacgccacacacccgccaagtttcctgtcaaagccttacccctgctccttggatcttcgagctgcgccacctcttcaagctcatcaaacactcgcgccgcaacacccttgtcgagctttcgcatcgccttatcggcgttcttcgtgaactcaattcgccaggccacagtgcaccctcacctcattgatgccgtaggtctcaagcttgcctgcgcgatagtcctcaatgtccttgagaatcccatactcgtattcgagacggccaatagcttcttgcagagcttcgttcacataaaagcttctcggcctgccagtctccctcgcaagcttgctataacgttcgttcagctctgtcggaatcctcatcgaagtaactgtagtagccatgtcacacctccttgatgtgtattacatgtactactataacatgctaccgtttgcagccatcacatccagggaatgggtcgatgggggagttcgtcctcatcgacccattttgtcctccgtcttccgtcacagtatttttaggacgtagtagctaaaaatactgtgacgatattgtgccacactataaaggactaaaaaagatcgcaagagtcgcgaatgggcacacacatcccattcaccggagcgaagaataagtacattccttctctccgtccgtggggctctgccccacaccctggccgcgcctaggcgcggtaagagacaaagacgcacgggccatcgcccaagacggattctataccccctctgaactgcgaaaatacgaaaatacattaccattgggtcggggtcgggggtcggcacccccctgcgagggggtcgtagaaagcccctcgcaggagccatccccgaccctttcccagccgaagactcaggcaaggaaagggtcgatgggggagttcgtccccatcgacccttgtttcagtcttctctgtcagccgcccggtgtgtcaattccgcaatctgcgaacgagggctacgcccccgttgtcgccgattgctacattgactcacctactccatctcctcgtgctgttccctaaccatgtcgcgcgcaagcttcgccctgtagattcgcttcgctcgctgtttgtccatgtagttgccgatggcccacgagcacttgaggtcgagcgcacggctccaagcgtcgttgttctcgtcgcaccagtccacgaagtccgagaactcccaattgtgcaggctcacgttgtcacgcagccaggtgcgcatctccaccatcgtggcgtggacgtcctcaagctccgagcaccagtcgtgccagttcgcgccgccgaactccaagacctcggcggggtcgtactgcgccttgccctcgctgccgatgtggcagaggtagagcgccatgcttcccttgctcttcgcgtacttgatgttcgtggtgccgaggaacgcaaagtcctccttgaccgtctcgtagtcaaccggctgtgggtactcgacaaggccgtgccagtgcggcttcttgagcgtcccggccacgtgcttggggttctttcgctcgtcgcgctccgtccacgcatccctgtcatgcaggggagagacgcagaagggcagcatcagctcgctgtcggcaatctcgcgccagtcaggatcggcactttcgggatagaacacgaacatccagacgcggtgcctgctcccgcgaccacggttctcccgctcccactgctttttcttctctgggtccttgtaaggcatgaaaaaacctccctatttgggaggtcacatctcgaaatctctcacgcaccggttatactcaatggtggtgctgatacgagtcgtgacctcgtttatcggcgttctaagtgctgagaacacttagaaccttcggccaccagtataaacccgcccgccttattccggtagggcgggctttttcctttctaatcgcagatgagctgcggcgagtccttgcggattacccctaggaagtcctcaggctcgtaggcatcgcatcagccgtcaatcatctcttcggttatctcctggccgttggcggcgacccacgtcttctcgctcatcgtgacctcctttcagtagcctctatctctcttgcaaacttcctctgcactggcgccatagcgtgtatcacaagccaaccagagaccgtctcggccgctatcagctcaacgtccctccccatcggccagccagccgaccatgagccatctagggggctcctgagg

SEQ ID NO: 6 - DNA, 582911 bp, Unknown
  Metagenome-assembled genome
gatcaaaagccttgtcacttctttctcttcggttgtgaatctgactgtcccggctttctcctgtcggatatttctgaatatgttcagatacaaatgaagtcctctcgcggacgccatcaataatgagccgatggcctttccgtgggatgtcaccaagtattactgggtgaaattaatgttccgaaaactgagcctgccataaatctccttaaggaatttcaacaattctgatgctgttcggcttattgatcttaaatagggaaatttcaataaggatcgtctctgtcttatggtcaacaataaaagtgcgcatctcgtcagaatcgtggtttaacattacgatgtactttctcccgggagaacagccatagacttagggaaatatccactggtaggctcctgtcccttgtgtgtcagaagtcccgtcttctcgtcgcgggcaaaccagctgacaccgtgaaaaccatcgatagaaacgtagacatactttccatcatctgaataacgagctcactcgaaaggtcggaaagatttgcattgtcccagatagggatagcctggatctgccaaagtcaggctttccatccttagagaataggcgtaaacctctatctcattcgtaagttccctaatatatgaggaatctggccgtctgctgagacttctgggctctcgggcaggaatcgagttcgtatggatgttatcacatagcctcatcttgccatttctcgaatctagctacgtagacctttacctgattacgaccgtagtcagctccaagggatatttctcgtccggagtaagccttaccactcgataccttcgggtggtcgagtcttctgtcgtgtgagatatggctactccctgatggaaaatgccatctgcaacgccttcgatacttccgtcctcattcacttcatcatagtgcctctgccgtccgtggaagcctcctacgaaaaggatctttctcttcgaatcacaggtcacgcagcagcctctcataccgccgatattggcctggttgatcttcttgagatcgccatttttatcaatggagaatgaagcgacgccctcaatcctctatggaatagagaaactttccgtcacgcgatacatcgaggtctgaagcattatttataggctcaacgcctctctctgtaaaattccggtttcggatccacatcgtaaacatggataccgatactgttctcatgggtgtacgtcccacatatgctacgaatttgctcattcctataccacctctttgcgtcttaaaaggtcgcccggctctgcctcctctggtaccttaaaatagatggtctcctttggatgcggggcactcttgacagcctccatgtccgcatttaaaagcttatcaatctttacaggtatattatctccgttaggcttcataatttcaatagtttcaccgacagaaatttatttttctgtgaaatttttgcgaagccacttttatctcttcgatctcaccgatataggtggcgcctttttcgttatgtgctctcgttgtagatctgcgcttctgcgcctggctttccgtagaaaaaccggtcgagaactgtctgtaggtgcactccctgatctcagcctcatactttggaatgttatttctgtatttctcaactgactccgccaagtcgtccagttgccatgcggtatgccctgacaactgttccgacataggtcagtcttcatcctgccttcgatctttttgagtcaactcccgcatccaccaggtcatccaggtggcctaccatattaagtccttggaattcataatgtaggtcccgcggtcattttcctcgacagaaggtattcgcccggccttgtctcctcgacgagagcgtatttccagcggcacggatgggtacactggccctggtttgcatctcttccttgtaaaatagttcgatagcagacatctgcccgagtacgaaatgcacatggcaccgtggacaaaatctccatctcgaggtcatccgggatatgggctcttatgtcctttatctcggcaagagacaattcccttgcccgacgactcttttagcgccgaggctgtgccagaatttaaatatctcgtagttcgtattgttcgactgtgtagagatatggagatcagtcttgccgttggtgataagctcttttgccatcataaaaatgcctggatcggcaatgagaagcccgtctggtgccatttcgttcaattcttttaaatattctctgacaccttccaggtccctgtcatgggcgaaaatatttacagtgatatagactttgcgcctctgtcatgggcgaattttataccacttacgatctcctcgtttgtgaaattgtctgccccggcgcgcagcccgaagctctcaccgccaaggtagacggcatctgcgccgtaccttacagcatttttaaaactgaaggtttgctgccggtgcgagcagctctggtaacttatccattctttcttcctgtatgctgagacagctagaccatctccgaccggaagtacggtcgagacaaagactcatctgtctgaatatctgaaaggtaggcccgatccgcttgtggatcgtcctgtcgcggcgctctaaagcctcctttggctctaagatcctgccgtcctgtaaaatattgtccgcagtgataacagccttatccgcaagaagcggtccaacgagtctaaggtactccggatactgccccttggcggcatcgataaatacgaagtcgaattttccatcgagattttccagatatctgcggcatcaccagcagaaaggtgactggcgcatcaaatcttctgaaattcgctctggcctctcttatcctgggctcgtagtcttctatggtacaagctctttcagatcatcgtcaaatttgccataagaagggcagaaaatccgaccgcagtgccgatctcaagaatacgctctggacttatgagttttcataagaaggccataaatcgctgcgtatcatctcttatgaacaggcacatgatctgacagggcttttttcttaatctgataaagttcatccgcagcttgaaagggtaacttcttaagaagtcctgaaacctgtcgtagtcttcaaaaatcatacttcctgaatcaccggaaggatcataggatttctctgtgtcttcttccagacgtagtctgaaaggacgttcttgacctcagtcttgatgcgagaccagtcgcgtaccttctgatcctctaaatctacaagtttgtcagatactatctctttggcatcctccatcaaatcctccgaatccttcacatagacgaatccgcgggatacgatgtcagggcctgcgcgatagtgcccgcttgcgctgtccattgccataactacaataatgattccgtcctcagccagatgctgtctgtcgcgaagaacgatatttcctacgtctccgactccaagacacatcgaccataactgttccggtgtgaacgtggcctgtgacctttgcctgtcccttcctcgttaaactcgaggacatctcctgaggataagatcttatatgctctgtgtcgtatccaagtgccctcgcgtcctctcctgagccttcaggtgcttgtactctccgtgtacagggatagaatactttggctttacaagtgagtagataagctttatctcctcctggcaggcgtgtcctgaaacatggatatcacgaaaaatgacgtttgcaccctttcgatatagctcgtctataacgtttgaaacgtccttctcatttcctggtatagcacgggatgagaaaattatcgtatcgtcaggctttacgaaatcttcttgtgagttccgtttgccattcgtgaaagtgcagccatcgactctccctggcttccggtcgttatgataactgtcctgctgtcagggtatttgttcaggtcgtctgccgagatcagtgtcttctcagggaacctgatatagccaagcttctgggcgatgtcgatgatagttaccatgcttctgccctctacagctacttttctgccgtatctgtaggcagtatttatgatctgctggacacggtccacattcgaggcaaatgtagcgataattatacggtggtcctctgtttctctgcaaatatatcgttaaatagttctccgacagtgctctcagacggtgtaaatccaggtttctcagcattggtcgaatcgcacatgagtcctaagacgccgtgtttttccgatctctgcgattctctgcagatcgatcgtatctccgtaaccggtgtgtagtcgactttgaaatctccggtgtgcattatgactccgaccggagtaaagatggcaagtgcagcggcatcctgaatgctgtgatttgtctttatgaattctaccttgaatggacctgtctgaatagtctggccgtattttacgacctttcttctggtcttttcgagaatgcctttttcctcgagcttgtgatcgattatgcccatcgtaagcttcgtagcgtagatcggcgcattgacttcgcggatgacatagggatagctccgatatggtcctcatgaccgtgagttatgaaaatcaggtgacggtaaccaaaagagggaggaccgataggaagagagaataaaaagtgggcgggaaagctgaggtagatgtgagcgaggaaccgacgaaaggggacgggatagaaaacaaggagcgaacacatagaagaagggtggacggagagagggagagagccagagatcgaaaataaggacagagagaaaagacagtaagaaagagaggaggaacgagagaggggcaggcggagcgggaaggaggggacaaagcaagggaaaagggggaatggggagggggagtggagaaagggcacgagtagggagaaagggtagggaaggaagggcgaaatgcaaaaggggggaagaataggtgaggataggaagggtaaaggcaaggaagcgcatggaaaatggacaggggggaggtgaagggggaaaagaggaaggagaggatcaaggaacgggagggagactaaagaaaataagacaggaggaatacaacgggggacagaaagaggaggagagagaagaagtaaacaaaggaggagggggggcgggcggaaacggagggagggcaaaaaaaatgaaaagtagaaaggggaatgaaaggagagtggtgcaagaggggaaaggaaaaaaagtggggaaccaagcggcagaaaagagactgcgacgaaggaaagaggaaatagaaaaaccggaagtgagcgataagaagagagtgggaaacagaaagagaagaagaagaagaaacgcaacaaaaaaggaaacggaggaaagacagaacgaaacaaagcaggagaaacaggggaacgaaaaagcgcgagaagcaaaagggagggagaaggaagaacggaaagagggcaaaaaacaaaataaacataaacgaaagagaacaagggtaaagaacaagggagcacacagggtagcaagagacaacaggcggcgggacgacgaggaagagaataaaaagggaaatagaagcgaaaaaaacagtagcaggaaagaaaaggaaaaataaacaaaagtgagcaaaaaaagaaacagtgaggcaaccaagggaaaaagcagagaaaaaaagaaaaaaaaaacgatgcatgcaaaaaaagaagacgaaaaaagagacagaaaaaaacgctaaagaaatcgtcgggaagcagaaaaaaaaagggaaaaaaaaggaaccgaagagagcgaggaaaaaagggaaagaaaccgggcgaaaagagcgcatgaagcaaagcatacgaggaaaaacaaaccaacagtggaaatacaagaacgaagagagacgagtaaagtaattaaagaaggggaacaacagaatggaggaagaagcgaaagaggaaggagagaaccgaacagacagaaaggcggaggacgcgaggatgctgggaaggaggaaaggaggaagaaagagagaaacataacaggaagatagaaagtaagaagaaagacgacgagtgtaagatggaaaacgaaaaaaaagcagacgaagagggagcgaaggaaggaacagaaaaagaaaacagaaaaatgaaaccaaggtgaaagaactgcagagcgaaaagagaaggggaaaacgaagaaagaagggggaaaggcagacagcaagaagagaggcaaaaaaagggtaaacaggaagagtagggtagacgacagaaatggatcctaggcagggagaaagaaacagagagaaaaagaaaaaaggacgaaatctaagaaaaaaaggagaaaaaagaacgggggcggacaaagcggacagggtcgaaaaggaagaagagagagacatgaagaaataggaagggaaaaaaagaggaacagagaaacgatggagactaaaaaatcaggagaggaagagaagacaaaaaaaagatgagagaacagaacaagaacaaaacaaacagtatggtgagcgagcggaggaacaagaagaagacacgaagggcgaaaagacgctaaactaaggacaggaaggcaggaaaagaaaaaaagaaccaaagaaggaacagagaaggaataaaaaggatgaaaagacagggagaaactgagaaagcgaagagaaaaaaaagaaacgtaaagtagaaaagggggaaacaacaaaagccaaagaggataaacatagcgcttgaccttttctttattttcaaccagatattgatgtccgggatgcacatgtcgattcccaacatgtcttctctggaaatgcgagtccacagtcaacgacgatatcgtatccctgtactcgaatgctgtcatattcataccgatctgctcaagaccgcctaatggtatgactttaagatgtgcttttgtatgagttttcattatacctccgttttcaggcatagcttcacagagggcagtatttttgcatgaaaaaagagctgtaccgccttctgcgttccgctttgaattatcttctgtgtcacttaattcttctctgaaaacagcaaaaaccgcatcgatagtcttctgattctctataagctcatactcgagctcaccgtctgaatcactgtctttctcataatgtaacagtcagtctcctcctctttgtcaggatcctgatctgaaactaacagatagctatgctggtttataactgtctctgaaattatataaaaatcctgctctttaccggattcttcatcaaaaaactatttttccatgtcttaacatgtatgtctctaataagaactgctgcagcttgatccacagtctgcttgacttcgtggggattcttctttcctcccgctattatagtactctcagcctctatagtcgtaaaacgctcgtcctggtaatctaccggataccgagcttttgaacaagaaggtcaccaaacgctcttgtcacctggcacctgtctccctctataccgtcaaggcccgagggaaggcccagtacaatttttataatgtgatttcttcacagatctcccttatggcagcaatagtctgcctgtacttcgtcggtgcttcctctttatcgtggtaagcccctgtgcagtaataaaagtgggtcagaaactgctgcaccaacagttttagacccataatcaagtcctaaaatccgtccttcagccatcagtcttcccaggcttttctcttgatgtattccgaagaagctcctcaaccagctcatcgcgctcaaccttcatgatgaggcttctggcgttgttgtggcttgtgataaaagtcggatcgcctgacataatatcccgactatctgattcaccgggttatagcctttttcagaaagtgccttgtaaactaattcgatgatctccttcaccgaaatagaattatcgctcgtaaccttaaagtactgagtctgattaacatctttcataaaagttctccttcacgaatccaatccattttactgcactggcattttttcacttttcatatgatacaacaatcgcctgcttttttcaagactctctgaaaaggcggtatcttaggcttttaaataagcccgagcttctttagcgctctctcgattccgtcttccttaagaccagacgttacgatatcggctgcgttctttgcctcgtcggctccgcttcccattgcgactccgacgccagcgtgacgaagcatatcgagatcatttacgccgtcaccgatggagacggtatcacttaaatctatgccgcatttcccacagaccaggtcgataaccgtggccttgttgtgtccggcggggaccatctcgcagacctcagggttgtgtgacataaaggtgtaatcattgcctaagaccttttttacagcttctacgtcagcctcaggctggggagtggcacagctcattttgctgatctcccactttccccagttatcatcgatagatagaatattatttccaagctctctgaaaagtttctctccgtaagggtcgccggcaaaatcttttttttcgaggtagaggttgtatcttccctcgagtaccggcctgaaatggtattttcttatggtctctaaagtgtaagccacgaaatctgcaggtatcttgtagtaatactccactctgccattaagttcgagcatcgtgccacagccgctgcagatgccgtcaaaacctatgtctaagagattttttctcctgacaaatgacctcgagcggcctgtatttataaaggcgaggttcccatttttctgcagcgcgtgaatggcccttacagtgctctccggtatcacattgtgcgtatcccagagcgtgccatctatgtcaaaaaaaactgccttcataaatcatcccttcaaaaaatgtgtttaaagaaaatatccataaagcttacaggcgatcagcagatacgcggaagtccctctccctgcagtacgtcgagttctctctctcctccgaggtctgtgacctcgataagcctgccggttgaattcccggctacttttccaatgatcgcggcattttcgccgtactttgagttctttattatgtcaagagccttattggcatcagagccttttactattgcgacgagctttccctcatttcccatataaagagggtcaagtcctaagaggccggcgaaatccgctaccttcttcgttaccgggaccctgttctcatcgatagtgaatgtctttttcgactgctctgagagctcctttagaactgtagcgaggccgcctcttgtgatgtcacgcagtgtatgtacctcaactccgcttccaagcagattttttacaatgtcaacgagtggcgcattgtcggaacagatatctgtgtcgatgcacatcctctctgaaaggattgccgcatggtgatctcccatatttccggaaactattattgcgtctccgacttcagcgtttaccgctgaaatatcggtatcgtccgatacaaagccgacacccgcagtattgatatagagctcaccacttccgtttacgacctttgtatcaccagcgacgatctttacgccagcctcttttgcggtctgtgccattgagtgcacaaccctttttaaaagagcgattgagagtccctcctcgagaataaaaccgcaggtcaagtactttggtgtggcgccgcgcatcagcaggtcatttacggttccgcagacgcagagccttccaatgtctccgcccttaaactcggcaggtgtcacgacaaagctgtccgtagtcatggcgatccttccagagccttcgactacagctgagtcctccatcgcatcaagtgtctcgttcgtaaactccctgtcaaaaatattatcaatcagctctccggttgcgcttccgccgctgccgtgggccattattatcttatcttccatttttctccttaaaaatctgtggcacgtaaaatgagtaaatcagaacagtcacgcagaatggctcgctcattgtccgcttcgctcccaaatgtcgctcgccattctgtgtgactgttccgtctaacgacgtaatatgcattctgcgtgactgctccgacgaacattgtcataaaaagttctgcgtgactgcccatcaagtctaagttataaaatctcagccgtctgttcggtggtttgcgaggtatgaaaagcaagagccctctgtgcttaccatgcaggctccctgcgggttcattggcgtgcagaccctgctgtagagcgggcactcgtaagggcgcatctttcccatcagaaccttgtcacagcagcaggctggattggccttgtgatctttgtcgagtccgcggcttcctgcatcgagataactgtacttgggctttagaatttttcctgaacccttgaccgctcccattccacgccaggaagcatcgtatttttcaaaatatttatctataagagccctggcttcaggatttccgtccggctttaccaccgacggataaaaattctttacaacgccttttccataggacattacgatgccatatatagcagccagaagctccggccctttaaatcctgcgactccgaaaggtattgaaaatttctcagctatcggctcatacacatgaacgcccgtaaccacagagacgtgtcccggagctataaaaccgtcaatcggagcgcctgactccatcagataatctataacttcaggcatagtctttatagccgtaagaagctggatattttttatattgtttcttacgatctcatcgactaaaagcgcatagacaggagtcgtcgtctcgaatcccactgccgcaaagataaaattagtgtcgggatccttcgcagcgagatcaaacgtatccattggagaatagaccatctcaacacgcgcgccctcgcctcttacggacgagaggttttttggagtagatcccggaaccctgatcaggtcgccaaaagtcacgatacagttcttcggatccttcgcgagctcgaggagcttgtccacataagacgatggagtcacacagaccgggcagcccgggccgctaagcaggtggatcttcttcgaaagcattcccggaatgccatttttcgcgatagcgccagtgtggcttccgcagacctccatgatattcatttcaggcccgtcgtaatttttcaggccgtcttttacttgatctaatgtcataattttaccaaaaataaagaagggaatacgccctcagataaggacgcaccccctctctgacagactccaggtcatgcacctgcttcactgccaatttcactgaaaatatcgttcatttcatctgcatcctgttcagtcagtttctgaagaatgcagccggcgtgtaccaaaacatagtcacccgggtttatatctacaaaacctgtgcgcgcgtcgactctgttgccgttgaaatcaacgacagccttacggtcgtggcttcgcactgctattaccttaccaggtaaagcaacacacatgaaaacacctccatgtatttaaaaaatgatcaggcctgcggcttatcagctggttttgcagcagcatccggtgctgctccatccttctttgcagcggctgctgcggctgccttcttggccatggctgcctttatagctgcctgtttcttggcctccatttcagcttcatgctgcttctcagcctctgtcagaacgtgtgtctgagaatagatgtacttctcaggcccaggtgtctgatatccaggatttaagtagaggcacttcttagggcagactgtggtgcagtatccgcactgaacgcagtcgaaacgattgatcgtccatgtcctggtcttcctgtctacggtaattgctccaggagggcagactctcatgcacattccgcagctgatacactgctgaatatcgatatcaatgtgtcctcttgacccttccggataattgataggctcagcaggataattttttgtgaccggcttttcaaagagctgctttaacatagtcggtgcaaatttcattattcccatttttacaccttacctttctgtacagctgatgcacggatcaatagttacgcagaggattccgacgtcagcatactcacagtttttaagcatctcgcataatccttcgaggtttgcaaaagtcggtgtacggagtctgaatctgtcgagcatctttgtgccgttggcctttacataatagatagcctcacctctaggctgctcgatacgtgtaaagcactcgcccttcgggaagccctttacaggaacagacagatctccctcaggcatctttgcgaaagcctgacggataaggtctatagactggtgaatctccttgatacgtacttcgcatctggcgtatgaatcacagtcatttgaaataatcggctcgaagtcgaggtttccataggcctcatagcctaattttctcatatcgtatgagaggcctgaagctctggctacaggtccgcagcatccgatctcgtgggctctttcctttgtgatgattccgactcccttgagacgggtctgaactgaatagtctaaaaggaaagccttttcaacttctttaagctcttcctcaacaaggcctatctgctttaagatttccttttcctgatccttatttatatcgcgaagaactccgcccggctcaagtacagagaagatcaggcgtccacctgtcgtaagctctaagcagtcgagaactctctcacgaattctccatgactgatagaaaagtgactcaaagccaaaggcatctgatataaggccaagccagaggagatgtgaatgcattctcgcaagttctgaccagatagtacgcaggtactttgctctttcaggtacttcaacgttcattatgttttcaatagtctctacataaccgagaccatgtccgaatgaacagataccgcaggtacgctcgatgacataagtcatctgcctgaagtcttttttttcggtaaggccttcaagacctctgtgaataaaaccgatgttcgggacggcttctactaccttctcatcctcaagaacgaggtcgaggtgaattggctcaggcagtacaggatgctgaggtccaaaaggaactacacttctcttctttgccattacttgtcacctccgtcttcagaaacattttttacagaaccagctgcgttgtcgttacaaggactattttcagctgcgcaaagtgcctcttttaaagccttctttccagcttcaggaagcataggtgtctcaacgtttaatctgtagagcttgtccttatagtcaagagctatcatctcaatctggcagccaaaaagctcacgcatctcattctcatagaattctgcacaaggataaatagcagtaacagacggaatcttcctcgcaaggtcatcgacaacgacacgcagtgtatcaaaagtatatgcatcgtcgtcgctgaacgagtatgaaagctcaaaatttccatctacaaaggcagcacatgcctgatcaaagcgaaggccctgatgctttctcttcattacttcttcaagaagatcctcgagaggtatcacttccattgtgtttcccggattaataacttcagccattattctcctcctctcttctgtcttcctcagccttggcagcggctacttttttagcctcttcctcgtccttcatcttcttgtactgttcataagtaaggccagccttgaccatcgcgtcgtgctcttcagaacgcttctggaagagctcacgtgcctggatgataccgtcaatgatggactgcggtcttgcagcgcatcctggaacatagatatcgacaggtactactgtgtcagcaccgcccttgatattgtaggcgtctttaaatacaccacctgtgcaggcacagatgccgactgctactacaaccttagggcggggcatctggtcataaatctgctttactacaggctccgcctgagcattgatacctcctgtaataaggagaatatctgcctgcatcgggtcaccggtattctcgacaccgagacgctctgcatcgtagacaggagtcatgcaggctaaaacttctatatcgcagccgttgcagcttgaaccatcgtaatggagcagccacggcgatctctttacatttgccataattttctccttttacacttacttaatgaccatcagtacaagaaggtttacaccagctgaaagcagtgtaacgatccaggtcatcttaagcattgtctcccacttcatacgggcattcgaatttccgatgaggatctcaatgaagtaaacaacgagatctacaatgactgctgcaagaatgctccatgggttcctgttcaggatgaacagtgcaacaactccaagaaggaaaatattctcgtaccattctgtgatgttaaaaataccaaggttcttgccgctcatctcagtcgtgatacctttgacaagttcctgatgagcatggtgagaagtcgaaagatcgaacggtgcctttctcatctttatagtcattatgaacacaaaggcgaagaagaagccaggcatttttacaatcagactgtaatttgaatttacgatgtctgctgccctgaatgaaccgattgcaacgtagaagccaactgctgtaagaagtactgccggctcatatgtcatcatctgaatcagctctctctgcgcaccgatcgtggtgtacggagagttcgtaactgaagccgcaaagtaaaggaaagtggctgcagtcgacaaaacgaagaagcacatcagaagatcagtcccaccaaaaagcatcgcacctgtaaggaccatcagtgccatataactgacaagtaaaaagtgaacagaacggtttactacaacgtactgtttcttaaaaagcttagttacatcgtaaaacggctgaagtatcggaggtccgatacgtctctgcattctggctgagatctttctgtcacatccctctaataatcctccgaggaaaggtgcaagcactataaagcagatcgcaataattattctaattgaaaaatccatcagaatgcacctcctatgatcatagccatcataacgataagaaccgccatacttataagctggcatggtaccatcagctttctgataccaagtctgttagcgaaatagtagtttgaaagtgtcagtctcctctcgtttccgaaagaatctacgaagccgtcgttctttccggtattgataccactcatatatgagagtttctggttcgcatgcatcttcttagatgcctcataacttataacaggaactacgaatacgaagacaatgataaatacaagcaggtacagaatagacatcggaagaacttctgctgtctttccgaacatctctgctaagagaggctcaacgaaagtcttcgtaaggattggcataagcacgcaaagtaaaaccataagtactgcgtggattgcgattgaaatcttctcgtttggttttgtgatatccttaacaggctcctcgttcgtctgagcgatcagttttccaagccactttgtccagtagaatgaagtcgtagctgaaccgaagatgatcatgaatgtcatgatgatgttgttctcatcgatcgatgaacgcagtgttgcccatttactgataagcattccgaatggtgcaaggaacattcctgcgataccaataaacatgcagaaagcaaggaaaggcagtctgtagagaagtccgtgcatattctcgatgtctcttgaaccaagagagttctctgtagctccgacatcctggaagagaagggacttagatactgcgtggaatatcataaggaaaattccggcccagatggtctccggagttcccatgccggcgcaggcgaccatgagtccgaggtttgaaatcgtagacatggcgaggactttcttaccgtcgctctgtgcgatagcgataaatgaagccatcaggaaagtaaagccgccgacaaatgctaccatgtttccagtaactgtaccgtgcatagcaggtgaaagtctgaaaagtacatagatacctgccttaaccatcgtagcactgtgaagaagtgctgaagaaggtgtaggtgcgaccatggctccgagaagccaggtagagaatggaagctgtgctgcctttgtaagagctgcaaaagctataagtgctacagggacgatcgcgaagtctccgagtggagttcctgcagcctgctcagcaaagcttacaagacctgcaagagaattcattcccgtagtcatagcaaacattatgattccgatagtaagggcgcatccgcctagaaggttcatccacagtgcacggaatgaatttctgatggcgactggctctctggtatatccgataagaaggaaagaacatacagaggttatctcccagaacagctggatccatgtcagagaatctgaaagaacgaatccgaacatggcaccaaggaaaatgaagagaaccataaagaaatagtttcttctgtcctgtaccctctgatgaaggtaatgatgatagccgtgcatgtaacctactgcgtagattacaataagggaacctataacacctacgataaggcacatcaggattgagagatgatcgatgtagattctcggtgtctcctttgtaatgtagccagacttctcaagccatgtaatagctatcgtcggaacgatggaaagtatgcagatccagtactttctatacttgaaagacaggaaggtaactacgatcatcaggataaattctccgactatcgtagcattatcggcaagttccatgccctcactgtagagtgctatcggcttagtgcctccagctatccacatagccactaaaatgcccacagcagccatgattgccacacagctgatgtaagcgattgcattccttacccggttcgcctttgggttaagcgggatgaccagcatcaaaaatgcgatgatcattggaaaaataatgagaaacggtactatcggtacggtcatcatttttcttctcctttcatatttctaaaaattttaccattacagaacgcactgtacggtattttccgtttgatattctactctttctcattttaggattcaagaaaaccgaacgggaattctgtattaaatacggaacatttttataattagaatgatgttatactatcgttatgcatgaattaagttatatgatgagaatggtcgatacagctctcgaggcctgtaagaaaaacgacctgaaaaaagtaacagaaatggagatcagcgtaggtgaggccaccgggctgattccccactatcttaaagactactaccccaagtgtgtaaaagggactatacttgaaggctcagatcttaccgtacactttatccctgttatggcgaagtgctcggactgcggaagtgaatatcagccatcaaaagaaaatgactaccgctgccccaactgcaaaagttttaaggcagtgatagtccatggcagagaatttactctcaatcgtctgacaggtgaataaagccgtcctcgatgcgtgtcagttttcctgtcacaaattttcccgacatatcttcatctgaatcgtagagaacccttatgtattcaggtgtatagccgcaccagtaggtctttcctccaatttcagtcttttcttcgagaagtgcttcggcagcttttccgagatggcggtcgaggtatgcctgcttcattaaagcagcagccgctctaaggagctgtgtcctctctgccttctgcttctttgagagctgcccgggcattttttctgctctggtgccctgtcttactgaataaggaaagacgtggatctcgtagaaaccgaccttctttgcgaactcaagagattcattaaattcctcttctgtctcacccgggaaaccgcagatcatatccgcggtaagcgctggatcgtcgaaatattttctcaagtatccgactgaggtcaaaaactcttctggtgtatagtgcctgttcatacgggaaagcactgtttttgagccactctgcagagacaggtgaaaatgaggacagaagtttttaagctctgataactcctttgcgaaatcctccgtgacagcgcggggctctaaggatccaagcctgatgcggtgcactccgtcaatttttgcgacttccttaaccaggtctttaagttcaaagccatcataggagtagctcgtaagccttatcccggtcaggacaaattccctgaatccctgctttacaagctcatttacttcttctataactttctctgggcttctgcttctctcccttcctcttgcgaacgggataatgcagtaggtgcagaactgattgcagccatcttcaacttttaaaaatgccctggtgtgttcctctttcatcgagactttggtctcttcgaattcccattttcccttgttgatatccggtacaaaggtctctctggcattattgtcggtaagtcgcctggtctttagtttttctatctcttcattcagatggctcttctcgttatttccaaggataaggtctgcgactccatctcttataaggacatccttcccggtatttgcgtagcacccgcaggctacgactatagcgtcaggatttaaatttttcgcgcggcttatcatctgcctcgacttctggtcggcgacacgggtcacagtgcaggtgtttatcacgtagacatcggccttctctgtaaacggaacgatcttatagcctgctttcctaagttcctcttccataccctccatctcatatgcgttaactttacagcctaaattgtggaaggccgcagttttatttttcaattaaattaactccttttgattgacttttttcctgtgttgctttacgatataatcaaatataagcatatgtttttacaggagggaaacacatgagaacagtaaagatatctcttaattcgatcgataaggttaagtcattcgtcaacaccataagccagttcgacagcgactttgatctgatctccggccgctatgttatcgacgccaagtctatcatgggaatcttctcactcgacctttcgagccctatagatcttacgatccacgatgataacgatgccgctattctcgaagcattgaagccttacatcatcgaagaataattattatgtaaagatggtcccctctttcgaggggactttttttattccaggaatatatttactgaactattcgaaaactgcaacgattgagacccattcgccgcaggtgtttacctccgcgacatcgaagccgttctcctcaagagctttctttacctgctcctgcttaaaatcaattatgcctgacgtaagaagcactccgttcggcttgatcgcatcttttatggctggaagcataccaattatgatatctgctaaaatatttgcgcagaccacatcatagccgcttcccactgcctctttgactttactgtctttcgagaggtccccgatcacaaggttcatctttgaaatatcgaggtcatttcttttaaagttttcagccactgcgtcctctgtcgcaggatcgatatcagtagctgtaacagatgaggcttcctcgcgaagagctgtcattgaaaggatcccgcttcctgttccgagatcaagaaccttttcgccgccgtggatatacctgggcagctcttctattatcattctggtgctctcatgctttccagtaccaaaagtgattcccgggtccatgcgaaggatatgctttttatcggttttcggatctgattcctcccagcttggaactatagtgtattttccgaccgtaaacgtgtggaaatactccttccacttgtttctccagtccttctcatctgtataggaaatatcgatcgtcccgtcgcctatatcagtggtttttctgaggttatcgagtccaaaccttatatcttcgaggagcttactatagtctctgccctcttcgacatagaatataacacggctttttccatcgtccctgccacggtccgggacaagttcctcgtagttctctccctcgagtggagttaccgcagccctgtcctcgatctcgatattcgttatatcgtaatctaaaagcagtgccgagacgatgtcctctgccttttctgtcgtttcaatcgaaaatctggtccagcgcattatttttctccctgatatgtaagaaaagccataattccggccacagtcttcgcatcctctatctcaccggcaaaaattttcttctttaaatcctctgcgtcgcactctaagatctcgatgctctcgtcagggtccagatgctgggcggtctttttgacacagccagttgccgcatagacatctatatgttcatcgcagaatgcaactgtcgtgcgaagtgacagaagcttcgtccagtttgaggattcatagcctgtctcttcactgagttccctttttgcagtgactaaggtgtcctcagtaagtgaatcccgctttcctgccggaagctcaagtgtatatctgtcaagcgctggcctgtactgacggaccatcaggaatttgcccccggctgtgactgaaaccacagctgcggctcccatcctgtggtggatgaaatcatagtattcttctgtcccgtcaggaagcttcatggtatcccgataaaagtcaactaccgaaccagaatagatcttttcccttgcgattctttctacgtgctccatttttaaaatctcctgtactttaatagaactggaatcagctcatgcatgacatcagaagcatattcaacctgctccattgtattatagattgaaaatgaaaatctgaccgtcgactctaaaagagagtcctttaaatgaatagactttaatgtcctcgatatcgcaggtctgttcgaggagcaggcgctgccggctgaaacgtagatgcctctgtcttctaaagcatggagcagaacttctgcccttactccatcaacacttacagagagtatctgcggcgctgaattgtcatcgaggccggaatttatgcttatggcatctatatcggaaagccgctctgccagtcccctcttcagttcaaagaggtgtgccctgtgtccttcgaaatcagaaaacatttcagcgaccgcaacgccaagtccagcaatggccggaacattttctgtgccgctcctgtatccctgttcctgtccgccgccgaaaattatcgggtcgagttttaccttgtcctttttatataaaaatccagagcccttcggtccgtgtatcttgtggccgcttactgaaagaaggtcgatgttcatcttctttggtatcagcggcaccttgccataggactggatagcatctacgaaaaatactgcattcgggcattttttatggataagctcccctgccctggcaacaggcataacagagccgatctcgttatttacatgcatcatggctacgaggacagtgtcgtcacgaagggcgttttcaaggtcgtctaagcttatgacacctctctcgtccgtcggaagaaaagtcacatcgtatccttccttctcaagctccttaaaaggcatgtagactgctgcatgttctactgctgtagttattatgtgttttcctacgcgcctgttggccctgaccgaaccgaatatcgcgaggttatttccctcggagcctccagaagtaaatatgatctccttcggctcacacttcaaggtctttgcgataatctcccttgtctccttcagataattttctgctgtcattcccttgccgtggagggacgaaggattgccgtagtctgtaaggagaacctgtctcatcttgtcggcggccttctcagagcatctggtcgtcgctgaattgtcaaaatagcattccatttttacttcaccaatatcgtttcagtagtatcgtaagcggtctttaagaggccgtcgatcacatctttaagcttcgtctcggacttctctattgctgaaagcctcggcttcgtcacagggtgctttgccacaaagatcgtgcagcagtcctcatatggaagtatcgaagtatcaaaagttccgatcttctcagagatgtctatgatgtcctgcttgtcaaatccgatcagaggcctgaataccggaagcgttgccgcatggtctgtgacatatagagactgcatggtctgagacgctacctgtcctaagctctcacctgtaataagcgcctgatccttgtcaagatccgcaaaatgctcggctatcgtcatcatgtatcttcgcattatgatcgtaagctcatcgtgcgggcacttctcgtagattgccatctggatatctgtaaagtttacgatatgaagctttatagggccggtgtactttgtcaggatccttgcgaggtctatgaccttctgcttcgccctctcagaagtataaggcggcgcatgaaaatatgtcgcgtctattgtcaccccgcggcgagatatcatgtaccctgcgactggagagtctattcctccggacagaagaagcatagcttttccagacgttcctacaggcattccgccggcgcccttgtgtttgagaaaatgaaaattaatcctctccctgatctctacctcgaccagatatttcggatggtgaacatccacctttgcattcgggaatgcgtcgagaatcctgcttccaagctcgacgtttatctccatcgaattcataggatagtcttttctcgcgcgtctggcctctaccttaaatgtaaatggctcgtcgccaagttcttccttcagatactcgatgatctgggcagagaggtcatcaaaaccgttgtcgtccgtcattatgcacgggcagatccagatgattccgaacactttcgagagcgcatctatcacctcgtcatcatcgaagccgcttccctctacaaaaattcgtccctgtggcctcgtgactgtaaattctccgtcaatttttcttaaggcctcttcgatcctctttaccagagtctcctcaaaaaagtatctgttttttcctttaagtcctatctctccgtatttaactaaaaatgctttctccatgtcgtatccttatatattttttgtaaaattatcagctgactgaatagtcggtatccatcacagcaaaaaccttgtagtcagggtatgcctctttcacttgtgatactacctgattaaaggtcgaaaacctgtcaggtgaatcaaagcttaccacaaggtcaaatcttatcattttatcctcttcactcatataaaatccgtgcatctggataatataatcgtttctgcctgctatctcgcggatcttctcgcggacatcgatgacgtgctgatctttggtatttatagaatatacgctgatcgcagccacgataatcctgcatctgatatagacagcgtaggttatttttctaatgagtctgtcgatatctcctgcatttaaagtgtccggaacttcaatgtgaaatgaaccgatgtaggaatccggtccgtaattgtgaagcacgaggtcgtacacaccgtttacttcaggaaactccatcgcagcggctttgatctctttcgagaggtcgttgtctgatctctgccccagaatctctgagattatctcacgcagcatatcgattcccgattttatgataacgatcgagatgatcgcaccgagccaggactcgagtgaaactttcgtcagaagaaatatgactgcggcgacaagtgtcgatgctgaaataatcgaatcgagggtggcatcttttccggaatttataagtgagtcggaatttactctctttccgacactttcgacatagcgcccgaggaaaatttttacaaggacagcagtcgctactataattagagcaacagccgtgtaactcggcgtttccgggtgaattatctttgtcaccgactcctttaaggatgtgacaccggcgtagagcacaatgaccgaaattatcagtgcacttaaatactctattctgccgtaaccgtaagggtgcttcctgtcaggctccttagtggcaagcttcgttccaataatagtaatgactgaacttacggcgtcagagaggttatttacagcgtcgagcgtgatggcgatagaacccgaaatcacaccgattacagccttaaaggctgcgagcagcacattcgctaaaatagcaatgacactggtctttactatctgcttatctctctttcctgcgtttttaagtgcctcctgatcaggctgcaggatagaaacttcattttcatgaatatttgtttcagctgaagacataaatgattctccttaaatacaatcactatattctacaactttaaccgcaagttggcaaatcatatcttgcactaaaaaaagccgcgggtggaaaaatcctgccagcggccgtcagatatttggcataaattatagaaatgttttctcacaaagctctctcatcctgcctgctgccgcccttacatcctctcctgcaaaaatcgcagaaacgactgcagcgccgtccagccctaagcccttaagcttttcgatattgtactcctcaattccgccaatcgctacgacaggaatcgagacagcatccgttatcctcctgtattcatccagggatacgatcgacttcgcgtccttctttgtagcagagccaaaagccgctccgactcccagatagtcggccccgtccttctcagcttttacggcctcagcgacattgtgagcagtcgctccgatgataacatcatttcctaagatttttcttgcctcatcgaccggggtgtcatcctgtcccaagtgaactccgtcggctcctgactttttagtcacttcaatgtcgttgtcgacaattagcaaaacaccatttttttccaaaaagtccctcatctcaagggcttcttttacagtctcctcaggcgagagttccttttcacgaagctgaaccatcgtcgcaccgcctgcgactgcctcttttactgcatcaaaaagagtctctccactttttaaccatcttctgtctgtaactgcatagagcagcaggctttttcttaaatccataatagtctccatagacgtacgcatataacttcagaacgtgcgttatattaccactaaacagtcagagattcaacgccttctccagcgaaatctttctgatattgtgatattcgagcagtgcgattatgaaaaaatgcaatagaaaattaaagttgaaatagaaacattcgcatatagattttatgtcagatcatcggagtcgagtattatcgtaaacggaccatgatttacaagtgatacgatcatctctgctccgaactccccggtctcggtcttaaagccctgctcccttgacttttttactatatactggtagagactgtctgccatgtcaggtgcgccggcatttataaaagacggtctgttgccatggtggcagtcagcatatagcgtaaactgcgagatcaaaagcagctcaccattcacctgacttagcgatagatttgtctttccgttttcatccgggaagatacggagaccgagcatcttctttatcattttatcggcgatctctttggtgtcatcctgaccgattccgatcaacaccatatagccttttccgatagaaccgactgtctcgttgtcaatgtcgacctttgccttgtcgactacctgaattacaaaacgcataattgctcctcctttttgacatacattataatgtcaacattcatgagttttttgctttttcttttaaacattccccgtaagcctctaaaccctctccttcccgctttacattcgataaagcagtatgctatattaaaaaagcggtgtcaaaaatatcttgacaacgagctggatttatttaaattgatttaactactttctgggaggtttgaatggataccgaagtttcaggaaataagagtactgcctgtacagttatcagagtcgttacagtgctttttctgattgcactgatgacagctgtttctgaagcgatgcacgacagggaaataatattccctgagatcgcagctctcgccgtcggttacatctgcgcgccaaagcgctcctgggccgtaaattcccagagaatgatgcttctgatctcagggtgtgcacttctcggacttctgatcagtatctttctgccgggaagcctttacataaagcttatcgcagcatttgcggctgcccagcttatctatatgttttcagggaccgggcttgcgccacttatttccgccgtcgtattgccagtccttatcgaatcgaagtcatttacttatgtaatttctgcggcaggaatgacactttcgataattattttccatgaaatatatgtcaaagcagacatcatcccttccgagagcttcgccccgagagcaaagcctggaaaatacgcttatttcagatttcttgcgaggactgctcttgtcgctgtttttatgctgatagcccttaggagtggatggcgctttatggcagctcctccgctcctcgtggcgttcacagaattgagcgagaaaaaaggtggcagattcccgtttaagcctgtaagcatcgtaattctcctgacatcctgtgccctgatcggctcagtctgccgacttgctcttacaatgacactcggacttcctctgacatccgccgctgtctgcgcagccgcactgatgctccttatcgtatacaacaggaaaatgttcatgccgccagccggagccatcaccatgcttgcgatgcttatcccggaaaatgccgtactcctctaccccctccaggtctgcatcggtatgacagtgtatatggtctcgtcatatttcatttcaaaatatttgaagtaatatttcttaattacaggccttattttgaaaaagaagctcttttcaagagcgcaacagtctcgacatgctccgaggcaaacgggaacatatccaccggctgaatcttatcgactttgtatcttcgtttcaagatttcgatgtcccttgcgagcgtatcaggattgcatgaaatatagacaatcttttcagggtagagcctgttaagcgacttcaaaaattccctgcccgctcctgctctcggcggatccatgaaaacaacatcagccgaaagatttttttcatagaagatttccgcagcatccccgcaaatatagcgggcttttttgatgccgtttaatctggcatttgcgacagcatcatctgcggccgcaggattattttcaatgccaaggaccgacgaagccttgtctgaagcgcagattcctatcgttccaatgccgcagtaggcatcgattattttttctgagccacccaggtctgcaaatgagaccgcagtctggtagagttttttcatctgctgcggatttacctggtaaaaagccagcggagacaggcggaaggtctttcccattactttgtctgtcagatatttttcaccgtagagaagagtcagatcgtctgtcagtacaagactgtcagtccttttattaatatcaagccagatgcttttcacgtgtggaaaatgcgaagttatctcttctataaggtgttttttgccagggataaacgagtcagcgcttacgagaacaagcattatatccccgtttgagaaactctgcctcataaaaatatacctcaggctcccggtctgtgtatcctcgtcgtaaaccttgatcttaagcttcggcagcaggcctgtgataaaatgcgccagcttctggcagtctttcgactcaataagacaaccgtctgtctcaacgacctcgtgagaacccttcctatacttgccacagattattttttttctattgaaatcaaaagcgaggctctcagtcaccttgtacctgtagtaatatggaaaattcatcccaatgatcgggagcacatcctttccgaagagattttccatcctcttctgcttcaggtcgagcgtcgcctgatactccatatttatctggtcacaagatccacagatcttttcatatctacacttcataaaaactcactccaatcacttcgtaatggtttttctaattatagattgcaacgccttttgcgtcaataatgcttgaaagcccgggaaaaattttacaagaaaataaaaaatttctgcttgactttttttaggaacgtgatattatataaatcagtaatgataatcattattaataaggagtgaccgatatgaagagattttcaaaacgacggcaactcattctggataatctcgcaggcaggagcgatcatcctacggctgagatggttttttcttcagtcagagatcagatcccgaatatcagtctgggcacagtctatcggaacctgaaggaactggccgagcagggaactatactgagtttctctcagaacggtaaggaacatttcgatggaaacagcaagcctcacattcacatctgctgtgtcaattgtggcaggatcgaggatcgtccacttccggacagtctcagatttgtgaatgaagacagctttttggttaagaatgtgatagttcagggaatctgcagtgactgcgctaagaagtcagaagtaagctgatatcttctctcctgtttttcaggagatatgatatacaaagagtatgtattttattttttaaggaggtaacattatggcaaagtgggtatgcagtgtttgtggttacgtttatgagggagaagagcctccaaagcagtgtcctgtttgtaaggcaccagcttcgaagttcgttaagcaggaaggtgagatgacctgggcttcagagcatgtaatcggtgtagctaaggacgttccagaggacatcaaggcagatcttcgcgctaacttcgagggtgagtgctcagaggttggtatgtatcttgctatgagccgcgctgctttccgtgagggatatcctgaagttggtttatattatgagaaggccgctcacgaagaggctgagcacgctgctaagttcgcagagcttctcggtgaggttgtttcaccttctactgaggagaaccttcgtgtaagagttgaggctgagaacggcgctactgctggaaagacagaccttgctaagcgtgcaaaggcattaaatctcgatgcaatccatgatacagttcatgagatggctcgtgatgaggccagacacggcagagctttcgcaggtctcttaaagagatatttcggaaagtaatcctactctcccaccactgattttcatatagcaatacgcagggccccgcaaacgcggggccctgtttttatgtcagggaggaatacagtccctcacatccagcttttatctccgaaaatgccttctcaaagtctcttgtataccatggatcttctatctcagtactctgattggaatattctgatagaagatggattttggaagcaaattcttctccacagatctgatggagataatacagattttctgaatcaaagccaatcaggaaatcataatccctggcatcagcctttgtaatctgcctggcatggtggtttccaatcggcatgccatgctccctgaacactctctgcatcggtggatacataggattcccgatttcctcggtactggtcgcagccgaatcaatgacgaaggaatcatccgttccgtttatttttaccagatgtttcatgatctgctcagcagccgcacttctgcagatgttaccgtggcagacaaacagtatctttatcatcaacttctcctggtgttgtcaaaatctaaattttttcattatcctcgttagtatcatactcctcgatcaaatcgtaaccttccagaaaccatccctgatagaatgggcgtcttttatttttttctttaaggtctcttcatcatgatactctgtaagctccctgttttcattagaatcatatacgacgagtttcctgtcgggatgctcctcttcaaaccttccaagcgataccggctccgcagtccagacacccgggatatacagattctcacgcgatgtgatacttaccggagtctgctctgcccactgttttacctgttcaatactcaccggataatagttattagcatcgacaccgacatcatatctcctgataccagccttgatatttgcttcgttgtactccggcccggaatgaatatgcccatgcagcatcacagaaccagccatagccttcggccaggacagcatcgggaaatgcatcatgatgatattcatattattggcattcatttttttgtagtaacccacatactcaaacagggattcatcatactggcacttctctggttcacctgtcatatcgtgatttcccagaagaagatacttcctcccatgaagcctttttaccaatgcgttagtctccccgacagtgatgtgatgacttacgtcaccgagtataaaaagcctgtcattaggaccgacacactcattaatgtgatgtatcagggcatcatccatatccctgtaatccttaaagggcctgttctgcatctttatcacagactcatgcccgaaatgcaggtcagccgtaaaccatatcatctgttaaatcctctcgaaagcccgccgaaggctgccatgccgattacgtcaaatccatcctggcgcagctgagcggttaattttccacttccacaacctaagtccaggcagctcatgccctcactcgttcgctcaatcatatcaatcagagcgctgccataatcagccacaaaagaaaaatgttttgaatagttatttgaatcccaagtgatattactcatttaaaaaacgtccgcacccctcacctgatgatactttccaatccgacacattcctcttctctgttgagaagactaccccgattttataaagcttacggttatcagcagcatatggaatagcgtaccctttgtcgtctatctgcgacatagcatcttcgattggtttgtccagcttgaattcaaagacattccaaaacgtctcgggcgtgaaagaaagtatgacagtctggtcctggcaagttcccatacatatctggttttatccacatatacatagccattctgccgtctttccataatatcagccgtcctttcagatgattaataagagaagtgtactctcctatcgtcggaaaaaaaacgggaacctgtactcaagccctctcctttcgaaagcccaagtctataataccaaaaaataccgttttatcaaagtcttaaacgtcaagaactatcattttagcaaaaaaaaatcaatagtgaaaaataattacagatgtggtatcctttatgcatgtataaagattattttaattcaatacactggacggttaccatagggacgaatcccggatttgatctggaaaaccaacagattatggattacggaaagtttgtggcgctttttcagagaataagtgaagaagagaaaaataaaagcggagtctggattactgcagtcattactccatcaaggctggcatatcgtcacagcgctggctgcccgataggtggcgaatatgcgtacactctgaccggcagctgtaatacggagtttgcaagcgttgacgactatgtaccagctctaaaaagagttctcgcaaaattaaaggacgaactcagacaggtgacatttacacttgagataatcccagctcatcttgtgttctacaatgatgagccaggatattcggaatgatcttttctttagattaacctgtctttaagaactatacaattatttttctgtacataagaataggcaatactccaaagcctactacgtgagagtttgaaaaaaagtctgtaaaagttttcatatagggtctttcatgatacaattattttaattcatggagggcctattattatggcaagaagagaaaagcaaccagtacaccacgttcagatgacagatggcaaaagagccatcatccaggggcttctgcaggagtatgatagtaagcgagttatcatggggcgtcagccccgcataaaaattccacgtccaggaagtgcatcctagatggagaaaacttataattcacacaagattttcagaagaatccggctggcaggcttttaaagcattttactgcactggcattttttcacttttcatatgatacaacaatcgccgcttttttcaagactctctgaaagggaaccccaggtgccaggcacctggggtggatatgatttctggtttgtcggaaacgtttatttttccagataatactttgtttttccgatgctctttttgccatactcgattgcgccgactggacagccgccgatgcaggcattacactgagtgcagtctttgccccagaccggtttaccattaaccagcttaatgtttccgagtggacagttcttatttgatcctgctcccgattccggcgcggactacccagatctcttcggcctcttttgcgagaaggcaggaagtgcggccgacaagctccgcccaaaaacgctgtctttcatcaatgggcactactccgcagccaactatatggcataggattatatcatttttctctgacaggatttgagaagacagttcctccgctgcggtatctatatctgttttagtagcattttcacaagaattgatatgagtaaaaagctggtcatcagatgaatcgatacatgatttgtcttcctgagtatttgatttgaactgtttttttagaaattgatctgctatctcactgacattttggggaagaatactctttcctgggaactgactctccgcgaattctctctctccctgatacctgccggaaatgataagaatcataggaacagtcccttttcgctgaaaataagaagcattgggatgtctccgtcgtgtgtcggaactttgtcagccatgcactctgaatagcatactccgatccgcatcacatccggatattttttaaagaacctgtcgtagtaccccttaccgtatccaatgcggtttcttatcttgtcaaagatcaggcccggtgtaaatgagacggcctttccaccggtgtactcttctgttctgtcggtcggctccatgacatgaaaagttccctctttaaaggaatttaagtcatttaccttgtaaaatttaatattatctccctctgtcacaggaaaatagaggctttttttcttcatcaggataaaccctgccagagacagcagatccacctcgcttccgagtggatagtacatgagaaatttatcgtaggcggcgaagagaaagtcccaattatttaaaattgcattaactatctcttcggagtatttctgcctctcttcggctggaatattgtcgcggatttttttatatcttgctcttaaatcgtctgaagccatagaacctccttatagcagatgcatctgtcttattttttctgattctcgtttcccctcactgcaagcctgtttatctgagtcgcaatgtaaccggcgccgtatccgttgtcgatatttacgactgaaatgccgttcgcacagctgttgatcatcgtaaggagtgccgaaagcccgtggaaactggcgccgtagcctactgaagttggaacagctataacaggattagatacaaggcctccgattacgctcgcgagagcgccctccattccggcaacacagatgacgcagttggccagctctatagcatctgtctttgataagagcctgtggattccgcttactccgacatcgaagatcctctcgacattgcttccaaagtactccgctgtctgggcggcctcctctgcgacagagatatcggccgtacctgcggtgcagacggcgataaggccttccttttctggaagggtctgcggtgggactttaagaatcctgctgactggatcgtactcggcatctggcagggctttttttaaaacttcatactgatgcttactggctctggtcccgaacgcctctccatctttttcgactaattttttatagattgatacgagaaattcgtcattttttccctgacagaaaacaacttccggaaaacctgtccggcgctttctgtcagtgtctattttggcaaaacccatttcttcgtaaatatggtccatatataccctttacataaaatcgaagatcgaaagctggttgctctccggcaggtcttttagaaggccgaggcgcttcatagtctcacagatagtctgcgaaaccttgccgcgctccctcatatcgtccattgacaaaaattcctgctgggaagcggctattgccagcgattcagcggctgtatcgcccatcccgtcgatcgatgagaatggaggaagcagcttaccgtcgattatctggaaataccttgcatcggacttgtagagatcaataggcagaaattcgaagcctctcgcgtacatctcctgaacgatacgcatatccctgtagcttcccttgtcctttgcggtcagcttttcgccgctcttttccttgtcctctatttcctgcaggtagtgctttaaggtctcctcgcccatacacattttctcgtaggagaagtctgtggctctgatcgagaaaaatgctgcatagtaggccagaggatagaacaccttgaaataagcgatcctccatgccatcatgacataggcggctgcgtgggccttcgggaacatgtacttgatcttctcgcaggaggatttgtaccagtccggaacgccgtgatccttcatgtctttgacccattccggccactgtgggacagcacctttggcgacctttcccttacggacacgctccattatagtaaagctctcctccgggtctagtcctttgtttataaggtagatcattatatcgtcacggcagcagatacaggtcgaaagagtagccgtgccgctcttgataagctcctgtgcgtttcccagccatacgtcggtaccgtgtgagaggccggagatcctgatcaggtctgaaaacatctgaggctttgcctctttgagcatctccatcgcaaaatccgtaccgaactcagggattccaagagttccaagctctgtgttcttccatagctgctcaggctttaccttaagagccgaggtatctttaaagagactcatgacggatttatcgtcgagcggtatctttgtcgcatcgagccctgtcagatcctcaagcattcttatcatcgtaggatcatcgtgtcctaagatatcgagtttaaggaggtttgaatcgatcttgtggtaatcgaagtgagtcgttacgatatcgctcgtcatatcgtttgccgggtgctgtaccggcgtgaaggtatcgatctcctctccgactggcagtactacgattccgcccggatgctgtcctgtagtccttctgactccggtgcagccttcgactatacggtcgatctcgcagtgcctctttgaaataccatgctcgtcgcaatagtgcatgatgtagccatatgcggtcttgtcagccagtgttccgatagtccctgccttaaatgtctgcccgtctccgaaaattacggctgtgtaggcgtgtgccttagactggtagtcgcctgagaagttaaggtctatatcaggctccttgttgcctttaaatccaaggaaagtttcaaacgggatatcaaacccctgtttcgtaagctcgtgtccgcagaccgggcagactttatccggcatatcgcagccggagtttcctgcaaatgcctttacttccggtgaatcgaagtccacatagtggcacttcgggcacagatagtgaggtggaagcggatttacctctgtgatacctgccatagtggctacgaatgaagagccgactgaaccacggcttccaacgaggtaaccgtcctctaccgacttccataccagcttctgcgcgatgatatacattacggcgtaaccgtttgaaatgatcgaattgagctcacgctcaagtcttgcggaaacctgctttggaagatcgtcgccatacatttcgtgagcccttgtatagcagatcttccttagcatctcgtcggaatccggaattacaggaggacacttgtcaggcctggtcggcttaataatgtctaccatgtcggctatcatattcgggttatctattactacctcatgagcttttttatcacctaagtaggagaactctgaaagcatctcatctgtagtgtgaagataaagaggcggctggtggtccgcgcccttcatctccttttcagcctggattatacgtctgtagacctcgtcctcagggtttaaaaaatggacatcgcaggtggcacagacaggcttattgaactcttcgccgagggagacaatttttctgttaatgtcgtttaagccctcttcgtcggtgataccgctcttttcatccgaaagcaggaacatgttatttccgttcggctggatttcgagatagtcgtagaaatttactatccttgcaagctctgcgtcgcttcgcccgaggagaactgcctgatagagctctcccgcttcgcaggcgcttccgatgataagcccctcccggtgctttaagacttcgctcttcgggactctcgggtatctgcggtagtacttcagatgcgagatcgaaacgagtctgtagaggttgatgcggcctacatcgtttttggctaaaactatgcagtggtgaggcttagatttcattatggcctccgggctcatttttccctgctcgtttaactcggacagagtatttatatttttcgccttgagcttctttgcaagttctataaaaataagtgcagtacactctgcgtcgtctactgccctgtggtgatgtccgagtggaacgtcaagagccttagcgacgttgtcgagtgtcagctttccaatgccggggatcagataccttgccatcggcatcgtatcgcaatatgtaaaatcccagtcaattccgagcttcttcgccttgttgtgaatgaagccggtatcgaaatccgcgttgtgggctacaaggacagcatctccgataaactctttgaattttggaaggattacatcaatcccaggagcgtctgcgacatcggaatcagtgatgctcgtaagctcagtgatcctgaatggtataggaatatgcggatttacaaattcactgaaacggtctaagatctcgccgtcttttacttttacagcgccgatttcaatgatctcgcacttgtcggcgtttagtccggtggtctctatatcgaatacgacatattcgtcgtctaatgtctgatcctttacatttgtcgcgatggtcttcgtgtcgtctacgagataaatctcgcagccgtagatgactttgaagtcttttaagccggatgcagctgaagctgcatctgggaatgcctggactacgccgtgatctgtaatggcgatggccttgtggccccactttgcggcctgcttaatgatatctgagacgtcgcttacgccgtccatatcactcatctttgtgtgacagtgaagttcgactctcttctctatcgcattgtccatgcgcttgatacgaaagtcgtttatctgcatgatgccccggatgcgcccgatcgatatctcgtggtcaaatgagtcctctgatgcatcgccctttatctttataaaggctccggccctgaccttttctttgatcagtgaagcctgctctttctgaaggaagagcttggcccttatcgtgtcagtaaaatctgtaatagtaattataaagaggacttttccgtttcttaactcccgatcctctgtacagcgtacctgaccgtggattatcacttcacccatttcggtcgtgatatccttgatatcgatgctgttttcatcgaaatctctgccgtagatcgtatcgggattcttcgatttcgtgagatataccttcttctcaaacggcttcttttcatttttgtcaggcgtatcgtctgaaggcttgtcgtatggattttcggctggaagaggtgcctctttttctgcttcagcggcttctttacctttattatctgctttttctacatttgccacaatatcggcaatttttttatgaatcagggcgtcctttttggcgctgtcgttctggtggtcctctgccggcacgtattcagtatcgattacgagatcaaggccaagcctctcgttaaaaatcttatcgagaaccgagacgagctctgagtccttcttgtggcagatgctcgtatcctcgagagatacgatgagtttattgtcctcgaaacggaatttgcttctctctaaaatctgaaagaggaccggagaagccttgtgaatttcctccaaaatgctgtctctgtacgaatggtagaggtcttcagcagaatatgtatccggcaggttaaaagattcgaagattcttaccctcgtgccctttccactgaaatactgggcttgtatcctgtcttccagcttccagatcgcgcgctttgggattatggtatcggatttcagatagacacggaggacagacttgtccctgttagtcgaaagtctctcaatctcgcagttctgcagtacaaaaccggtcttatcctgatctttaagttttccaaatacatcaaagaattttctttccatcaaaaatcctctatcgaaatccgctggatttatttgtttttctctgctctcatctgatcgagctcactgcgaagggcagaaagaagttcattttcaggcagtttctttacgatctcgccgtgctttattagaaggccgactccgtcgccaccggctattccgatatcagcttccttcgcctctccggggccgtttacaacgcagcccataacagcgactttgacatcgaggtcgtcgtaatcgtgcacaatattttcgaccttttcagccagtccgataaggtctatctgcgttctgccgcaggtcggacaggagacgatctcaacaccgcctttccttagccccagagtctttaaaatttctctggctgcatagacctcttccacagggtctgcggtaagagaaactcttatagtatcaccgattccctgacttaagataagtccaagcccgacagatgactttataagacctcttttaagagttccggcctcggtaataccgacgtggagcggatggtctgtctttgtgctgagaagttcatgagcctttacagccataaggacgtcggatgactttattgaaatgacaaggttgtcatatccaaggtcctctattattgctgcctcttttaaggcgctctcaactaaggcctcggcagtaacaccaccgtatttttcgagaagatctttttcaagtgagccggaatttacaccgactctgatcgggatgttgcgatctttagcacaatctactactgcctttacgcggtcccggcttccgatatttccagggttgatacggatcttgtcggcaccgttttcaatcgaggcgatcgcaagtctgtaatcgaagtggatgtctgccacaagcggaatgtgaatctgcttcttgatctccttaatagccctggcagcctccattgtcggagctgtacagcggattatgtcgcagccggcagcctctaagctctttatctgtgcgactgtggcggacacatcctctgtcctggtatttgtcattgactgaataagaacaggattaccgcctccgataaccctgtctccaatgtgaactacttttgtcttcataattgtcttgtgataatccttctgatgtcgtttcccatgataagaaccataagtaccataagaataacgaatccaaccgcgttaatatatgcttctaccttctctggaatctttttccgggtgattccttcgatgataaatataaggagccgccctccgtcgagcgccgggaaaggcagaagattcataactccaaggtttgcagacaagaggatcgtgatatttatcatgttcattacgacatagtagatgccatctgcaacagactccttgtaggtatctccgatagtctttacgataccgacaggacctgacatatcgtttattgtaagatgccctagaacgagctcctttaagctttgaaataccacgtagatctgatacttgatctcgtaaaatccgtactggatagttcccaaaaagcccggatgagtcatttcaggagaaccgacaataccgataagactccgcttaagcttcttgtcgtacttcggcgttatcgccgatttttttaagacgccaccgtgtctgtactttacattatagctgctttttttgtgaaaaaaagtataaacgctgatctcgttataaaaatgtatcgggtaaccgtcaatagagacgatcgtatctcctgccttaatcccggcctgttctgccggatagtcctttgtgaccccgcctacattcggtgcgtagtacccggctgaaccaatcataataagagacaggagaaaagccaggatgaagttaaacagaggtcccgcgaatacgatcaaaaatctctgccagagcggctttttattaaaggccctgtcatcctcgctgtcggaatcctctccctccatgacgcaggctccgccaaaaggcaggagcctcagactgtacttcgtctcacccttcccgaatgagaagagctttggtccgaatccgacagtaaattcatttacccttacgccacatgctttcgcaacagaaaaatggccgagctcatgaaatatgatgataaagccgaaaatgagtatggctattataatgtgcaaatcagtttcctcactatctcccttacgtcgcgctctgtctctaatatatcctcaaccgacggatcctcttcaaagtcggcctcttccatagctttctgtatgatctgcggaatctgcacgaagcggatctttttattaaaaaatgctgcgtctgcctcttcgtttgcggcattgaatacacatggcatattgcctccggcgagggaagcatcgaatgcgagctgcagtccgaagaacgtctccatatcaggatggtaaaaatgcagtgtctgtacctcgaagagatcgagcggctttacagtaagctctccgcggttcggataggtaagcgcatagtgaataggaatcttcatgtccgggacgcccatctgtccaattactgccccatcgtcgtattctacggctgaatgcaggatgctttcaggatgcacgaggacctggatgcggtttaccggaacgccgaaaagccagtgtgcttccatgacttcaagtcctttatttaccatgctggcagagtctattgtgacttttctgcccatggaccagtttggattcttaagggcatcttcaagtgtcacctgctcaagctcctcgtaagtctttccacggaaaggaccaccggaagctgtaaggaggatgcgctttatattttcactctcgtttcctcttaagctctggaatatggccgaatgctcggagtctaccgggaggatcttaacaccgttctttttggcaagcggcataatgatgtggcctgcggccacgagagtctccttgttcgcgagagctatagtcttctttttctcaatggcctttatcgtaggaatgattcccttcataccgactatggcgtttaagaccatgtctgccgcagaatcctctgctactgcattaaggccttcatcgccccagagaacttctatcggaagatcctttaaatcttcttttaaaatatctgcgtcctcttttccggcgcacgagatcagatgaggcatgtactttctggcctgctctaaaaggagctttatattcctgccgcaggctagtgaagagacttctacgtcgctcatctggtcgataacttcaagagtctgggttccgatagaacctgtagaacctattattgctaattttttcataagatcatcctaaaataaatgtcacaagataaaagatgattggggatgtgataagcactgaatcgaatcggtctaagataccgccgtgtcctggaatcagctttccgtagtcttttatgccgacatttctctttattgcagaggctgcgaggtctcctatcatagagataagtgctccaaccatcgaaaggagagaaaggagtacaatgtctccggtgctcatgtaaataagcttacttctaaaaatcataaggtagagcaggtttaaaagaaatgctccgacaactccgcctaccgctccttcaactgtctttttcggggaaaggaccggcgacatgtgatgcctgccgcagagtcttccgacgcagtatgcgcaggtgtcgcatccccaggatgtaaggaagataagccatacaaggtactttccatgtgtgtactcacgtgtagtaaaaatatacgaaagcattacagaaacatagagaggcccgaagaaaagctccgccgcctgtcgtatctcgtacctcggataagtcaatacatagaaaaacaggatggctacaagcagaaacactatgagcatcagtgagctaaatctccagaaataccttgcaaaataccaggccagtgtgaaaatataccctgaccaggctgccggttccttttcgagccctactgccctgtaaaattcaaagaggccgatcaatgaaataatgcaggtagaaacaagaagaactggacctcctggaatgataaaagcaagcgccaaagctaccagcacgatgctgcttattaatctggttttaaacataatcaaacctttccgtatctgcgatttctatgtctgtagctgtccacagccttctttaactcttcctctgtaaaatcaggccagtccaccggggtaaagtagagctcggtgtaggcaagctgccataagaggaagttagaaatcctctgctctccactcgttctgatgagaaggtcagggtctggaatatcagctgtgtcgagatatctgctgaacgtctcctcagtaatttcgtcaggatccttgacatctgcgtacatttttctcatggcgcggagcatctcgtcacggcttccgtagttgatacagatgcacagacacattccggtgttttcggcagtggcattttcgagctcagtggcctcttttaaaaggtcagcaggaagcccggatttgtcgccgattatgcgggctctcatgccctcctgaagacaaagcttctggcatattttcatatattttgcgagaagcttcatcagagttgaaacctcatcctttggacggttccagttctctgtagaaaacgcatagagagacagatacttaatgcccagctcatttgcggctttagttatcggttcgactctcttggctccctgtatatgcccgtaagtacgcggcattcccttggctttggcccatctgccgttgccatcgagaatgatcgcaacgtgttttgggaccggcagaagttcttcttccataaaaatccacctttaataaaaaatggggacttttcagtcccctctgtaatatttttatactgtcattatctctttggtcttattctcaatggctgagtcgaccttagcaacgtactcatcagtgagcttctgaatctgatcctgcagatcctttgtctcgtcctccgagacatcctcttccttgctgagcttcttgacaaagtcgttcgcatcgcggcggacgttccttacggcaaccttgccattctcacccatcttcttgacctctttggcgagctccttacggcgctcctcggtaaggtcagggaagaccaggcggatattcttgccatcattcgtaggattgatgccgatatctgacatcattatagccttctcaacttcctttacgagctttggctcccatggtgtgatctgaatcatcctggcttcaggaactgtaacattcgctacctgctgaataggggtaggagctccgtagtaatccaccgtgagcttgtctaagatgtgcgggttcgctcttccggcacggatagctgcataatccttcataagtgaatcgtaggatttctgcatcttatccttgaattcgtttaatctcttgtccatattttttcccttatactgtaactgtggttccgttaaagtctccactgacagcctttaatatgctgtccttctcatcgagtgcaaagacacgcatcggcatcttgttctccatgcacatgatagaagcggtaaggtccatgactccgagcttctgtgcgatgacatcgtcaatagagatcgtatcgtatcttctggcatcaggattcgtcttaggatccgaatcgtaaatgccgtcaactgccttggcaagaaggatcatgtctgcgccgatctcaatggctctcaatgctgtggccgtatcagttgaaaaatacggatgaccagtgcctcctgcgaaaaatacgacgtgaccggcatttaaatacttctctgccctgtccttcgaatagagcttggtaaatgaaccacactcgaacggcgtcagcacatttgtcataagacctgtgtgccttactgcctccgacatatagatgcagttcattatcgtggcgagcatcccgatctggtcagcctgggagcgacccatatcacctgaagtacggcctctccagaaattaccgccaccaataactataccaatctgaatgccggtatctgcgactttcttaatctgggcagctactgaagcggcatttgattcgtcaaaaccgaagcccttgctgcctgagagggcctcacctgagagctttaataaaattctcttcattgctgagcttcctcaccgccaaatacggcattgacatcgacatctgcataagcctgtgagcagaagccctcgatgatagcgccattgttgatctgaacgctcttggacttgatgttgcccatgactacggctgaagtatcgataactacaggtccctgaacatcgatatcgcccttaacagctcctgcgataacagctgaagaagcactgacatttccgatgataactgagcctgcaccaacatttacagtgccatctgaaacgacttcaccctgaatgcgggcctgatctgccatgaattcggatgtctgtgaatttccattgatagctcctgtaacggtaagctttccgttgcatctgacattaccattaatagtaccttctacacttatagatcctgtagagtcgagatcacctgtgatagtcatgcctgcagtgatgactgcgttctcatctgatgctgccgggcgggtatttaaagtgtcaagattgtctgctgctggtgtctggtaatccatagttctgtttacttcctttgattctgttgctggtttgactgtctgaggtactggtgctttggcaggctgtggagaaactgcctgcggtgtgatgttttcggtcttgtttactgcagaagccttcttttcagaactgtctgcgccaccatttaaaagctcagcaggtgtaacctgatgagaatctccggccggtttactctgaggtgcatcgaccttcttggaaaccttctccaaaaggccgtcgagctttgacagctcggaattaacatcgatgttcgaatcatcgatcggacctgcagatgacgtcttcgcatctgtcttgttatctgacatctcatccactgcatctgagaaatcatctttaaaatccttaaagaaactcatttacttacctccataaactttatttggtggaaagactgacatgctggatcagccttgtattatcatctatcggcaggataatatccccctcgccctgaatcttctggataagcttcggaagagcctcaactgtggagtctttcgcagcggcatcatgcatcagaacaaccgacgttctatattttaccacatccctcatgatattttcaataatttcatcagaagtcttcttttttgatgaagcatcttcactagatacattccagtcaaaatatcgcacgtgttctttgtcaagaaagcggatcaggtccgacatgtctgccctggaaactgtatttgaactgcctcccggaaagcggtagagattgctctttacaccggtatatttatagatcagtttctgaattctgaaaaaatcgtccttaaaagaagaaagagatgcatacacctgaccgtagtcgtgggtgtaggaatgcatccctatggtatgtccttcttttactatccgtttgtacattgcgacagagtgggcgtctgttctcccgtttacaaaaaaagtggctttaacattgtaatcatccaggatattgagaattttgtcagtgtttacgctcggaccgtcgtcgaatgtcagatagactttcctgacatcggattcatcggccaggttttcgacatcggtctttacgtcattagtctttatcgctgtatcctttgtcttagtgagcgccctggatgacttccgggtatttgccgatgaagcgtccttttccatcagtgtgcggacagtctcgtttaagtccttaacttccgaatataaatgaattgaaaaaattcccaggaaaattatagctgctatagaaaaaagaacccagaatatcagaaaactggtcagaaattttttcatgcggtggacacgaccaactttatttctacgctcccttatctggtctgcgttatcagtttcgttcatcattataaaaaaacaggcactgatactactgtacttgtaatatcagtgcccttaaaaatcaattgattactgcatctgctttgctacttcttcagcaaagttctcatttctcttctcaagtccttcgcctgtctcaaaacgaacgaattccttgatcttgaggtctgttccggcagccttagctacctgatccaggtacttggcaactgactgctttccgtcctcagccttgacgtaaacctgatccatcaggcatacttccttgagctctttgttcagacggcccttaacgatgccattcttaaccttctcaggcttcttggactccttctcatcgttctcaatctgagccttgatgatctctgtctcgtgatcgatgaagtcctgatctacatcagaatctctgatgtacttaggatttaaagcagcgatctgcatagctacgttgtgaagtgcttccttaacatcatctgtagggttcgggcactcagcgcttaagataacgccgattctgccgccgccatggatgtatgatacgataacaccgttgtcagctgtaagctttctgaaacgtctgattgaaagcttctcgccgataactgcgatctcctcgtcctgagcttcctttacagtcttggatggatctgcgatccacttgtcagccatgaagccgtcgatatctgtggcggaagtcttaagagctgtatttgcaacgtctttaacgaatgccttgaacttgtcgttatttgcaacgaaatctgtctctgagttaacctcaacgatagctgcggtatttccttcagctacgacatcaacaagtccctctgctgcgatacggttagccttcttctcagccttagcctggccgttcttacgaaggtactcaacagcagcttccatatctccattagtctcagaaagtgccttcttgcagtccatcattcctgcaccagtctgctcacgaaggtcctttaccatttttgctgtaacagccattttatctcctttatataaaaaacgtttagctaaatatcagattactctgcagtctctgctgcctcgacatcagcggcctcatttgcaggggcagatgcttcttcgccctgcttagcctcgataacggcgtcagccatctttgatacgataagctttacggcacggatagcgtcgtcatttccagggatgacatagtcaagctcatccgggttgcagtttgtatcggcgattccgataactgtaagtccaagtgagttagcttccttaacgcagagagcctccttcttaggatctactacgaatacagcatcagggattctgtccatatccttgattccgccaaggtttctggtgagtttctcctgctctttcttgaggttggctacttccttcttaggaaggacatcaaatgtgccatcctcagccatcttctcgatcttcttaagacgatcaattctggaacggatagtacggaagtttgtaagcattccgccaagccatctctcgttaacatagtactcgccgcagcgtgtagcttcctcagcgatagtgtctgaagcctgcttctttgtaccaacgaagaggatcgttcctccctgtgctacgatatcgaagatagccttgtaagcatcgtcgatcataccaacagtcttctgaagatcgatgatatggattccgtttctctgtgtgtagatgtacggagccattctaggatcccatctgcgtgtctggtgaccaaagtggacacctgcctcgagtaactgtttcattgataaaacgctcatttcttacctcctatggttatacgtccagctgtctcaactgcttcggaaacctctgcataaaaggcaccaccctctgcattaacagctgtgcaaaataaaagagaccactatggtctctcaactgagcctgtagtattatactacaggcaattataaaaatcaatagaattcttatttttttgtgatagcttctgctatctcgtggtacgaactgccttctttgatagtaaatgtaccgctgtgtattacatgatcgtatccattatgttcgagatattcgttgaaactttttgcagaggatacaagtcctgcttcctgaagcttttttccgacgcttagcgaatcatctccgccacttatagtgacctttaccggtttctgctgtccagcagtattctccctggatgatggattatttgaggaatttttgccgtcatttttggtttcaagcggatcggccttcttcgtcgttacagtggtcttattgccttttgaatcagttgtggtcgttgtcttagtctttgccctggaatcggtggtagtcgtggttttagactttgttttgaaatctgtcgtagtctttgtcttctttttctgctcctgcagctcttttatcgtgcggcttgaagcatttcctgaagcctgttgttcagagtctaccattccaagagctctggcccgggctcttacctgatcatctgtcatagggacgccggagaagaaaaggccaagcattataataaggcttgtggctatgattccgatgcctaagcccctcatatagtactttcttttcatgagcctgcctccccatctttttcatcgaaaagctgaagaatcagctgaacttcaccaatgccttttccggtctccttagcgatatcgaggagagaatagccctgatggtacatcgagaggatcttctcacgggtctgttttgtatctgcagaaggatccggctttttatcggaatctgctgacttttcctttgtggcttttgctggtttcgcaggtgctttctcctgggatttgagatctgcgatggcttctgcctctttcttatctgcatttttctcttcaggtgtttttggcgcaacagtctttttttgaagaggtggaaaagcagatgtatcagccttcttcgccggagcagattttaatattgggactgctctgacctgggatgaggctttctgggcggcggaactctgtttctcagcttctgtaaggagctctctgacgtgcgactcggcttctccgagtgtctttgtcagctttgtcatctgttcctgtttgtcgtttaacatctgatagagaaagacaatctcgtcgtgagtcttggtcatagaatcgaagacggtatctgcgtactctccgatagacatgatcctgttatttgtctctttgtcggctgctactgtaaactcctcggtcttttcttctgctttgtcggaaattgccttatcgacgcgttcatcagcttctttaaggctcttatcgataagtgccttgacctgatcttcgctaagccctttaatctcatccatgtcagacgatgagagcttctctgatacaaaaaagctcccgataaaaaatactgcacctatgatcaaaagaccaatttcaagtcctgtcatctttacacctttacatcaaaagagacgaaggctccctttttaatgactttgccatctgcctcttttgtaacttcttctttcttttttttgtttcttctctggtcggaaagtgctgcgccgccgttatttccatcgggatttaatgcactctcctttgcgctctcactctttttggcaacagtccgctgagcctgttcggctgactttgtgacgttgtcagatacaacctgctggttgatattggggcgggcatcatctgcacccttctgctgagataccgcctgggtattctgaagagtttgctgatacataactggtattataggcattctgtctcctttcaggcggtggcaggtcctttgactatctcgccgtttttcttttcgaactgtacacaggaaagcttttcggtagtcgtcatagagagctcggaaatagtaatcgtaactcccgggtagatcctgctgtgaacgataacttttgactgcttgctcataagcagctcctgatgaagggaattgaactcttcacggtgcttttcgagatcagtctttaaacgatctatcttctggagaatcgtagtcagataatccatattcttatcgtttaatttcttgccgctctttacaaaattgtcataggtgtctataacaggacggactttttcaatctgcttagactcatctaagatctggcgctgaagcaggttgtagcgggctttcttgtccggatcgattcctacctcgatccttgtgataacgcccatctcagagcctatcgttacagactccactttgcctccggctctgactgaagagccggcaataaagccttttctattcatgacaaggatatcgcccttcgcgtttacatcgctgtataggatggatccgctttcgacatagttgtcggtgtagacccttgcattctcgataaatgaagaaataaaggctcctttacactttataaagcccctgttcataccgtgaacaccttcacgtactataatctgtccacctgcatccagataagctccttcaactacgccatctactatgatatcggcatctgccttgaccgtaaaaccagtcctgacagagcccatgatatgtacatttccgttgtaggtaatatttccagtggaattgtctacatcagatttcaccaggtactcatcctgaaccgtgacttttccatggtctaagaagacgtgaccgtaaatctccgaatagatagatctgccatctccggaaacgctgatgttgtcgccgtaacaaagctgcgcatcctttactttccttacaggaatatccctgccatagacatccttgccattctttccggtatcggccgggataagagtagccagaagatctcctccgtttaccatcgaaatagtatttaaattcttaaaatcgacggaaccatcaggaagcatcttaggctttaagttaggatttgtattgaaattgtagatgatcttcgcatcgtgaccaattacaggtagatcacccttagcgataacataaggggtattatactgcctgtcgttaataaaatcgaggatggcatcctgatcaataccgtagattatgccttttttgttcaggacttccaaaatgtccttaagccccatgaagttgccaccggatgaaggtggcgcaaatgtcgctgtaaccttcatgtgatcgagagacatctttaacttcatcgactcgttaaattcaggtatatggcaatcatttgccaagagaactacggaaggcttgttttctgagatttgatctgtaacagcttccagatcatatatctctatgccgtgcttttttaaataattatagacctcggaaatatcgagtttcaaccccccatcagttggtgggacatattttgaataagctttgtcatccttaaggacaagctgtatatatgcgtttgccattagaacctgctttcttcaaaagaattccatgtaactgcccattactttgcgcatttttttgagagccttggtgtgaagctgtgaaaccctcgactctgaaacagacattacctcacttatctcctttaaagtgagatcttcatagtaatagagtactataacctttttttctttttccgtaagcagatcaagtgcatctttaagttttctgctcagttcttctctggataccttttcttccggctgctcaaaatacgaattcttctttgtatccatagcaggctcatttccgcctgcatccatgaattcgttcagggaaacaagatttgtgaccttcagtgaggaaacaaatgaatagtactcttcttcatccattcccaactcttcagccagctcttcgtctgtagcctcgtgaccagtcctctcctctatctccctggcagcagtgtcgagttgtctctgcttctgccttatcgtacgcggtatccagtccatcttcctgatctggtcaagaatggaccctttgatacgaagagaggcataagtctcgaactttacatctttatgtatgtcgaatttgtctatagcatctatcaggccaaaaattccataacttacgagatcctcgtactctacggttttgccaagatacatactcatcttccctgcaacgatcttcaccagcggagaatactcgataataagcttttctctgagtgctggtgtagggttagcagcatattgatcccacagagaagaatcgaagttcactgccataagctatcttctactcctgtgtctgatcgccggcattatgatctttctcatcagcctcgtcagactctgctgcctctgcatcttcggcttcagaggctcttttgtctacttcactcttatcggctttaaaacccaaatcaagaaacacacggaccaagctcccaagtatcccaaagatgatcactgtgataagcagactgctgacaaagtgcttaagagacgcttgtcgtaaaatgctgatgacgcaggaaattcctgcagccgcaagcgtgacaagaattggaatcggcctagtattaggtttgtggtattgctcgtctttttcttttctgtctttttgtttcatatcttataaggcgtcttacctactgcttttataagaaaatccccgtttgcgctgtaaagctcaactgtgcgtccgaaattctttccacagtcttcggcaatcagcgggattccaagctgttttaacatagcacggctggccgcagcgttgcgatcgccgacattcatagtagaagagccaatatcaaacatcttggctcctccagctatctttgcacggattcgggattttgaagctcccattttcagcatatcgtccagaagttttttgattccggtatcggcaaacttggcgatattggaattatttctgatggatgtactgtctggaagcataatatgtgccagaccggttacctttgtgactgggtcataaagagcgatgccgatacaggatccaagacctatcgttgttaaattgtcaggggctttacatacttttaagtctgccatgcccacctttatcatttcgcccaatgaaagtctccttataccggcagcccgagagctctcagaatcttctggtatgaatcgccctctggcataagaatgtaatatcctgagatgtcaagatcatcgcccatttcagtcttgatcatcagtgcattgtctccaaccattccaaactgtatagctggaacagagagtatagcacctgccatatctatagccacgtaaggaacagatggagttatcgtcatattagtaagaccggaaagagctgatagataagatccggcgataatatttcctatctcctttatcgccgacatatccatctcgtcaaaatcttcattgtaatccggatccctgcccataagacggttgaccagatgatgagctgatggaagatccatcagaaacatcatcgaaccggttatatcgtgctggactccgagcataattccaactactaccttgtcttctgctcctatggcacagcaaatctgctctacaggcatcagctctacatgcggaacactcatgcttatcctcaggttcagcatgtttgctatagctgtcgtagcatttccggcgccaatatttccaatctctgtaaggacgtccgggtacattttattaatctgatctaatgtcattttgcccatagatatcactctctaagatcgtcaagccttcggattatctatgatggtggaaatatcaaaaatagatacaaggtcatcaccatgaataccgattccgttgataaacatgttatcctgcttcttggacttcgtatttctgtttatctcagactcgcctaaagctatgacttctcttacttcgtcaacaagaatcccgacatatccgacatcttccatcttcaggattacgatacgggatttgtttgtaatctcatcctcgccaaggcccatttttctgcggactgacataacaggtacaacctcgccacggagatttataataccaatataatagtactgaacctttggcacacgggtgatcttctgcatacggacgatattgtccacataggaaatatcgagtccgtactgctcatcaccgatgcggcagatgatatactgcttcttttcttcttcaacagcgtttgtgtctttgcgctttacttcgttctttttctctttatccattctttacccccttagaacatcgcatttgaatcgaggataagtgcaacttcaccatctccaaggatagtggctccgcttatcatcttgtctgtatccataactttgcccatagacttgataacgatctcctgctgtcctatcaggctgtcgacgacaagtcctgcgtaattgtcgcccttctttacgatgactacgataatattgtcaggcttctcttccttaggcgggcagtcgagaagttcatcgagatgaataagaggaataacgagacctctgagatagatgacttcctttgcctgtacatacttgatctcagatacaggaatattctcaatattcatgatagaggcaagtgctatagcgtacttctcgccgctgacttcgaccataagagcctggatgatagcaagtgtgagaggaagtctgatagtaaatgtagaaccctgtccgagctcactctttacctcaacatctccgcctaatgcttcgatattgttctttacaacgtcgagtccaacgcctcttcctgagatatcggtaactttctttgacatcgagaaggatggaaggaacaggaaatcaatgatctccttcttcgtaaggttctctgcgtcttcctctgaaacaaggcctctttcgatggccttctgcttaacagcctcggtatcgattccggcaccgtcatcaccaacctggatgataacgttgttgccttcctgataggcgttcaggaaaatgcttcctgtttcaggctttcctgcggccttacgtgtctcaggatcctcgattccgtggtcggctgagttacggagcagatgctgcagcggatcgccgatctggtcgacaactgtacgatcgagctctgtatcttcaccggtcataaccagttccatcggcttcttcagacgacgggagaggtctcttatcatacgagggaatttatttacagtattctcgataggaaccattcgaactttcatgactgactcatgcagtgtagtcgtgatacgctcgagatattcaatctgttcctggaatgtctgtctgttgccacctgactcactgtacttggcagcgttttcattggcctgcgctgacagtgaaacaagtgagttctttgcaatgataagctctgatacctgattcatcagggcatcgagtttctcgatatcaactcggatagtacgggctgtaacaggcttgttgattgtcttcttcttgccgccgccattgccaccgctcttcgccggggctttagcagctgactttgccggagcggcaggtgcagccggtgctgcagcggcttttgccggagcagctgcctgtgctggagcagcttcaatcttaaacatatcaggggtaactttatcagcatcaactgattcaatctcagaaacggctgcagctgcctgcttgataggatcaagatctccagcagcacccatgataaatgatacagagtattcgaacttctcgtcttcaacatcctgtgagctcggtgaatagataagaatctcaccaaagtcctcaacagccttgtaaacaaggaatacacgggctgccttaaggaggcactccttctggacatgaattgtaaatccatagaggttcaggccggaatctgcagctttctgtaatttttcaatgtcattttcctcgagcctgatctgcttataagcatccttgtcgccattggcctggtcagcaggagcagaagccgctgcagatgcatcagctgccggagcggcatcagcaggcttatcaccattggctccagcgaggtaatcatttaatctcttaataagagctgcattgtcctcatcgccctcgttagatgtctgcttgatcgtgtctacgtatgcttcgatagcatcgaggcagtcaaaaaggatatcgatcagagtagaattgactttgatcgtatcgttcctgatctctgagaacacattctccatatcatgggtcagatgctgcatcttcttgaatcccatggttccagccattcccttaagggagtgagcggctctgaagatctcgttaataacgtctttgttctcaggctctttctctaagatcatgatgttatccgaaagagattggatatgctcattcgactcatcaatgaaaatgtcgagatactgacttaaatccattgtctaaacccccagttctctagtgatagcttttgctatttctttaagtggcttaacttcatctgacaggcctttgtcatgcactgacctcggcatgccatagacaacactggacttctcgtcctgtgaaatcgtgtaaatgttcttgcagtccttgagtttgccgataccttctgtaccatcagctcccatccctgtgaggactacacagaggatgttgttcgctttgacacggcagagcgattcatacatgacatctgcacatggccgcagattgtggacaggtggcgtatcgtagatatgcgcaataagctgtcctctcttgttctcggcgattgaaaaatgcctgcctccctgtgcgatataaacagtgtcagcttttaggacttcctggtcttttgcttcacagacatgaatctttgaatcctgatcaatcctctctgcaagcgaagccgtaaatcctgccggcatgtgctgcactaccaccataggcacgccaatgcgcgccggaagcataggtataagcgtgtgaagagcctgtgggccaccggtcgaacacgccagggctattagtgaataatgtccctttcgcttcgaaaccgacttatcggtgtgctgaacagagtcattaaaatcaaatgacacatttccagctgatgcaacctttagagatgataacagtgaagtcttgaatttctcgatccctgctttatctccaaagaaataaggacggacgactacatctacagctccggcgtcaagagcctgcatagtcatctccctgtcttcactgacagcagatgtaatggctataacaggagtccggcaccgtctgtcacgcagtcttctgagcagtgaaatgctgcttacaccgcccagatagatattcatgacaatgcagtcatagactttatccgatatggctttcagcgctccggttccgtcacggcagatgtctgtaacttcaaacccaggcactgaatctattatatcacacatcgtttttctcatgagtgcagagtcatctacaacaagtacttttctcattgcctgccctgctcctttttcatctgtttgcgctgctgctcaaacacatatttgataatacgctcgcggaacttcggattcttaaacacaaacataagcctgtaatagtatttgcgggtctcttcattgtaagtcttctcgaggatcctggctaaaacctccattatatcgtcccgctcttctattttttttcttggatcgatgactttattcttgtctttgtctttttccgtatcttctttaaaaataaccctgaggaggatataagtggtatctttaaagtcatactccgaaataaaaagtgctccgccgccgctgatattcgatatcatgccatgtgccacacggtatccgtcttcgatatgttcaagcagatagtgactcgcatctattatctctttaggttcaaaatcatcttcgcccagcgctaccccgatgcttcttaacgagcagtcgagcctgtagtattcccttctctggaacctctttaaaggagtcgaaagccttgcgtccatcaggaaaaaattgttctcacggtaacggctcaccagatcaccctgagctacatagaaagccttcttgccttctctttttatcgtaaaaataaacgtgtagcggagtccggtagaaagggcgacaagccttcttctgacaatcggaatatccatgaccacagtcccgtcatctctgatatcgtggatctgtgacagaaatctcctggccttttgaccgccattctgctcctgtgaaaattcctgagtaataattatcgagaccttatctccaatcgagagagtcacatttgcgcttttgtcctgcattggcatacctactttttcataaaactgtcaaaaagtgtcctgattgaaaagccgcgagacttctcgtgaccaccattatccataagctttttggcaatagcttcaaatgctctggcactcctcgaaccaggatattcaaggcttacgattttttgtgaacggacagctttttcaagattaacatcctgcggaactcctccggcaaaatcaatctgcgtatttaaaaactgatttactactgcatcgagcttcttatatacagtctcgccctcattttcatttttgaggcggtttgcaacgagacttatcgagctgattttatcattgtatgctggatttaatatcagcgctttaagcagcgagtacgaatcggttatcgaactcggctcaggcgtcgccacaagaagtatctctggagatgccagcacaaaatccatgacatgatttgaaattcccgcgccagtatccacgattatgacatcgcagagcccggaaagctgtgtaattgagcgcaccagcagatgagtctggtcttcgcttaaatcatttaatgaaataattccacttccggcagatatgaagcctatgtccattggaccttctgtgatgacatcagtaagaggtattcccttgaatactacatctgagaggttattcttcggaattgtattgaacatgacttcgacatttgcaagtccaaaatcagcatcaaatatgatgactttcttacccatcttccgaaactgcacggcgaggtttacggcaagatttgactttccgactccacctttgccactcgtaatggttattacccttgcagaggcgacattattctggtttttggactttataacgtttctcaatccttccgcctgatccattattcacctccgagaagattttttacgagtttctgagggtcaagaacagctatatcctccgggactttctgcccgtttgtgatataagagagattcttgccgctaaattgacggatgttatagatgtttccaaagttctccgtctcgtcgagctttgtgaagataatcgaaaaatcggtaatctcattgtaggtctttacaatgtgctttaagtcgttgtactttgtcgtggctgaaagcacaagataaacctgcttgttgtatttcgcagggaccagagacagaagtttcgataagttcttctgctgttcctggttattgtgtgaaaaacccactgtatctacaaatatgacatcgttgtccttattttcatttaatgcagcaacgatgtcctcaggcgacataagaacagtgatctttacgtccagaatgtcggcgtaggtcgagagctgctcggctgccgcaatcctgaaggtatcagctgtaagaaaggcgaccttcttgttcattgcgactttgaagttgctggccatttttgctagagtcgtagtcttgcctacgcctgtagggccgacaagaaatactacagaaggcgcgccctcgctcttgatctcaatctgatgaggaacaccgatctttaagaccatcttctggtaaacgttagtcagaagataatccatgctgtttcctgcctctatcatgccatcgaggtcggaaagtgcctgatttacatatctctcgtcgacttcgtgatctataagcttgttgtagagcatcctgacaaaaccgaggtatgactctgctccccggcttgtaaatccagtatcagaagcgttgtcttcggtgcggactacctttgcggtctcctcttcatgctttttttcagtctcctcttctgaagttctggcctgtcttggtgtaagcgggacaaactccttctctggttcttctttcttgtgctcctcgttagtttccttctctggctcactctcagaagaagctggctcctctatgactcggcttacagcttcgaaggcacttttaagctgatctgcgtctatctctgacttctcttccatcggctttgtctttatcggagtagcattttttttcttatagtggcttatagctgagtttccgacaggtgccgcgcttaaatctattttctcgtcggccactgctgaaaaatttgaagtaccgtcttcagacttcttcgtatcgactttgtacggaggtgtctttacactcttgtccgatgactgatagtcgtcttcgatagccgccgtcacttcgtaagtgctcttcttaaaaatgccgaaaaggccgcctggacgcacttcacgcacattcataataacagccgccggacctagatcctgttttgcagcatttatggcttcttcttttgtcttacctgaatacttatttatagtcatgagtcacttaccattcctactgactgaagctcgatatcagattcaatctcgttatatgaaacaacaatgaggtctgaatagtaatcttcggtgatcttcttgaaatacatacggactataggtgaaagtaccacaatcggggtctttccctgatcttccatcttctttatctcattgcccaatgaatccattatggacttgatcttttcagggtcaagcgtaatgtatgcgccctgttctgtctgcttgacagagcccattatctcctgctccaccttaggatcgaccgtgataacctggttcggaacgcccttgtcaaagaacttcgctgaaatagcaggcttaagtccctgtcttacatactcagtaagtacatcggtgtcctttgtattcgtggcgtgatctgcgagtatttcaaatatagacagaagatctctgatagaaatgccctcggagagcaggtttttaagcactttctctatatcgccgagagacatctctgcaggtgtcagctcgtccacaagagccggatttgtctctttcaagttgtttacaaggttctggacatcctgtctcgtcagaagctctgcgatatggtttctgatgacttctgtaaggtgtgttgcaatgatagaaggcgggtctactacggtgtagcctaaagactcggcacgttccctctgcccctctgtgatccagatagccggcagatggaacgaaggctccgtagtcgggatacctgaaatctcttcctcgacataacctggattcatggccatatagtggtcaaagaggatctcaccatctgcgacctggacaccttttatcttgattatgtactggttagggttaagctggatgttgtcgcgaagccttatgataggaactacagttccaagttcaagagcaatctgtcttctgatcataactacacgatccagaagatctccgccctgattaacatcggctaatggtataataccatatccaaattcaagctctataggatcgacatttaagagtgagacgacgttttcaggccgcctgatctcctcagcctgattctcctcttcctgaacctggctcttgatgtcttcttttccaatggtcttcgacatctggtagccgactataaaaaatatcactgcaaacgctatgaaaaggaaagtattgagcggtgtgaaaattccgagaagagcgaggacgattccaacgacatacatgacacgcggaatgccgaacatctgcttcatcatgacgcctgagaaatcagccgtctttgtgccctttgttacgagaagacctgtagccagggaaatgagaagcgacggaatggatgaagaaataccatcaccgattgtcaggataccgtacttatttatggcctcctgaatactctgaccattgtttaccattcccattatggtaccgccgatcaggtttatcatcgtgatgataagtccggctgtagcgtctcctttaacgtacttcgtagcaccatccatggaaccgaagaacgaggactcttcctgcagcttgtcccgctgcctcttggcttccttctcgtcgatggctccggatgacacatcagcctcgatagccatctgtttaccaggcattgcgtcgagggtaaatcttgctgtaacctcagatacacgctctgtacctttgtttacaactacgaactgtacgataagaatgatgatgtagactatggctccgatgactaagttacctccgccgacgaatgagccgaatgtcgaaacgacattacctggatttccggtggtaaggatcagtctggtcgaagctacattaagtgaaatcctgaaaagtgtggtaagaaggagaagagtcggataaaaagacatatccagaggctctactacaaaaagtgaattgataagcacagtaagtgctaccgcaatgtttagagcaaggcagatatcaagaagccatgaagggattggaacgataaagaaaatgacagcagccagaaggtaagctgccacaccaatgtcggtctttttcagtccggtctttttctcaaggacattatccaaactgcttctcctttcccattaaatctggctgattcagcccctcttatgctttttattataaatcacggcgagcacttccgcaactgcctgatacaattccggaggaatctgcgcgttgatatctactgtcgtgtacaaagctctggcaaggggtttattctcgacgatctcgacattattttcgcgggccgtctccttgatcttttcagcgacaaaatcttcacccttggcaacaacgacaggagcttcagcctgatctgcgtcgtactttatcgcaaccgcaatgtgggtagggttagtgataactacatctgccttaggcacctgctgcatcattcgccgctgagagacctcgcgcatcttctgtttctggcggcccttgatctcagggtctccctcttcgtccttgtactcgtcccttacttcctgcttggtcatcttgatgttgtttttgaacctgatcctctgaataaaataatccagaaatccaacaacaagatagattacgcttattctaatcccaatatcgatgaccagatcgactatcagagcgacagcctgcgtcaggtcaagctcatatagaataaaaagctcattttcatggcttttaatgtccgaataagctacaaaaaaaatgataacgatcttcgcgatggacacaagcaggttcataagtgcctgcactgaaaacatcctcttgaagccgtttatcgggttgaattttgaaagcgaaggtttaagcggttcagtcgacaccttgaacttgaactgaagccctgtcccgaacagtcctgaaaaaaatccgacgagcatgaacggaagcattatcagaagcatctgctggtaaacatcgctcataagcccgtgcacagacgccacagttggtatccgccgctccgactttatatagtcagatataacagagcccaaagaccaccggtaaattccaagcattctctcaatcgcaaaatttccaaacactcgcagtgagagaaacagagccaaaagctgtatcgccatcgaaagttcctggcttcgggccacggaacctttctttcgcgtatcagagattttcttctcggtaggctcctcagtcttatctgagaaaaaagtcagatcaagctctattaaaagcggttttttactgaaatctttcgtcactaactaatgcaagcctccggcaaaattacgcagatttatcttcatctgttcatagatcatgtctacgacctctgggaacaggaatgtaaccagatacattactgcaaaagctgctaggatcttgatctggacaccgacagagaacatattcatctgcggcgccaccttcgccataataccaagtaccacattaaggaccagcatcacagaaaataccggaagcatgatcctgaaacccagtacaaacatatttctcatatatgagatcacagacgcgagcatcatttctcttctgaagactgctcctccgagaggaatcagagtaaatgaatccgcaagcgccctgatcagaaacctgtgtgctcctccaaccagaagaaggagaaggacaaagtaatagtacatatttgctgtgatcgtgacctgagcatttgaagaaatatcaaattctgtcaccatcgcaaaaccgatgtccatatccataatgtttccggcgaacattacgatgtagtttgcgatactcgccgaaaatccgagaagcagtccggtagcagcctctttaaaaacaataactgcatagccgatcactccggtatagcttacttcgttcgcaggcatagtctctatcatcataagagccataagtccggcaaaaccgatcttcgtctgactcggaactccccgcatcgagaagaacggcgccgtaaaaacgaagcagcttatacgcacgaataccagaagaaaatattcgatctggtacagattaaacgtataattaaccataaatctgctactttatataaacattgaaatttgaccagagattggtgatgaaagtcaccagggtcctcataataaacgagccaaatataaggagagctataaatatcgaaataatctttggtacaaatgtcagtgtctgttcctgaatcgacgttactgtctgaaagatactgatgataagacctacaacaagtgatatcaaaagcatcggagcagaacatacgatgacgttgtagaaagcgtcacgcataatatcgagaacctgagcttctgtcacaaaaacctccttactggaatgtctttacaaggcttcctataaccaaattccatccgtctgccataataaagagaaggatcttgaatggcagcgaaatagtcgtaggcggcagcatcatcatacccatcgacatgagcaccgacgctacgaccatatctatcacgataaatgggatatagatcaaaaatcccatgataaatgcagttctgagttcactcaggacaaagctcgggataaggacatgcattgggacatcgtcgtagtcattataggtgatgccggcgatatcacagaaaagattcaagtccttagactgtgtctggccatacatgaactctcttatcggttccttgcctctgttgtatgcctgctcctgagtgatctttccctggtcaaaaggcactatggcttttttgtacacagatgaaaaagtaggccacatgataaacagcgtcaaaaacagtgcgagaccgataatgacctggttcggaggtgttgtctgcgtcccgagagccagccggacaaaatgaagtactatgatgacccgggtgaaactggtcatcatcacaaggattgcaggacaaagagcgatgatcgtaaggatgagaagaatccttatggtagagttcagtgaaccggaatccccgttgaagttcaggctgaatccgccagaacctgtactcgtagattcatttgtggtgtttggagcctggcttgttccgccgtaatttttgtttactcctgcccttccgtcgtcatatgccctcgaatgggaagtgccgtcggatgagttcgtcgtagaactctgcgaagtagcgtaggcagtctgagaagtgcagagcaaaaaaatcgccgatgagaaaaatacgagtccgagacatataaggattgtagttaatatctttaaaaaacgcttcatcagtcgtctgtagtatcctttccacgtcctgtgtatttcttaaacaattctttaaagctgccaaagtccgggttctttcctggaatcaccgagcctgagtcagtcttaaacgtgatgtcgtccttatcgatcttgtcaataaatgtgatctcgtcttttcctactccaataagataataattatccttcccagcttttacgatcgcaagaaacttgttgttggcaatcttcatggtatcgactacagcaaagtttcctacggacagctttttcttctgatagtctgcaataaaatgggtggtaaagtagcacaatgctactaccaccacaaacataagtatagcaactaaaagttgtcccagactttcaagaccagacgctaaaaacatcagccaataacctttttcactgcttcaagtactcgctctgcctggaaaggcttaacgataaagtccttggcacctgactgaatagcttcaataaccatggcctgctgacccatggctgaacacatgataacctgtgcattaggatcctttgcacggatacctttaagggcaccgataccatccatctcaggcatagtgatatccataagtacgagatcaggtttggtctctgtgtataactcgatagcttttacaccgttctctgcctcacctactacgttatagccattcttcgtaaggatatctttgatcatcatcctcatgaatgctgcatcgtcacagataagtatgttttttcccattttgtcatctccttgttatttgaccttactttactatctcggtaatacgaactccgaaagactcttcgatgacgactacctcaccttttgctacatatttaccattcacaaggacatccaccggctctccggctatcttgttcagctcgataatagtacctggagcgaactctaggatgtcttttatggatttgtgcgttctgccaagctctaccgtcacttcaagtggaacgtccataatcaggttgatattttcatttgccagctgcggggtaatattcgacgcaaatggtgtgaactgggcctgctgaacgttcacagtattttgtacgggctgagacggtggaggcggcatactgcccggattctgctgcatatactgctgtgctccattattattaactggattctgattctgtactggctgctgctgctgtggctgtgtctcaacaggaggcggagtaaagttcatatcgtctgcagtagactgtgaatcttcctgcatattctttgccaccagtgaacacatctcttttgcaaggctgataggatacagctgcatcatctttgaatcaaccagatctccaatcagcatcttaaaacttatcagtacaaaagatccttcaaggaaagaatcaatatctcctccgttgacctgttcgtgcagatcaataagatctgactgcggtggtgagatatcgactgtcatattcagcatagaggaaagtgctgtagatgctgaacccatcatctggttcatggcctctgaaatagctgacagatgaagctcggtgatctctccgtcgaccttggttccatcgccacccatcatcaggtccgtgatgatctttacatcgttttctttaagtataaggatattgcttccgtttagtcctcgggtataactgatctttaccatgacgcaagggcgctcgtacaaacctacgatgtcatcccaagtcgccattgagactactggagtagagatctcaacttttttattcaccagggagaataaagtggtagccgcagttcccatgctgatgttcgcgacttcaccgatggtatccttttcctgatcggaaagagtatctgcactatttggtgctcctgcagcggcgtttccgccatcgcctgaagcattattcaggagtgcatcaatctcatcctgagatatcgtggtatctcccatcctaaccttcttcctctcgtataacatttgttaccctgactgcatacttattatcataagtaccgggaagggcattgaacttctttatagacccgacatagacatcgagttcatcatctgcttttttgtcaagtcttataatatcaccattctgcaatgaaataaagtcattaacgctgatggtggaattacctaaaactgcagtaacaggaacctgcgttttctggataagcttttccatgtcttcggtaaaggccttgtcattctgttcctgcatattcgagaaccagaacttcgtgttcagcttatccataaccggctctaaggtaatgtaaggaagacagatattcatcataccttcaacatcgccaatcttcaaattcatcgtcactatggcgatcatctcagccggagaaataatctgggcgaactgtgagttcgtctctatcctgttcagcttcggatgtatatcacacacattctgccacggctcacgcagcaactcgacacaggtatttaaaacacgctgaatgatcaggatctctatctccgagaaatctctttccttctcaagtggttcaccctcgcctccaagcatacggtccacgatcgcaaatccaagacttgtgcccatgtccataataatgtttcccttaagaggctcaacatcaactatacttaaaagaacagggttcgatagagagttcgtaaactcctgatatgtaacggcttccgagttcatgacatcggcctgtacattcttgcggagatataccggaaggttggtcgaaagaagcctgccatagtgttcaaatatgacttcgagtgtcctcaggtgttccttagagaatttcgacggcctggagaaatcgtaatccttaacaggcggttcctgcggctttacatcatcgacatccacctcgccattgttcatggcgtttaacagcttgtcgatttcttcctgggagaggacatcactcatgataccaccccattttctttactggtaaataacattggtaaatgaaacacctactacaaaatctttgtcaaagagcttctgctctgccttcgtgcaggcatctataacagtctgctgattgttctgcatctgagtcacagtatactgagaaactgtctgctggatagcctgtgaaacctggccggctgctgaacccgactcatttgtcagtgcagcgtagttaaccttgtaacttttagccttggaattcataataagctgggccttgatgacggcgacgtggttctttccgtctgtagactttaagttgatcgtaaggccatcgtctccgccgatagctatcatagtctgatctgcaatagataccttctgatcggaattaccttctccattgctggcagtagctgaaccgttctgatcgagatcgatcgccgaagccaccttcgagaccagtgaattcacattctttacttctggaagtatagcaacagcaagtatcgctgtaagcagaagatttataaggactaacgccagagttaccatcgtgagtaaacttttcttcatctaaaaactctctttcttcctctatctctttgaataatatgagttataaatctttatctctactcttctgttgcgggctctgccttccggagtcttgttgctggctaccggatcgtattctcctctgccggagctgtagatgtgcgaagcttttacagaagaatactgtctgatatcgtttgccacgttcagagctctgtacgctgaaagaacgttgttgtcttcgtacttagcagaatgtatcggaacattgtccgtatgaccttcgacctctataagtgaatccttatagttatttaaaatctggcttatcttctgaacgataggacgagcatcggctttaagttcggcctttcctgagtcaaacaaaaatgcaccgtttaacgtcaacctgacatactgtccattgaaatctatctctacgttgtcttgaattccattgctcttaagctgtttttcgatgttctgggacatcttctcggattcctttagagactgctcttcaacagtcttcttggcctcctcctccgagttcttcttattctgctcggacttcgaagtacccccagtagcgtcacctgtcgctgtcgtttttccagactggccattatttttgctgtttcccgactggttcccggtctcatttgcagcctttgtaagagcctttccgaaataattcgctatctcagggagctgtgtcatgccgtttgatataagaataccatccgacagattactgccaccagacggcagtatcgaaaacgcctggttaactgactgtgccactgattcaatcttggactgtgtcagtgtagacatagagaacagcaacacgaagaaacaaagcaggagattcatcagatctgagaaagtcgactgccatagagggaaggttttgggaggctcaggaggtttcttgaaagccattaagcttcaccgcccttctcatctcctactgctacagaagccctgtctgctggcggaaggaaggtcttaagcttctcttcgattactcttgggttctcaccagcctgtatagaaagcagtccctcaactacaagtgtctttatagaaatctcgttatctgtgtttaccttcagcttattctcaataggctggcagatccagttcgcgataagtgatccgtagaatgtggtaataagggcaacagccatattcggtccgatagtagatgcatcctgcagatccttaagcatgttgataagtccgatcagagtaccgatcataccccaggcaggaccctgggcagcccagaaatcaaacattcctatgataacctgatgtctcgaatacatcgagttcatatcgttctcaagtatagatctgacaaggtcggcatcagtaccatctacgataagcaggaggcccttcttcataaactcgtcgtcgaggctgttcgcagtctcctcaagtgtaagaaggccttcctttcgggctacgtttgccatatctataatctgtgtgataactttctttgggtcactgttcttaggctcctgtacagcctgtttgataccattcttgaaactgttgataagatctggaagtttcatactggtaagcagtgatgaaagagatcctccaatagtaatgatgatagaaggaggatctatatatgaattcacggaagcacctgaagaaatgattccgtaaagggtcatacaaatacctaaaacaagaccaattaacgttgataaatccaattttatgccccctgaggtctattgtttgtacacataaaaaacaccatataatatattactagattgcagtgcgtttgtccacttttttagtaaatttttgtgtaagatttttatacaatatactagaattagtagttttcgtttcgcactgacggcttattgcaacatcaatcaatgaatatattctatactttttcactaaaaaaataaagtaggattcttaaaaaaaaataaacccatgccctttttcactgttctgtgaaaaaataacatgggattttcagtttcctcaggccttacctgaatcaccatttactgtggtatcagctgtttttgtgtctgatgctgaattcgtattggttgaggctttcgtagtatcagaagcctgatttgtgttagaagcagtagtattttttttggatttcccggtaagaatatctgccctttttacaagatcctcaatggtctgaacagtagtcttaggaatgaaagactgctgataagtggtcagtgagttgtaaactttctgaatattatagacagattctgtatctgcgactgtcagctggtttactgatggaagctttgcaagctcctgatttatcgtatctcttatggtcgtcgctgtgtagtagtcgctgtcctttacaccggtgacattgtctatagagaagtcgtcgtcgccgatatgaagccaggtagaaccgtcttttttgaaggtatattctacctttcctgtgtgctctactccgtcgtcgtcagttgctgtagcaatctgtccgacaagggaatttccgctcattttttcaaaggaagtggccatattttccacagcttctacctgtgagaaagatgccatctcttttaagtactctgtattgtccgtaggctcaagtgggttctggtacttcatctgagccacaaggagcttcatgaacatgtccttggtctgctgagtcttggaagaggatttctcggtctttgaattttcctctgcagactgactctctacattggctacagacttgttaccggttaccgctccattgattatctgtgttgtaactgccatttacccgtctccttgtaaaaataaaacgtaacctgttcagacgatcacagcgccatcgatattcgtaaatgctttctcctttgactcattactgtctaaggcagtgataacagtctgtgaaggaacgtttacgataaaagcgagtgaatccataagaacaagtgaattcttgatatccttctcttccgccttttttaatccatccgaaagccgaccggtctgctctgctgagagacttatatctctctgggccagcctttcggaggcgtgttttgagaaacggagcccatctgtctcctggcttgctgccttttcgagaactgactggaaactgtcggcctccgtgcctttatttgtcttcttaggagaattgatcccgtatgtgtcacgaatctgctctatagaagtaaatcctttaattccgttcatgaagcacacctcctttcgttacgcttcgctcgctttcgctaatctcgaagaacgacctcgcttcgggctcggcctacgctatgcttgtcctcacctcgaagctttcgacaaagaagttcttctcgctaagctcaaacttcgcttcgctcgttttcgctaatctcgaagaacgacctcgcttcgggttcggcctacgctgcgcttgtcctcacctcgaagctttcgacaaagaagttcttctcgctaagctcaaacttcgcttcgctcgttttcgctaatctcgaagaacgacctcgcttcgggttcggcctacgctgcgcttgtcctcacctcgaagctttcggtcatctcttcaggtttgtaagttcctcaagcatcgtatctgatactgtgatgattcggctgtttgcctggaaaccacgctgtgtggtgatcatctgagtgaattcctgtgcaagatcgacgtttgacatctcgaggtaaccggaattcatcgaagaaccatctgaagtaatttcctgtccgatcccatcgaatgatcctgagtttaatgtggtctgatagcagttatttccaaggctctcaagtcctgatgcattggcaaatctggcaacagggatctgtcctaaaagctctgtgttgccattcgaatacgaagcgaagatctgtccgtcgttttgaatcgtaagtccggtcatctgtccgatcttcttaccagcgccatcagaaccatcagagacagtacctcgattgagaccggcagttgagcttccaccgttgtcgtagtttagaagggttgagaagtcaattgttatatccttggtgaactgttttcctaattttgtaacattaagggttactgatgtgcccttagactcttcccctttgtcagttcgtgccgacaactgatggaaagtaccatttgaagtattaaagtacatgtcgtatgttgctgcattggactttactttcagtgactgggtattgtagtcaaatgatacgtcaacttgtttaccagaataattacttgctacacttgaaagagaagggaaaacagttgccaacgaaacagacgtagaagtagcagctccagagaacgtgattttcattgagttgatatccccacttcctatagatgtgccggttaaagtagcagtcatctgatctgtgccagttcctgtttttataataaagttaccgccatttttctctaccgtgtactgagaagcatcgagctggtatgagtctacagacactccgctggcagatccaaacagctctgattgtgccttgagtatatctgtttcggatgaattcggagacactttatttgtaacgtactcatcataaagatcgaaaggcacgccatttgaatttgtcttggaatctgatgtaatagaattcagctcgatagtaaatccgttgtcagaaacattaccatcagtaccgcttttattttcacctgacttaatattaaactttgctgtataggcatatccaaggctgtcatagaaagtaagactcattatatgtcctgaagtaccagtgacatttgaatcattggcatcaactattcctgaagcgtaagccttagtagtctgctcaggatctgaagtcttatgttcagcgctcataactttaagaggtgatacggtatctctcttgatggtttttggactcgcagttgaatcaacctgccagccctgtacaaggtatcctgtagatgtcattgcgaggtttccgttgccatctacatagaaagagccggcgcgggtgaagaggttcgatgaaccgtcgcttacaataaagaagtttgtagactgcttatctacgagacggagatctaggccgtcacctgtggactcagatgaaccctgagttgtgatagagattttatttgctgctgttgtaacaccgagacctatctgtctggcatttacaccaccctttgtagaagtaccgccactggcatttgacatagtctgatacatcacatcctggaaggtagttgatgtagacttgaatgctgtggtgtttacgtttgcgatattattaccgatgacatccatctttgactgatgggtctttaatccggctacgccggaaaaaagtgatttcatcataaggcgttacctcctatatcctgtaactaactgtatttccgctgtcctgcatgatctgcgcctcgaggacttcctctgaactcatatcatcaggaacggcaccatttcttaagtctattgaagaacggtttccactgtggccgttgtgtgatttctcatcatcaaagccctgggcttcctggccagggttctgtccaaactggttagtcatgttcttctcaagattttcttcaaacgcgtgaggctcaactgagatagtgacctcatttaccttaataccctgtctgttcagattgtcctgcagatcggcaagcctgttctctaaggcgtgctttactgcttcgttctgggcatacaggtgagctgtcacatctccgctcttctcagtaacctgcaggaaaatttttccgaggctctgtggatgaagctccatctcaaggcttgaaaccttagctgaaagagtctgcctggctttctcggcaatctgagagataagattatccgtatcgatactcgtgtacttctgaatcgtcgaaacaaaatctggcacctgtgcatcagctgagacatttgtggcaccttcggctgatactgcattggcattcacctgatctggcagggtctgctgcttctcgctgtttccgaagagatccgacctgctgctgtctggctctgtgtttgaactggaagactgaatctgatcggttgtgatctggccatttatagtctggttagaactattgtcatcagatacaatctgatcggtgtcctgcacacttgcatctgcagcatttgtcccggctgtttcagtcgtctcaacgtttactacagttacatctaaagccttgtcaggcgtcattaaaccatgactatcgtccaggttaaaagcattagaaagcttatctgcctcatcgcctgtaacaggtgtgagcccgtccagtgcatccggttcagcagctgaaaagatgtcctgcatgtcacttaagaaagaggtaaactgatccgaagtgaggatgcttgcattgtcagtgcctgtcagttttgaaaaaagtgctgctacgtttgaaggagtattaagatttgcgaaacttaggccgagagttttcatagcatctgtgatgtcgtctgtactaacgcccaagtcctttgaaatggtatcaaggatatccgagatgaggtcattcgtggcctcaggtctatccaccttgtcatcttccgtttccggtccagctgctttggtgtccttatcctgattcgaaatcttactacccttgtcgtcctccactgtcgttcttctgtcgtctttagtgactggtgaaggatcctttttgtcagcggctttagaagtcgtttttctgtcggaagtctccggcttcttaacgtcctttgtcctgtctgtacctgtggtcttcgtcgcatcggcggtcttatcctgaatgctggctttataagaagaagagaatttaacttctcttctgcctgcgaaataagtcccgctggctctcttactgccttccgatgactgcttcacgctgtcaggcgaattgttccgcgactgtgatcctgccgccatgtcactgattgacacagtgttcatgaccgacatgaaatcaaaatcgttcggagcatttgtcttcgcacttcgcgctttctttacgatctgaccactctgtacaggggatgtgatctcctctgtcttcattgtgctcctttcgtatctatataaggttaatagactccatttattgtatcggcagaaatttaaggtgttacatcactgccactgtattttaaaaagaacaatctacatctgcttaagctgttcttttacctgggctaaaactcgatctcctgtccctggctttttcataactaaaggaggtacgaggataagcatctttgtcagaccggaaagtacatttgaatagtactctgccggaaccgcggcatcaggatttgactcatccatctgatctgcaataaatatgacatcgggatgaagggcctttaagtccacatcagcaaaatatgacgccatgcatttctttggaaacccgtcccgttcgaaatggtactctcccaaagttccgccctgatttttgtcgtagtaaggaattggaatgaccatagttcttgaatcgggatctgtatcacaggcttcccagagtgaatcaagactctcccactgactcgccttacagactaaaaatacgaaaaggtgctttttcttttctctttcaatgcattgcagtacaattttatcaaatggttcgtaaattcccaggcagtcacaaaggagtgattctctttttacagaactcttctcttctttcgcctttaaaaaattcagggcaaactggcactgcggcgggagcatagatgagagaggctcggattcaaactgctcttttgaatatatatttttgtagtagtctacacaggcttttgagtatttgagaagctcatcagaaatttcaaaatcatccttgtgatctgcaatctccttttcttttgacttcagcctgaaaaaccggaatcttatgtcacagtcatcactgaatgctgccatcatttttcttacaggaagaaccctctcctcgtcgtgtttgtcgaagtaagtatttacgacgtgacaccattttttaagagggacctgctttaagacagctgcgatgtcgagacccttttcgagagctatctgccagatgctgtcatctaagttgaagaagtcatttgtcatcaggacaagagccctgaatctgtcatacagcttcttttcatcagacccatattctgcctcatacttcaggcggaggtagtccagatagtaatttctcccattcgcagtctgtccgagaacacggataagcttcgcggtctttccgtttttttcttttttgtcactctcttcgagttcttttgcgtgatcactgcattgactggcaatatcagggtaagacagaagctcgtctgcatagccaataaaccgctcgtcataaggcagctctgcaatggcatctataagctttcctgcaataaatctatactggcttccatctttctttaaattttttaaatacttgaaatatctgtggagatcgtcggcctcgccgatctcaatgccagagcagatcaggaaggcgatgagctgagccacttttcttgagttgaaaacgtcccttgtggtaagacttccgttggagttcagcttttccgataagtcaggcaggtccttccatgcgagatagagctccatatatctgtggctatagtttatcgcatgcttaaaatccttttttttgaaaaatgcaaagacggcgctgaaatagaggcttgcattacagatatcgttgttccgacgatcttttctgtagacgttgaaatcctcaattgtctgatcatagtcgaaaagctcgttgtcggcccacacttttccaaaataaaaatcgcccctgagcctgtttatttcaggattatctataccgtcaagcatttttaacgtcttatcgcagagatctaatagcttgctgctgtcccttactgcgatgtattcctgtgcaagctgcgaacgccagtggatatcgcctgggttctcttttatcatacgaaggagcggcttgatatttcttctggccttggcgaggtgttcctccttgttcgtgtaggcatatccatagtggtggacaaagctgtggatcatcttacattcgccgatcagcggagtaatgtactcgtgaatgataccggtaaaatgcgtttcgtcagtcagtttgcagagccggccaccccagaagtcgtcgtaatcctttcccgctgtatcgaaataatttctaataatgtaggaagcctgatagtattttttgtattcacctgatgtgaaaaatgacacgagttcgtctgtattctcaaaccactcgtcgtcatctataaacataaaccactcgccagagcactgcttaaggccagcattcctggcctttgcaaaatcgtcacaccacttgaatggaacgaccttatcggcgtatttgccgatgatctctttcatttcatcgtcacagccggtgtctacaataataagctcactcggaattctggaaatgattgtcttaagagattcgagtgtcttttttgtctccgtcttatgctttccattgcagagcatagaaattgagaggactggttttccaccaatattatttataaattgcccgttggatttaaggtatggagcgaatcttgaagtaattttttcctctttgtcagatgaaaaaattatatagtcaaatgtattttcttttaatttattttcaggatttttatctgttatgatatttccgaacgccctggcatagggcgctttaagctcatcaggttctatacccgtgtactccgcctttggaaacagagttttcaggcggcaggcactgcttccgattccacaaccgagctctagtacagagaatgcagaattttcatcctcttttatctttgacagggcccagttttttgctgagcaaagttcaggccatggatcaaactgcatctttcgaacgagtttttcgttatttcttttcaaaatgttcccgaaactccgtccatttttctgaagctctgcaaatgacctgctgccaaaatgaacgacaaagctgttgcggcaaaggacattaaaaaagccattctgtccgatacgaaaacagatatcgagatcttcgctgttacctgggttaaaacgttcatccaaaagtcctgtctgatttaagacagtcctcttaagaagcagtgaaaagccgatcagatacattctatactcatacggacggtccattgatacattggttttcgttccaaatgagatgacgtcatcaacagatttccattttctttctatcatctgattggcgctggcgtaatttgtaacactgccggtgcttcccgttttatcgctctcgtagagccctgttttaagccagaagagagaattcggaagaagaattgtatcagaatttaacagatatatgtcgttatctggagaagcattctttataccatcgttacatccacctggaaatcctctgttctcatgattttctatgagagtgatccagtcgaggctgcgaagatactcaacacttccgtcggttgaagcattatcgacaacaacaatctgatttctgtcgagatctacagtattttttacactttcaaggcactgttttgtaaatttaagagtattgtacgagagaataataacagatgtagcgggaacatggattccttcagattcaagagcagcagcctgctcctcaatggatttgaccatttggagatcagactgctgtgatgcaataaatctggcctgatagaggcagataagttcctgatatttattttttaaagcgtatgaatttgaaagtgaaataaaaaccgtaactttattcatcttattttcctgaagacgtactcggagccgctactgtagaacctgagttattcggggtcgaggaattcggctccataagcttcgtaacagccgcggccgtatccggatccatctgtcctaaaatattgcctctagcatcttttttcatggtccagaggatctttccaacaagttttaagttgttcgtcatcttgtcaaagatggcggctgcctccttaggcttcatggaagagtatgcagctgcgtaatcagaaagcttcgaatcagtctgaagatctccgataacctgcttatatagcttttcggcggtctcaggttctatctcctcatagtattgtttgtaatttgaaatatccggagcattgtcggcatagacaacctgctgatagaatttggtcttctctttctcgaatttcttctcgttgtcccgatacttcttcagctgctttttaagctgtgacatgtcggcagagtcatttttggcgtcatttaactcttttttctgcttcgcaacctgcttctcaagctgctttactcgggctactgcctcagacatagatgaaaaagcatacgggtcgtcctttgtggcgtttcccgaagctgtagcagatgcagggaggattttatttactcctgggatatttttaaggtatggggagatcatagtaccgataccgcctacatccatatgtattaaaagtgcaatgatgccgagccaggtaaggaggatgataacacccgtaataacgactacagcgcccgagccctttgagtcttcgtcataatcactttttttatttttcctgccttttcttttcggactagggcgcttctcaccctcggtctgaagtgaattagagtctgccataaaattctcctgaatatcaatctttatttttagctgaaccgtaggtgtagctggtcagctcgtcattggccttgttgtcctcggcgttgagctcgagcttgaactcctcgaaagccttctcacgaagcctctcgtgagttttcctctctttgcgggcttcatcgagcctgcggcgctcaatctccaaagcgttctgtgccttctggactgcaaacatctggtcgcgaatcagcgacttcatagtagtgtttgcattccttaaaaaaatgatctcttttctatctaaggaatcactgtccacaacttccgcgagcctgttttgataatttgcagctcttacgagaagctgagtcagtttttccctctcttcattctcccttgcctgagccaaagcaaactcagccttctgctggttttcgagcatctgctttaaattcaggatattctggagacgataaacaaattttgccatacgctggtactgccttctctgaccacatggtgcgatgcgttaagatgccttctgttcctgatcctcagaatttttctgagcctgatcctgagggaaaattttaagaagcatctcgatgatctcatcgtaattgtacttatcgtgcgtttcctggagcaggaattcgttgacctccggcatcttctttatcgcaaagtcgatctccggatttgagcccttcttatatgctccgatattaataagatcctctgcctcagaatatgtggccataacatttttgagctgtcctgctgcttttttgtggtctgatgctgcaactgcgctcatgaccctggaaatcgaagccaggacatctatggccggatagtggtttcgctgtgcgagacggcggtttagaacgatatgtccgtcgagaatacttctagctgtatctgtgataggttcgttgaaatcgtcaccgtctacaagcacggtgtagaggcctgtgatagaacccctgtctgagtttccggcccgctcgagaagtctcggaagctgtgcatagatagatggcggataacctctggtaacaggaggctctcctgaagccaggccaatctcgcgctgcgccatacagaaacgggtcagagagtccatcataagaagaacatccttgccctggtctctgaagtattcagctatcgcagtagcagtcttggcggctttctgccttatcagggcaggcttatctgaggtagcaacaactacgaccgagcgcttcatgccctcaggtcccagatcgtgttctacgaattccctgacctcacggccacgctctccgataagagctataacgttaatttcagctttggtattgcgggcgaacatacccatcagagtggactttccgacaccagaacctgcgaaaattccaatacgctgtcccttgccgactgtgataaggccgtcaacagccttaacaccaagtggaagcggatcttttatgatgacacggctcatcgggtcaggaggatctgcctcgcagggatactcttctgtgaaatgagggtattcctctccttctttcagatcatcgattcgtccgattccgtctaccgtatgtcccaaaagaccaggtccgactggaatcgagagcggctttccggtatttgtgacaatagagccgactgaaataccttctgtcgcctcaaacggcataagtatcagcttcttgtcgttaaaaccgacgacctcagccataacagtagtgccgaaagccgtctgaatcttgcagagatcgttgagctttgcctccggaccgatagattctattgtaagaccaactactttcgaaacttttccaagctggtcataaagcggctcatctagagcttcatcaattctggaaagatccatcagatcaccttaacaaaaaaatcagagtgtaaggagcctgatccgcttgatcagattcttaagctctgtgtcaatcgatacatcatatactcctccgtcagtctcgatcatgcactgaccgtctgtgagcagaggatcctttgcaaattcgatgtttactccctctccaactttatcttcaatctctccacgcttcgatgtaaggagagtatagttattttcatttacgcggataagaagctctttcgctgaatcaacgtgattcaggcagttgtcaaccagacgaaggagaagctcactgtcatcgccaaactctatgccaaacgccttctgaacgacatttaatacagtatctaaaacttctttctcgagagaagattccttctgtctgtagttcttttctaaagtctcactctggacattaagtgaattgagcttgtcctcaagttcctcgtgagcttttgccagaccatcattgtagccctggtttacggccttgtctcttgtatttaagaaaagagcatcagcctcttctttagctttctcaatgatagaagcggcttcgctgttggcagcatcgatgatctttttacgctcgtcttcggaaattacaggagtaggatctgtcacttcctcttcgttttcttcttcctcttcaaaaaatggcacgccattttcatcgacagaaaaaagtggctcaccatcgtccccaagcgggatctttactgaaccatcttcgttctgctcaagtagaggatctccattttcggactttgggaggccaccaagatatttctcggcagctgctttgcgctgtcttctcttttcatcctcggactgtttctgccaggctcttattttttcaagagcacggtcattggaatttatgataattttatccttgctgaccgtgctgccatggtaaacactatacaacgatgtcgtcacctccgcctctggagataatgatctcgcctgcatcttcgagtcttcttataatagcgacgatcttctgctgagcctcctcgacgtccttcatacgtacagggcccatgtactcgatatcttccttgatcatggcagaaagtcttgaagacatattcttatagatggcattctgtacgtcctcattggcgcccttaagggccgtagcgaggtcactgttatcgacttcacgcaaaacacgctgaatagaacggtcgtcgagaagaaggatatcctcgaatacgaacatcttcttcctgatctcctctgcaagctccggaacctcgatctcgagagcttccataatacgcttctcagtaccacggtcaacagcattcaggatagcgacagtagagtctacgccacctgctgaggtgtaatcctggttgataagagatgaaagctttctctcaagcactctctccacttccttaattacttcaggtgaagtacggtccatcattgcgattcgctttgcgacatcagcctgcttctcaggcgataaggctccaagtatcatagccgcctgtgaaggaggcagatacgaaagaatcatagcaatcgtctgaggatgctcgtcctgaataaagttcaaaacctgtgaaggatctgtctttctgataaactcgaaaggacgaacctgaagagatgcagtcagcttgttgatgacttcctgcgccttgtcgcttccgagagcagtctcgagaagctccttagcgtatccgataccaccttctgcaatgtactgctgagcaaggcagatctgatagaattcatttatgacggcatcttttacctgaggggaaacactcctggtgtttgctatctcaagtgtcagctcttcgatctcatcttcttttaagtgtttaaatatctcagccgacctctcagggcccaatgtaataagaaggatggctgccttttgaactcctgaaagtccctctagtgcggcagtatctactttagcctgcgcatctccattggttcttgccggagctccacctggggcatttgccggcggattcgctgtatttgttctttctgctgtagtatcggccatgatcactcaccccagtcttcgttaagccagttgcgaagcaggtttgctgcagcctccggtttttcgtccacaaatttctcgatgagctgtctggcctcggacttctcgttgtatccgatgtcctcgagctgctcatcctcctgctgttccttcaggagtgtatccactgatacctcctctgcctgttcctcttccttctttccacggagacttctgaatgctacaaatccgagaagcgcaaagataaggattgcaagtatgatctcgagccagtcaacccaggtacgtccacctgtagaatagtgaaactgaggaacattgtaagcgtttatcgtaatatttgcctgaggtattcctgtagcattcgatactgccttcaacatgctgttatttactttcgcagcagtcataccgctgttggcctgtacgaactggtcgaaagtctgattcttaagctgaccggaagacttcatctggtcttcatcatagatcacgtcattgtaagcagtgatagtgatagtcgagttggatgtgtttactgtgccggctgcaggcttagtgtccgtataagtctcattcggcaggtatttgcttgtggtcttgtttgactcgctgcttgtattgccgttgtttgtagtaacgtagctgtttactccgttatttgatgctgttccaggctgtccaccgttcgaaccggtcgatgaagacgactctgtagtctgactgtcaagatatccctgatcctgtccgctcgctactgagtaattccagctcttggtctctgtcgtgtcgaaattcatatcgagattggcagccacctgtacattatcatagatagcgtcgctgcccgaaccgttcttcgagaggactttctttaccttatcctcgatgtacttctccttcttctgctgggcagaaagattcgatgaggcaataccacctgaagttgactcatctccacctgagaaaaggatgttgtcatctgtatcaatgatcgtaatatttgaagtggtcttatttccaagacctgtagctacgaatttggcaatcgcagcggcctggtcatctgacatggaatcggagagatttaacatgacactggctgaagcttcctcagacttagcagcgagggtaccatcatcatcaggaacgctcaagtttatctgggcatccttgacatttgacagagtcttcaggtagttttccatctgcttctgcttaaagtagttgtcctttctctgcttatccgactcagtcgtagtaaatgagccatctacaacgtttgaaaaaggatagctgtcgtcagttttctcgccggaatatccgttggaatagataccattctgtcctaagatgatagtggcattcgcctcatccttcttgtcaatagtaaaagtcataccatcctgggactgggtatatttgatattcgctccgtcgagatcgtcctttatagtctgggcctgagtggcatcctttgcggtaacaagagtcatcttgtctggacgagtggccacaactcctaaaatgataagagcaatggctacaatcgagacggaacttataataagcgctttctgtctggaagtgaactttttccaccagtctgcaatttttgtgaaaatgtttttaattctatcaggcatttaagctcttccttttatgatcaaatctgcatgttcatgatagtctggtatgcctggatgacattcgtcctgatcgagttcgtgaactggagcgctatcctggctttctgtgctgctatcataagatcgtgggtattgtctgaaaggccaagggcaaactttacctgctcggcatctgccttgttctgtaatgtgttagtctcttcaaccagattctttgctgcatcgaagacagttccgaaatcgtcgacagaattcggatcctctccacctctcttcggtgcagtcttataaagagtatttgaagcatcaattccagtaacctgcatttataactcctgtaattataccgatgaacctatggaaattccctgctgggctgtggtcttcaaaccattcaacacagtgacattcgcctgatacgcgcgtgtcgcatcgataaggtctgtcatctctgtaactgtgtttacgttaggatatgtgacatagccgttctgatctgcatcgggattcgacgggtcatagaccatcttcatcggagtagtcgtatcctctaccacagaggcgactcttacgccattccccttgtacgaattctcgtactgctccagggactcggcaaaagtaggattcagtctcttctcctgaaaaataaccgacttcctgcggtacggaccagagccgtcctcggagtgagtcgtattaatatttgcgatattttcagatatcgtatccatacggaaacgctctgctgtaagcccgcttcctgatatgttaaaagcttggaataaactcataagaacctcctgccttatgacttcgtaacaatgttaaatctggcaaacgcactcgaaacactcgtagacatagcctgatatctgagctgctctccggcgtactcagtgctctcctggtctatatcgacattgttcgtatcgagtctgtaatcgaactccggataatcagtatagatctgtccgtcgaggctgtcgtccttataattgagcgactttacagcctgatcaagatctttgtacttcgtgctgtctaactcatctaagaggatatcctggaacttcacatctttgcgcttgtatcccggtgtgtctacatttgctatgttattcgagatggtggtctctctgagccagctggcatcgagtgccttatccatcagatttatatagctgaatgcatcagacttcagcatatagtttcctccgtaattatttcttaaaacaatgtaatcaatatatattatatttttatttgcctaaaaatacaagctttttaacaaaaaaatagtggcatttcagctaaaatgccacacgatgttgttgtattgagttatatgctgatgtgttcctttaatttgtcaagttccccgaagactgcatcatttaaaaccttaatataagtgcccttcatcccggatgaatgtgactcgatgacaccggctgattcgaattttctgagtgcatttacaatgatactcctcgtaatcccgaccctgtcggcaatcttcgatgtgacaagaatgccctcacgcccgttcagctcagcaaagatatgaataatggcctgctgctctgaataggataaggtgtttatcgcagactgtacatctgtgatcttcctgttttcctcttcgttctcttcgtttacagagcgcatcatctcgaggcctacaactgtggtcccgtactctgctaaaatgatatcatcaatgtcatacggattctggtatctgtagatcagaagcgttccaagcctctctcccgaaatatcaatcggagtaataagcgcattgtacgaagctatatcctcctgctcgaacccgagtgtcccgagattaacattctctctcgtagagaggatgcctaaaagcctttcgtttaagtcaggattaataaattctccgaccttgtcagtaaggagttctgtgatgtgatgtccatcttcgtgctggctgatgcctaaggccttgcccttcttgctgatgaccatgcaggaggagtctaagatgtctgtaaggaccttgcagatatcattgaatactaccttcgaatggttgttgttatgaaggagtttgcctatttttcttgtcttatctaataattctacgcccatattttcctcaaaatgtctaaacaattctctcaatatagaaaattataaccattttctgataaatttcaagactcttcttcaatttttggctcgctgtatccacaagatggatctgagcataccagtttctttccgcgaatgaccatgtacttcccacaccgaggacatttcttttcgacaggcttctgccagctcatgaagtcgcaggcaggataatcctcgcagccatagaatttacggccctttttagtctttctgataacgatatccttaccgcactttggacactttacgccgatcttttcgagatatggcttggtgttccggcagtctggaaatcccgggcaggccaggaatttgccatgcgggccatattttatcaccatgtggcgcccacacttctcacagatgacatcggtctcttcgtccttgatctcgactttctcgaggttcttttcggcagtcgtgacctctctctcgaggtccgggtaaaaattcctgatgatcgacttccagtcgaccttgccttcctcgacaccatcgaggagactttccatatttgcagtgaaggtcttgtcgacaatctcagggaagttttcgaccatgatattgtttactatctcaccaagctcggaaacgaagatgttcctgccctcttttatgatatagtgcctctttaaaagagttgatatcgtcggtgcgtaagtcgatggacgcccgatcccgagttcctctaaggtgtgcacgagagatgcctcagtaaagtgcggcttcggctgtgtgaaatgctgcttcggatctgtctttacctgggaaaggacttccccctcatcaaatgcctttaaatccctggagttcttctcctccttttcgtcggaatctacataaactttcgagaaaccgtcgaatgtgacagaggtgcttgaagcattaaatccgtatccggcacaggtgagcttaattgatgtggtctttctcttctccggcgccatctgggatgccataaaacgcttccagataaggttgtagagcttaaactggtctcttgtgaccctgtcctttatctcggatggaagaatcgtaaggtctgccggtcttatagcctcgtgcgcgtcctggacattctttccgccggtctttctgtcagtctttatccctaaataatcttttccatattctttttcgataaagtcagctgccgtggcttttgcctcatccgcgacacgggtggaatctgtacgaaggtaggtgataagtccgatcgttcccatgccctttatctctacgccttcgtagagctgctgagccaccatcatagtctttgcaacggcgaagtttaaagcctttgaggcctcctgctgcattgtagatgtagtaaatggaagaggcggcttaacggacttttcggaatctcttatcgattcaatggtaaagtcttttccgtctatagcctttaaaatactgtcaagttcctctttagatccgatatttcctgccttttttccccttccgtggtaagaggcggtaagcttcttcctgccggagcccttaagttctacatccaaagtgtagtattcctccggtatgaaggcgtttatctcatcctccctgtcgcagatgatgcgaagtgcgactgactgcacacggcctgcagaaaggcctctcttgaccttggcccagagaagcgggcttatgctgtagccgaccattcggtctaagactcttctggcctgctgggcgtccaccagattcatatcgatgtctctctggtgcttgaaagactccttgaccgcttttttcgtgatctcgttaaaagtgatgcgggcataatccttgtccgaaagatttaacgcagggattaaatgccaggaaattgcctctccctcacggtcggggtctgtcgcgagatagactttgtctgctttctttacttcttttctcagcgaagctaaaagctcccctttgccccttatcgtaatatatttgggctcaaaatcgtgctctacgtcgattcccagctggctcttcggcagatccctgacatgccccatcgtagcggcgatagtatagtttctgccgaggaatttcttgattgttttgaccttagtcggagactcgacgatcacgagattttttgccataaaaaaatatcctttcatatttcgatttcgtagagtacgtagcagtttataaatatacaccactaatttttgtttttcaagcctcttttttatgaattgtacttgcaaaattgctttttttctgataatgtaatagtgtctttcaaaaatattcgtattttttcatttcagatcctgcggtttccgcagtttttttctaatgtttagccaaattaaatcaggtactttacatggccttgacgctgccgtcgtcacagtggaagcagatgtaagtgaaggtctgccagtctttgatatggtgggcactctagccactgaagtccgcgagagcagggagagggttcgaactgtattaaagcttatcggcgtaccgcttccggcaaggcgcatcactgtaaatataagccctgccgatcagaaaaaaagcggaagcggctttgaccttccagtggcctgctctgtgcttctcgccatgggttattttaagagtgactcatttgacgatacttttgtccttggagaactcaggctgtcaggcgagattctgcctgtacggggcgtgcttccgatgcttcttgccgcaaaggaaaaaggacttacgaaatgcattattccaaaggaaaatctcggcgaagcggccctggttcccggaatcagggccaccggagtctcttctatcgaagagctgatagaatttattaaaagaggcactctgccaaagcctcttataccttcacctgaagactcttcttctgatgaatatgaatacatggattttaaagacctccatgggcagaaagcgccaaggagagcctgcgagatagctgctgccggaatgcacaaccttcttttgtacggccctcccggcgccgggaaaagcatggccgccaggtgcctgccttctatccttccgccactttcggacagcgagaaactagagcttatgaagatttacagtataagcggaaagaacaatttttcctaccagaacatcaaaagccctttcagaagccctcaccacactgttactgcgattgcgatgtcaggtggtggcagcaacgtgacaccgggagaagtcactatggcccacaacggtgtgctgtttttagatgagcttcctgagtttaaaagagatgtattagaggttctccggcagccgctcgaagagggaaagataaacgtcgtccgcaacagataccaggaggaataccctgcggattttctctttgcagcagctatgaacccgtgcagatgcggctactacccttccgcccgctgtacctgctcagtaagttcgataagaagctatttatctaagataagtcagccgcttctcgacagattcgatctctgtgtcgaggcgaagaaggttttgatcactgatctcttcggagaaagcgaagacgaggattcagattctatcagaaagcgtgtaatcgaagcctctatgatccagaaagagcgctacagcctctgttcgtataactacaactcacaggttccgtcttccgacatcgaggagtactgccgtctcagcgccagcgtaaaagaattcgtaaaggagatgtttgagaacatggaccttactgcccgcggatattacaggattcttaaggtctcgcgtaccatcgcagatctttcaggcattaaagatgtcggtaaggatcatatagctgaggcctgcttttttcgaagcctcgaccgcagattctgggaggccgcgctatgatatttgaagaatttgcattcgcctccaccaaactgttctcgagaggcagaaagagaaaactgctaaagattttttcagatgtaaatggatttttaaatgcatccgacaaaaaaatactcgcatttgacatcattgatgaaaaagagcttttcgccttcaaagacgagctgaaaagccctgctttaaaagaaagcttccggaggttttcagataagggctttgatctcgtgatgaattaccagagcggatttccagagactcttaagtatatacatgaggatccggtcgcacttttctactgtggaactctgcctgaacctgaagaaaaggtcgtcgcgatggttggcgcaaggcgctgctctgcttacggacgggtaatggctggaaatatcgcagagtgtcttgcaaagtcaggctactctgtagtcagcggaatggcctatggaatcgacgcctattctcatcgcggcgcattagacggaggaggaaagacctacgcgtttttaggatgtggactcgatatctgctatccggagtcgaacaggactctctacagagatatccccaaaggcggagccgttttttcagaatatgcaccggggacccagccccttgcagcatattttccagacagaaacaggcttatcagcgggctttcaaaggcagtatgtgtgatagaggccagggagaagtccggaagtcttatcacagcggactttgctctcgaccagggaagggacgtctatgcacttcctggaaaagtaacagacccattaagctgtggctgtaacaggcttatcgcccagggagccgggatcgttacctcacctgaagctctcgcctgcgaactcgaattcggcccccatgccgcagaactttctgtgaatcagattagcgaaaaaactcctgatcttgcggcagatgagcttaaagtatttaagtcgtttgattttaatgcgaaaggtatcgatgaagtgcaggacgaatgcggacttaccctgctcgaactccttgggatagtatcctctctctgccagaaaggatacttgagggaagtgtttttaaatcactatgtaagaaataaaatctgagtattacgagatgctttgatgttttttatgttttttcaggacaaattccctgatgtaggcaaaggtcgcttcctcgcccttctctgcgttcatcttcagaagctttgagagcagtgcgtcactttccgggtggatcaggtagtgcccgtgccccttcagatagtacttataagctgcatcatcggtatatttgtcaccgagatagtttttgctggcggaaatcctgtctataaacatctctacaacgtattttacgggcatcttcatgccgataagcggatattcgccgggcttggaatccacattgtagtcgatccagtactcgtagtggtgcttgtttctgcctttgtgatggagccatgcggtagagagacctgtcgcttcgcgctccgcgttattcgggcttctggtgccctgatagtacttagctccgaccctgaactctgtccaggagtacttcgaaaggtcgtgcagcaggccctgcctgtaaagtcccactttaaagcagcctttcatgactaagtgccggtgatgtgtgatcgtcttgaaatgtaaaaaagctttctttaaactcatattacctacctgcaaggatagataccgtgccacctggaacggttatttcgtcctcattacacagaattggattttcatagaaggcctcttccccggtatttgcacacagataccattttcttgagtctttaagcccagggagagcatacgtcctgtcctcatagtagaagttcataaggaccatcacatcctctgagtctttagatacataagctccggcatagaggatgccgaggcccttcttctcggggccgatgcccatgatccacggctctctgtcgtggtacgaaagatcaggaagaccgcagccaatgtagtcgcactgcttcataggaagagcgctccttattgcgggatggtcactcctgaattttataagctgctttacaaactcacgcaggtatctggcatcttttttgtttgaaaactgtgcccagccaaccgggttatcctgtccgtacgggttgttatttccctccgctgaatttaatgactcatcgccttcagtgataagcggtattccctgggagagcatcagaagagcaaaatccgacctgatgcagacaagcctctttcgattgacattgcggctgttcgtcctgccctcgtatccgtggtttgagctgcagttgtagttgcttccgtcgcggttttcctcgccattggcttcattgtgcttttcaccgtaactgtacgcatctaaaagggtaaaacctgtcttttcagccgtataatttacaaagccaaacttctttccctgttttctcatctggtttgcaagctctgctacagagccgtccatatgattttcaagccgcctcagaggatagatgaaatcgtcgttgtagtaaaaaaatctcttgtgctgctcgtgtgacaggtctctctcatcaactctgtcgtagaagatctttacatctgaaagcttagggtgagacagcagatactttatcggaagtccctcaccgataaggtgaaaaccgtcgaccttgtatctcatatgccaccagattaaaatatttgaaataaatctcggattgtttattattttttcggaagtgaaagaaaattcgagaagaatctccatcccggccctgtggactgcatttacaagagtatccattcccttctgcgggtctgatccgaaatatgacgccttcggcgcaaaataggaggcatccccgtaaccccagtaattgactccaaaaggctctgaagtaacttcccctactgtatcgtcaggctctgtgaccttgtatgaatggtatctgatctcttcgaagtcatagacaggcattaatagaagcgacgtgattccgagctccttcagatacggcagtttttttataatgcctttgtagttgccacgggctgaagccggaagtccgttctgctctgtaaatcccctgacatggagcttgtagattaccatatcctccggggaaactgccgtaagcttctcagaaaaatcagcacagcactcgcccacacagccgtagacatcaaaatcgttcttctttctcgagacatcgttccacttctcgcggccagatatgacaggagcataagggtctaggtaaatgccgtcggaatcctttaacatatagcagatgtcgcctttaagtgcgggaaaaaagacagagtacacccgtccaacactcatagacttacttaaagtgacttcttcgagcatcttctttgtttttttatcgtaaaaaatgacagaaaggccgccctccctccttgcaaccacagtgagctctactccacccctgcagtggaacgctccgtagtttaaaaagctgccttttttcatttctaaactcatataatctccaaattctttatttatccgcaaccgttagccctaattatagcatatctcatttcaaaaaaaacgaaaatttgtcacaaactgccaaaagcctctttcagaaacggagacggatagtaaatatgattaccgtacttcccgcagactgagatgtagaggctcttttttgcgcgagtcatcgcgacatagaagatgcgcctctcctcctcgatcttagcggctgtgtctgccttatccgacggagtgatcccgtcgcaggctccgattataaagacagtgttaaactctaggcccttcgaaccatgaaatgtgtagcagccgattttgcttttcctgtctgacttagtctctgaaaaaagagccctctcctttttttcatgcatcgcttcgcaaaaatcgccgatatgcctgaagcgcattgcttctttctggaggatctcagcgtgcctgttgtagattgatgcgtcctgcccgtttttatatgaaaagtcgcggatgaacttcccatatcccatttttttaaggatatagtttatcgcggcagaaggtgaaaggcgcgagataaaacttatgtctccgataaataagacggcatcctttgcaaatacagtctttttcatcttatcaagccactcccttttgtctacctcttttctgccgaggcctatgactccgatatttttatcagggtgggtaagcgctgtaacgaaatcctctcgctttacgacatctttctgtgaaatttcaaggtaggataaaatgtcgatgaatacaaaactcttatagaaaaatatgtcatcgcaagtgccaggagaagaaagcctctccatctcctcgagaaggcaggcacttaccatcctgctgcggtagaggacagcgatttctgaaggatcctctcccctgtccagaagctcctttatcttttgagctacgaggcgtccttcctcgcgttcatcctttgaggtaataagctcaatgtttcccctgtccttcgaaaaggccgacagattttttttaaatctttctctgttttcagagataagcttagcggacgattcgacgataatcgagtcactcctgtaatttttatttaagataatgctctctgctttcggaaaatcctgcctgaactttaatagaaatgacgggtcgcttcccctgaagccgtaaattgcctggtcatcgtcaccgaccagaaacagattgtcgagaggatgagaaagttctgtaattatgtcgtactgaagcttattcatgtcctgcgcttcgtcgaccagaataaaagggaacctcttccgccagaagtcaagccgttctggatgacttgaaaagaaccgcctggtctcaaccaagatatcgtcgaaatcaaagtatcctgcatctgtcgtattctttgcgaaggatgcgataatactttttacttcatctgttgtggtatcgtttggatagagattttcgtcaagaaagccggtattcttgtaatagcttatggtccgaagaagggctgaatagaactctgaattcacctccttcctgccgcactcatttacggacagcgaaagaagcccaatggcctttcttcctgagataaggcgctccggtctgatctttccctcttttagtaaaatattgtaaaaaactgaatggaatgtgccgaatgcaggcgaagggtaaatcttatgctcaccctcgcagcgtctcttcatagatgaggctgcatcccgcgtaaaagtgacaacaagaatcctgcctggctcaacgcctttttttacaagagacgctatacgctcggtgatgacaagtgttttgccgcttcccggccctgcaatgcaaaggcagggccccatgaagtggtctacagcagcctgctgctcatttgaaagtattctccccatactttatccccctgcttcccggttattccgggttttatttatttgttctcaagtttttcgatgccagcctctatacgcttcaatgactcatcttttccgagaatctccatgatctgcgtagcgccgccaggtgtagtctgcttgccggaaagcgccgtacgaagcggccacataacaaagccaaccttgtagccgttctctttcgcaaatgacttaagcgtcgcaaaaagcgcatcatttgaaaaatcgtcctgatctttaaggatcggaaggacagactttaaaagttcgagtgagttctcctctgtgcacttgttcttcttgtttacataaagagaggtctcgtactcaggtacctcttcaaagaagtccacaagtcctgcaatatcagggaagatctcgatacgcgactgaacgagtcctgcgatcttctccttgtcacagtctctcgttactgccttatcgatgtaaggctttgcctcctgatagaatgcagcaggatccatctttttaatgtactcgccattcatccacttgagcttcgtagtatcgaagactgcaggcgacttattgatatggtggtagtcgaacttctcgataagctccggaaggttcatgatctcctggttgtcctcagggctccagccgagaagtgccacaaaatttacaatggcatcaggcagatatccctgctcgacaaggtcctcaaatgaagagtggccgcttctcttcgaaagcttctgatgctcctcgtttgtgataagcgggcagtggatgtacttcggaacttcccatccgaaggcctcgtagagcctgttgtacttcggtgatgaagacaggtattcatttcctctgacgacatgtgtgatgcccatcagatggtcgtcgaccacatttgcaaagttataagtaggatagccgtcagacttgataaggatcatgtcgtcaagctcgctgttgtcaactgtgatgtctccgtagatctcgtcgtggaaagtagtcgttcctgtggtcggattgttctgtcttatgacataaggctttccagctttaagattggcctcgatctcctcctttgaaaggtggaggcagtgcttgtcataaatggatacgaccttcttctcaccgttttcgtctacgacttccttctttaaactctcgagtctctccggagtgcagaagcagtaataggcttctcccttgtcaataagctgcctggcgtacttcatatagatgccctgctttacacgctcgctctggacataagggccgactccgccgtctttgtccgggccctcgtcgtgctcaagtccggtgtcttttaaggtcttatatatgatgtcaacagctccctcgacatatctctcctgatctgtatcctcaatacgaagtatgaaatctccgcctgcatgctttgcgataaggtaggcatagagtgctgtacgaaggtttccaacgtgcattcttcctgtaggtgatggtgcaaatctggttcttactttcatttctttgtgctcttctttctctgggaccttctccggttccgtattatttttttcagtctgttctgcttcaggagtctctttcttttccactgattcaccatcaggtgatccagcttctttttctgctggttcgctgtcaggtgttttggcattctgctcctcggtctcctccttgtcgagagacttcagaacactatcatcctcttcttttctcaatctgtcaagtccgcagagcttgtcaacggatctgatgatctctatgatctcaggtacatagaaatctgcctctttcataagcttatctatctcgtcacgttcgctctttacctggtggatctcaagccttatctgctctcttacgtcttttctcttctggacgagctcactgtgaacgtcacgcatggcatcttcatgatttaaagcagccgcctgcttcagccatatcttgctgtcgtagagcctgagcggtgcgagaagcctgaggagatattcgttccaatatgttaaatcctcgtcatcctttacgaacctgtttcttctgtaattaaaatcctcataggcattgaaaaggtaggtaagctccgttgacgagtgcacatggtatttatcggccgtggcatttaccgcttttgtgacatttgcgtactccattctggtgacatttaacgcagttatagtggaatttaaattcgaaaggagtgctttccgctgtcttatggaagaagcctgccacatgaacaaaagcatggcaattacagcaaaaactataagaaaaatacccgctatctgtgacgctgcactgcctgatgatccgcctgccgcaaaaagaaatataaggctcgctgcaaaaaggaccataagcagaatgcagattcttctggcaaatgaagcgtgagatgatgcctcgtcaaaatcaagcttaagctctcctttatctgcttcaagagcatgcatctttgccgcggtattcgactggaggatctcgttttctctcatgcggctgatctcccgctctatagtcctgtcattttcggctataagggagtatgcatcgtcggagatagtcttgggagcatctataaaagttttcctgctcttctggactttttcaatagcagctgctgccttttttacagcagcggcctccttgggattaagctcgtggattctctttatatcttcaagatacctggtcaggactctgtattcggcttttttgccttcgatatcctttgtctccgagatgatctcttcacaagaatcgaggatcatgtgctcgatcttcttcggactttccatgtcatctatggcatttgcctcatcgactaagtccgtaaatatctcgtcttctgtcttgttcttttttttccttttaaatccaaacaatatttatgcaccatactttctgatgtagtcggactttagccctgcgacaaattcatggagatttccaccgtctgtcaccttctcagtggcagcctttacagccttagtctcaccggcagccgcaaacacggctcttgctctctcgagctcctcatctgcaatatggtatgtctcacaaatgtcctttatgccgtcctcgtcgtttagctccataagggagaacagaagctgcataaggctctttatgcttaagttgtgctcgtaggcctttttgtaccattccgctgcctcgtcaaacagaaacaatctggcataggcatagccaatatcgtggcagatatccccgtaagtactgcgctccaagtcctcggacgcaagtattctctgatatgctgttataccctttctcaaggcaccgctctgaaccataaggtctgcgcgcttctttctcttctcagcagtagaaagtcccgctgaaagcctgacttcgcgtacacagtcctttatctcctttggagtcaggtagccgcacgaagtgaggatcatctcgataagcacatggaatggcgtatctgcatcccttcccgcctttagacgcagcgaaagatcgcggtatccggcctcatttgaaatccagtctataagctcatcagacagaaaatcgctctctaagatatcagtgtggtgaaagataaaccagctcagttcctcgagcgaatatatatttaaagatgtgctttctatgtaaaacggtgccggagcaagtggcttcctgcatagtattaattctcccatttaatctaccccaatcgttgtagtaaatgtctttccgcttcctcttgcaatctcgccaaaacccatatcgagaatctttatgctgacttttttgtcagaaagcggagttgcagtgatgcggagcctcgtcagccggttgtcacggaccgggaggtctttaagctttaagacagaggccacggtctttctcgaatccggtcgtccgatgtagatctcaacctccgggcttccatcgaggatcacctcgcactctcccttctcctcataccagctctcgccggctcttatcagcggataaaatttcagatcgttcaaatcggaaactttaagcgaaacattaagtttcagttcgtggtcacccacataggtgtacccccagttgacgctctttgtctttaccattgcggcgtagactgcgccacgtgtgtagaggttctgtcctgtaaataccctgtgtccgagcagtgccctctgcagtgacaggttcatccactcccttgaaaatccagcccctgtcaaaaatatggcagagacaagattgccctttagcatctcttttaaggcttcgtcaaatgaagagtccttatccgaagggtcaagtgtaaaatatttctcatctaaagtaataaactctccgtcgtccgaagcatttttattaagcctcagcgcatagacatttaaattctcacactcgaacagtacgaggtcatgccttctgatatccgggctctgcgacagacaatagtaataaaatgcttcttttttgtcgattacagcaattttgtccctgtctatgccgattttttcagcacagtaggaaaaaagcgagactgtctcctgtgtgacctcctgtacgcagaagaccagaagctgcgtgtcttttatcccactcatagtcaaagccatcgataacagtctgcgcagatatatcgtaaaaatatcccttccggaaaagaggtcggcatccactatgatcttctcgttctcgagtgccctcttgtaaaagtctggtatcagcgtaacacccttttcatcggcgtggcttatggcctcctctccagtgtaccactggcctatcccctcttttttggctacagccatcggtacacagtaattttcctctccatagactaaagagacagtgaccggtgaactgccatccggatttacataacttataagagccctgtcttccgagacatcgatcccgtagaccgctccagttctaggtaatagtttatcttccatttctcacaccatcgaaaataaatcttccgacgaaacatcgagcctgatatattctctgatgctttcttctatagcgctgtcggaatttttctcttcctcagagatctcatttataagcccgaatctgctctttacacatccgtccggataatcctggttcgaagcgttgccgctgtcaactctgtttccatcctggtctttgacctcgtatgggacgctgtcaccatggaaaagtatcagagacgagatgtaaatgccatcgtacgcctcatccatgtcaaggaacctctccttatcagatccagggtttagcgtaagtacaagctgcttaccgggcttaaagtgaacttcgataaaaactctctcgtagagtccgaattctcttacaaggtgaatgtccatttttttgtagaaggagaaatatctgccatctaaaatattgtcgcgcaggatctcctctgccgttgaaaactctgccggtttcagaggagaagaaaaagcgtagtgcttcaaaagtgccgtctttacgctctggtttatgtcgtggtctgtaacatagagatttctgatattagtaaagaaatcctcgtttctgctcttctcttttccaaggacatacctgtctgaaaaatatgtaagatacgctctgataagagtcttgtcatcggaatggagcggaacatacgacatgaaaatatcatcggcaatatcgcagtctccctcttcgtacatcatctgctctaaaatgcgtcccgcaagatctgtgacttcgcagcctctggccttcgcatatttgaaaacagatacaagttccttaagcggtcctctgtaatttgcacagaggtactttaacgttatctcatttgagaggtagtgatctaagagccagattgaaagacctgtcagaaactcgtcttcttcactgttttcgcacatctttgtagcaagatgcagaagaacattttccggaacaagaaaaccgtagacatccttgatcagtgaaaatgcctgccctgtcctgtcttcctctatcagctttctcagataataagtcacgacctcaggtcttctgttcgaaagcgaaatctttgcaggaagataagatatatcaacgctgtcatagtcatttgaagaaataacgctgtcggcgaaagcctcttccgtatcctctgtaatcagagccttcccctcatgcgtcttattgtcttcaatctctgagagctcagggaggagtttctctgtgtagaacagttccttctcggcaaaagtaccgttctggttcgtaagaacagtaaagaaattctcctccggaatatctattacagccgcgtgatctttcagttctgtaacataaggtgtcctgatcttcggcgtatatatcgaaagtctgccggacttctgcgacagacagaacacttttcttgaattcttaagtccctttaatttcgacaggagatcgtcatcaaagaattttctctggtaaaggtccctgtagataatagagagaaaatcgtcgataacatttccctgcagcttttctatagcaaagcgctcagtctggctcttgtaggtctcatagatatccggtatcctgtctttatacataatgacattcgcatacaggtactccctcttttcatcagatatctcatttacatcgtacgaaaaatacaaaagcagcatcctcggcagcaggtctgtatcactgtcgtcgatgcaggacatataggtctcgtaaatccccgtcaggttcagatcgagctcaatgcccctcttgtaccagatcttgtactgctcaccaacgcatctgtttctgagaagatatgagtctatagccgataaaagctcgtcatcgtcgtatctgtcatatagctttcccgcaaaatcgaacactcccggattaaatgtcttaagctctccgatgcttttcgccacatatttgactatctcgtggcttaataccccgtttctctgtccgaagcgaaggattgaaagcgaaaaactgtcgatctgcccgatgtactccggataggcgttcattacatcgagggcttcagcatagaggactgggctgtgacagcccctgtttatccactttctaatatctgagaggcgcttcagagggtcatcagtgtactcttttcgtaaaaacagcagaaaccagaacactctcgggtcgtcaagctctttctgtatcccctctatctctcttgttatggtatcgatatagctctcgtctgagtccatcagagtgcacagatacaaaagaaaagcccattcgaagctcttcttgtcggcgatcatctctttaagcagtgagatcgtcgtaagtgccttctgtttctgaccggccacgatctgtgccatagtcctgtacagcagtgcttggacatcagccggattctgattcagaaaatattcgcaggcgtcagttgccgactttaaaaatgccatcgtgtcggtctttcttaatctgaaatcgagataccctttcaagccgtttacaatggtattctttctctcacgatcctttacataaaccggctcacccttgccataagttgagacagtgatatccttctctataaggatgccattgcccctgatagtcagctttgtagtgtttaatccctgatggatacggtcatatctgataaaaaaaggaacctcgagtgttcctccgtagaaatcactgtcagtgccttccgtattctcaagagaaacaaaactgtcttccggaactgaaaaacaaagcgaaacatatccgtcggtatttctagtaacgcggaaactctccctgatatcttcgtttactgcatagtaattgagctcggctgggaagacatgcagcctgacaggctctttaagaccgttctcacagagaaaattctcgagagccagcggtgtatatcccatagtcccggttagcgccctgtagcttagccagctgtcaggaaagtgcctgataagaagctttttaaattcctctgaggaaaaaacagaaactgcttcccttctgtctgttttctccagctcgtagagatctgcgagatttttgatatctctgccgtcatatcttgggaatttttcaataacggtaaaagtgtatgggatttttctggaaaatccgtcgcagattatcgaaaaagctccatctaaggtctgtccgtgatagaatccgccggtatgagcagtaaagtcgattacagcttccttacctgaaaaatcgctctgctctgatttcacataagggtttgaagagcagaccataccatcgagaggaaggtcactatctgtataaatgcgaaagcttcctgtgatgtcagagccctctactccatctttttcaatgatatcagggtccgtaagaggctccgggaagtcccgttcaaattcaccttctgcgagccttgcgattttttctttcaaaggaaagtcctttctttacataaattacaaaaatactataatgattataaatgttttatgttatttattcaataaaaggagtgatcaaaaatgcttaaacataaagaccattttcatggcagcgacatggagctgattgaaaaaatatacggcatcaaaaaagaggagatcgtaagcttctccgcaaacgtaaaccccttaggcatctcgccgaagctcgcctcggatctctccgatcatgttcactgcatcgagacctatcccgacagggagtatagtgaccttcgaaaggctatatcctcctatgcgggctgcgatccacactatattattgtcggaaacggcgcgacagaacttatttctctctttataagtgtcacggctccgaagcgggcgctgatcctcgggccgacatactcagaatacgagcgtgagatcaccttaaacggcgggcgcacttcgtactatccacttcgtgaggaaaacgatttcacactgcagatagatgattttatcagtaagctgactgatgatatcgaccttatcgttctctgcaacccgaacaacccgacctcatcagtgataaaaaaccgcgacatgagacttatcttagacgcctgcaaagtgcacgatatctatgttatggttgatgagacctacgtggagttcgtatcggacgagcctctggtcacttccgttccgctgactgctgactacaataaccttatagtcctccgcggcacatcgaagttcttcgcgtcgcccggccttcgcctcggctacgctgttaccggaaatgaagaccttctaaaagagataaatcagaaaaaaaatccgtggatgatatcatcccttgccgaagaggccggaaagatcatgtttaacgacatcgaatacataaaggcgacaaaggatctgatcacatccgagaagaagcggctgtatgacatctttaaaaaaagctctgttttcaagccttactatccgaatgcgaactttatgctgcttcagatccttgataaaaatgaagacagtcactcactttttgataaatgcataaaacagaagcttatgataagggactgctctactttcccgttcctctcggaccgctatattaggatctgcttcatgaagccttctgacaatgaccgcctcttagaagttctaaggccttagtcttctcaagtgccattacagtaaagtacagtatcaggctgtagatgggccaggtgatcaggttttttacaagtctcgggataaagatcactttgaaagcctggccatagaggattgaaagccagagggtgttaaggataatattatttaaaattgtaactgctcccttggctgcaaaaatccttatcacaccggccttctttctgtagagaaaaagcccgtaaattatggcagtaagcactgctcccaatgtaaatccagggaaaaatgccccgtcaggccttgtgcagtaatttataacatccagtgcagcagctgaaaatgccccagtcacaggaccgaaaagagctggtatgatcgccatcggtatccacgagaatccgatgtgtatgaattgaccgatattaatcgtagataccatgttaagcactgcggagagcgccataagcatagccaccgtgcataagctctttacgttcttaagctctgacagtgagtctttccagtaaaacacttttttttgcataaaaaacctcctttgcagtatccttaccgcacaggaggttttgttctcttatgcagcagcgggatgcggctataaaaccgcgggcatttttacaaaatgcccttcgttccggtgacaactccctgttcaccagacacttgacgcaatacagcctactctgcgtaacaaatatttaattctttactactgtatagctacttatattttttgtcaagcgaaaaagaagcggcccaaaagggccgcccaaccgtatcaatattttctttttccaaatgtcaagtaaaaatgagcggcgcattcgcactactgtactgaatataagatatcgccgtatgtaggatatggccacaactcatgtggaacgcggctctcgagctcatcgatgatctcacggagagaatccatatcaggatggatcgtgttcctgttgtaagatgccagttccttaacgtctgacatatcgtcctctttggcaatatcgctgtcgagcttgtcgagtctgtcatagagatcgtcaaccataacagaagcctgctgtaagagcttctcctcagtctttgtagaaactcctgtgccggtagacttcatatcgttgatggtctttgaaaggaatgactcatagcggagtgctgcgccaacgatctcatcctttgtcatatctgagagagtctgtgcctcgatgttgatctgcttatagtagttctcaaagctgatctcatatctagccttcatctctgtctctgagaataccttgttcttagtaaatacttcgacagattccggctccatgaatgcctcagtggcttcaactgtagaaggaaggtttctaagtcctctcttctcggcctccttgacccactcttctgagtatccattgccttcgaagatgatcctcttgtgatctgtgaggtgtttcttgataagctctgaaagagatgaatcaaaatcagatgacttctcaagctcatcagcatactctcttaaaacttctgcaacgatagtatttaaaacgatgttagggtctgcgattgaagcatttgaaccaagtgaacggaactcgaacttgtttccagtgaaagcaaacgggctcgttctgttacggtctgtcgtatcctgtgggatatgaggaagaaccgtagcgccgatgatcatcttggtcttcttgttgtcgtcgtaatcagttccattgattatagacttgataactgcgtcaagctcatcaccaacgtatactgagataatagctggaggtgcttcgttagcgccaagtctgtgatcgttacctgcagacgctactgagaatctcagaagtccctgatatctgtctacagcctcgattacagctgtaaggaagagaaggaactgagcgttctgagaaggtgtatcacccggctcaagaaggttcttgccagtatctgtagaaatagaccagttgttgtgcttaccggaaccgtttacacctgcaaatggcttttcatggagcaggcagtgcatatggtgtttcttggcgactgtcttcatcagctccatagtcagctggttgtgatcggttgcgatatttgtcgatgtataaacaggtgcgagctcgtgctgagcaggtgcaacctcgttgtgctcggtctttgcaaggattccaagcttccagagctctgtatcgaggtctttcatgaactccttgacacgtggcttgatctgtccgaaatagtggtcatcgagctcctggcccttaggaggcttgttaccaaaaagagtacggccagtgtagagaagatctggtctctttctgtatacgtcctcatcgataaggaaatactcctgctctgaacctactgtggtatccactctcttggtctctgtatcgccgaagagacggaggactcttaaggcctgcttatttaagactgccatagagcgaagaagaggtgtcttcttatcgagagcttctcctgaatatgagcagaatgctgtagggatgcagagcgtgtcctctttgataaatgcgtagctggtcggatcccaggctgtatagcctctggcctcgaatgtggcacggagtccgcctgaagggaaggatgaagcatcaggctcaccttttacaagttcttttcctgagaactccatcagtatcctgccgccaccagctggagaaatgaatgaatcgtgtttctcggctgtgactcctgtcataggctggaaccagtgagtaaaatgagtagctccattttccaaggcccagttcttcattgcctcggcaatgacattagccatgtcaagcttcagcgaaagcccctcattaattgttttgtgaagtgccttgtagacatcttttggaagtctctgtctcatgacgtcatcattgaaaactttgcttccaaagatctcaggtacgtttaccattttgttactcctttcctttaatcagataccacttgcgccatagttctgtaatactctggcactcgggtcatcgacatcgcagttctcccagttcttgtttggcatccaatatgccgggatcatctgtgcctgtcctggataatatttttcaaaaagatctctgtagagcagggattcttttgtgaacggaaccggtgcgccgccctctcttccataagctgcggctcttttcttaaattcttcgtcggtataaaggctttctgcgtattccttgatgtcatcgaccatcgaatggccaactgcatctgagaacgctgccttctcacggaacagcaggtcgtgaggaagaaggcctgtgccttcgaaagcgtgacggaggagatatttgcccttgttatatacattcattttaatactcgggtcaatactcatcacatagcttgcgaagtcgagatctccaaacggaaccctcgcctccatcgaccaggtcgaaatgcatctgtctgcacggagcacatcgtagaagtagagctcgtgaactctcttctcggcttctgtctggaactcctctgcattcggggcaaaatctgtatatttgtaaccaaagagctcatctgagatctctccggtaagaagaactcttatatcactctgctcgtgaatggccttgcagcataagtacattcccatactggctctgatagtagttatatcatatgtgccaagttctgcaataacttcttcgagagaatttataactgtgtccctgtccattatgacttcatggtggttggaaccaatgtagtcagcagcttccttagcgtacttcaggtcaatcgggtctgtattcattccgatagcataggtctcgatcggctttcccaaaagcttctgtgaaatggcacagacaagagatgaatcgaggccacccgagagaagaaatccaagaggtgcatctgaatcgagtctcttatcgactgctgctataagacgatctctgatgcctgcacagatatcttcgagatttccatttacatattcgtgtctttccgagatatctctgtactttgtaaacttaccgtccttgtagtaatagcctggaggaaaagctgtgatggtacggacaagtcctgtgatatccttggcttcacttgcaaatattatctttccattgtcatcgtagccgtagaacagcggcctgattccgaacggatcccttgctgctacaaaagtatcggctttcgaatcgtaaatgacgcaggcaaactcggcgtcgagccttgaaaacatctctgttccatagagctcatacatcgggagaagcagctcacagtcgctgtcgctcttgaaagtatagcctgccttctcgagcttctccttctccttacggaaaccgtaaagctcaccgttgcagacaactccgttgccgtgcagcacaaacggctgcataccttcgggagtaagtcccataatcgaaagtctctgaaaaccaagtctcttctttccgaagtccattatcctctcgtcatccggacctctggaatgagtcttggcgaaatgctccttaaaagaagcatcggacatgcctgacatatcctctactgccatgatcgaacacataaaagcaacctcttttctattcctgtttcagccaggtaaaaagcagattaaaaaaggtgccacggaccccgttaagagttccgcgacacctttgtcgtctgctttaagttgtagaaaagtataggacttttgagcatctttgtcaagggtttatttctctttcttatcctttgtcttatcttcagactctgctgcttttgccgcgtcttcaggcttttcaacagcagcaatagctgacttctgcatagggatacggcagttcttgttagaaccgaattctacaattattgtgtcctcatcgatatcgataacgactccgtagaaaccacttgtagtaagaacagtatcgcctactgccagtgaattcatcagtgcattcttcttctttgtctctttctgctgcggacggatcataaggaaatacatgaatacgaaaagtaccacgatccatatgatcatagtgacagcactgctgcccgaagaagatgctgacgagctcaaaaataacgggtaattcattctttattgcctcctgatttttcaaaaacttgttttatattagctgattttacatgttaagtcaaccgtttaaataaacgctctcttatttttcttctctggagacttcctggagctcatccagcttgtttttcttgaatgtggcatactctccggcatctatcgcattccttatctgctccataaggtgattgtaaaaatagagattgtgcagtacgcaaagccttaaccctaacatctccttagcctttaagagatgatggatataagccctcgagtatgtcctgcaggccgggcaatggcacccctcctcgatcggtctcatgtccttttcatagcgggcattgaagagattcctcttgcccttgttcgtatagacatggccatgtctgccgtttctcgacggatagacacagtcgaagaaatcaattcctctgtcaactgcctctaagatattctgaggggttcccactcccataagataggtaggcttgttctgaggaaggtaaggcacaacgacatccagaatatggtacatctgctcgtgtgactcgccgactgcaagccctcctacagcgtaaccatcgaggtctaattcacttatcctcctggcgttttcaatccttaaatcctcgtagatcgctccctgatttataccgaaaaggcactggtttttatttacagtgtcttcccttgcattcagttctgccatctttttcttgcagcggacaagccagcggtaggtacgggctacggaatttttgacgtagtcatattcggctaaggcgtttggacactcatcaaaggccatagcgatcgtagagcccagattcgactggatctgcatcgattcctccggccccatgaagatcttgtggccgtctatatgagagcggaaagtcacgccctcttcttttatttttcttaagtcagcgagtgaaaagacctgaaagccgcctgaatcggtcaggatcggcttgtcccataccatgaatttgtgcagaccgccaagctcttttatcgtctcgtctccggtccttacatgaagatggtaggtgtttgagaggactacctgggtgtcgatctgatgcaggtcgtcagtagagactgcacctttgatagctccgacagtcgcaacgttcataaataccggagtctcaatgtcgccatgcacagtcttaaatgtgcctctcttcgcacgcccatcaactttatgtaaaatatattctgccatttttatagtttgatcctgtcgacctttgcgtactggttctcgagcagcgcatcggcaagtaccagggctgtcatgctctcaacgacaacgactgctctcggtacaatgaccggatcgtgccttcctttgatttctattgtagtgtcgtcgccagcctctgtcactgtagactgcggccttgcgatcgacggtgtgggcttaatataagcccttaaaataatatcacttccgtcggaaataccgccgagtattcctccggaatggtttgttttcttgtggaccctgccgttttctgagaaaaattcatcgttattctcagatccctttgaaagcgctgccttacagccgtctccgacctcaaagccctttacagctccgatcgacataatgccgtaggcaagtcgcgcatcgagtttgtcaaagacagggtctcccagtcccgccggaacgcctgaggctatgcactctacaacgccgcctgccgagtccttttctttgatacatttctccagatagtcagaggctttctcatatgccttatggtccggcatatagagagggttctctgcgcattctgacagatcacagtcagagatctctacaggcccgatagcctttgtgtaagcgtggatctctattccaaactcgtctaacagcttagctgctactgcgcctgcagcgacgcgcgctgcggtctcacggccagacgaccttccgcctcccctgtaatctctgatgccatatttgctgaaataaccgaaatcagcgtgaccagggcggaatttgtctttaagctcctcgtaatccttcgagtgctgatcctcgtttttaataaggatggcgatcggagtgccttctgtcttgccttcgaagacaccggagaggatcaaagccttgtcactttcttttctcttcgtggtgaaatctgactgtcccggctttctcctgtcgagatatttctgaatatgttcagatgacaaatgaagtcccgcgggacagccatcaataatgcagccgatggcctttccgtgggattcaccaaaagtagttactttgaaattatttccgaaaactgagcctgccataaatctccttaaggaatttcaacaattctgatgctgttcggcttattgatcttaatagggaaattcatcataaggatcgtctctgtcttatggtcaacaataaaagtgcgcatctcgtcagaatcgtggtttaacattacgatgtactttcctcccgggagaacagccatagacttagggaaatatccactggtaggctcctgtcccttgtgtgtcagaagtcccgtcttctcgtcgcgggcaaaccagctgacaccgtgaaaaccatcgatagaaacgtagacatactttccatcatctgaaataacgagctcactcgaaaggtcggaaagatttgcattgtccagagaagggatagcctggatctgctcaaagtcaggctttccatcctttagagaataggcgtaaacctctatctcattcgtaagttcccctaagatatagaggaatctgccgtctgctgagaacttctgggctctcgggcaggaatcgaggttcgtatggatgttatcacatagcctcatcttgccattctcgtaatctagctcgtagacctttacctgattaagaccgtagtcagctgccagaaggaatttctcgtccggagtaagccttacactcgataccttcgggtggtcgagtcttctgtcgtgtgaagatatggctactccctgatggaaaatgccatctgcaacgccttcgatacttccgtcctcattcagcttcatcatagtgactctgccgtcgtggaagcctccgacgaaaaggtatcttctcttcgaatcacaggtcacgcagcagcctctcataccgccgatattggcctggttgatcttcttgagatcgccatttttatcaatggagaatgaagcgacgccctcatcctctatggaatagagaaactttccgtcacgcgatacatcgaggtctgaagcattatttataggctcaacgcctctctctgtaaaaattccggtgttcggatccacatcgtaaacatggataccgatactgttctcatgggtgtacgtcccaacatatgctacgaatttgctcattcctataccacctctttgcgtcttaaaaggtcgcccggctctgcctcctctggtaccttaaaatagatggtctcctttggatgcggggcactcttgacagcctccatgtccgcatttaaaagcttatcaatctttacaggtatattatctccgttaggcttcataatttcaatagtttcaccgacagaaaatttatttttctgtgaaatttttgcgaagccatcttttatctcttcgatctcaccgatataggtggcgcctttttcgtatgtgctctcgttgtagatctgcgcttctgcgcctggctttccgtagaaaaatccggtcgagaactgtctgtaggtgcactccctgatctcagcctcatactttggaatgttatttctgtatttctcaactgactccgccaagtcgtccagtgccatgcggtatgccctgacaactgttccgacatagaggtcagtcttcatcctgccttcgatctttaatgagtcaactcccgcatccaccaggtcatccaggtggcctaccatatttaagtccttggaattcataatgtaggtcccgcggtcattttcctcgacaggaaggtattcgcccggccttgtctcctcgacgagagcgtatttccagcggcacggatgggtacactggccctggtttgcatctcttcctgtaaaatagttcgatagcagacatctgcccgagtacgaaatgcacatggcaccgtggacaaaaatctccatctcgaggtcatccgggatatgggctcttatgtcctttatctcggcaagagacaattcccttgccccgacgactcttttagcgccgaggctgtgccagaatttaaatatctcgtagttcgtattgttcgactgtgtagagatatggagatcagtcttgccgttggtgataagctcttttgccatcataaaaatgcctggatcggcaatgagaagcccgtctggtgccatttcgttcaattcttttaaatattctctgacaccttccaggtccctgtcatgggcgaaaatatttacagtgatatagactttgcagcctctgtcatgggcgaattttataccacttacgatctcctcgtttgtgaaattgtctgccccggcgcgcagcccgaagctctcaccgccaaggtagacggcatctgcgccgtaccttacagcagtttttaaaactgaaaggtttgctgccggtgcgagcagctctggtaacttatccattctttctcctgtatgctgagacagctagaccatctccgaccggaagtacggtcgagacaaaagactcatctgtcatgatatctgaaaggtaggcccgaatccgcttgtggatcgtcctgtcgcggcgctctaaagcctcctttggctctaagatcctgccgtcctgtaaaatattgtccgcagtgataacagccttatccgcaagaagcggtccaacgagtctaaggtactccggatactgccccttggcggcatcgataaatacgaagtcgaattttccatcgagattttccaggatatctgcggcatcaccagcaagaaaggtgactggcgcatcaaatcttctgaaattcgctctggcctctcttatcctgggctcgtagtcttctatggtaacaagctctttcagatcatcgtcaaaatttgccataagaagggcagaaaatccgaccgcagtgccgatctcaagaatacgctctggacttatgagtttcataagaaaggccataaatcgctgcgtatcatctcttatgacaggcacatgatctgacagggcttttttcttaatctgataaagttcatccggcagcttgaaagggtaacttcttaagaagtcctgaaacctgtcgtagtcttcaaaaatcatacttcctgaatcaccggaaggatcataggatttctctgtgtcttcttccagacgtagtctgaaaggacgttcttgacctcagtcttgatgcgagaccagtcgcgtaccttctgatcctctaaatctacaagtttgtcagatactatctctttggcatcctccatcaaatcctccgaatccttcacatagacgaatccgcgggatacgatgtcagggcctgcggcgatagtgccgcttgcgctgtccattgccataactacaataatgattccgtcctcagccagatgctgtctgtcgcgaagaacgatatttcctacgtctccgactccaagaccatcgaccataactgttccggtgtgaacgtggcctgtgacctttgcctgtcccttctcgttaaactcgaggacatctcctgaggataagatctttatatgctctgtgtcgtatccaagtgccctcgcgatcctctcctgagccttcaggtgcttgtactctccgtgtacagggatagaatactttggctttacaagtgagtagataagctttatctcctcctggcaggcgtgtcctgaaacatggatatcacggaaaatgacgtttgcaccctttcgatatagctcgtctataacgtttgaaacgtccttctcatttcctggtatagcacgggatgagaaaattatcgtatcgtcaggctttatcgaaatcttcttgtgagttccgtttgccattcgtgaaagtgcagccatcgactctccctggcttccggtcgttatgataactgtcctgctgtcagggtatttgttcaggtcgtctgccgagatcagtgtcttctcagggaacctgatatagccaagcttctgggcgatgtcgatgatagttaccatgcttctgccctctacagctacttttctgccgtatctgtaggcagtatttatgatctgctggacacggtccacattcgaggcaaatgtagcgataattatacggtggtccctgttctctgcaaatatatcgttaaatagttctccgacagtgctctcagacggtgtaaatccaggtttctcagcattggtcgaatcgcacatgagtcctaagacgccgtgttttccgatctctgcgattctctgcagatcgatcgtatctccgtaaacaggtgtgtagtcgactttgaaatctccggtgtgcattatgactccgaccggagtaaagatggcaagtgcagcggcatcctgaatgctgtgatttgtctttatgaattctaccttgaatggacctgtctgaatagtctggccgtattttacgacctttcttctggtcttttcgagaatgcctttttcctcgagcttgtgatcgattatgcccatcgtaagcttcgtagcgtagatcggcgcattgacttcgcggatgacatagggaatagctccgatatggtcctcatgaccgtgagttatgaaaaatcccttgaccttttctttattttcaaccagatatgtgatgtccgggatgcacatgtcgattcccaacatgtcgtcctctggaaatgcgagtccacagtcaacgacgattatcgtatccctgtactcgaatgctgtcatattcataccgatctgctcaagaccgcctaatggtatgactttaagatgtgcttttgtatgagttttcattatacctccgttttcaggcatagcttcacagagggcagtatttttgcatgaaaaaaagagctgtaccgccttctgcgttccgctttgaattattcttctgtgtcacttaattcttctctgaaaacagcaaaaaccgcatcgatagtcttctgattctctataagctcatactcgagctcaccgtctgaatcagctgtctttctcataatgtaacagtcagtctcctcctctttgtcaggatcctgatctgaaactaacagatagctatgctggtttataactgtctctgaaattatataaaaatcctgctctttaccggattcttcatcaaaaaaactaattttttccatgtcttaacatgtatgtctctaaaataagaactgctgcagcctgatccacagtctgcttgacttcgtggggattcttctttcctcccgctattatagtactctcagcctctatagtcgtaaaacgctcgtcctggtaatctaccgggataccgagcttttgaacaagaaggtcaccaaacgctcttgtcacctggcacctgtctccctctataccgtcaaggcccagaggaaggcccagtacaatttttataatgtgatattcttcacagatctcccttatggcagcaatagtctgcctgtacttcgtcgggtgcttcctctttatcgtggtaagcccctgtgcagtaataaaaagtgggtcagaaactgctgcaccaacagttttagacccataatcaagtcctaaaatccgtccttcagccatcagtcttcccaggcttttctcttgatgtattcgcgaagaagctcctcaaccagctcatcgcgctcaaccttcatgatgaggcttctggcgttgttgtggcttgtgataaaagtcggatcgcctgacataatatatccgactatctgattcaccgggttatagcctttttcagaaagtgccttgtaaactaattcgatgatctccttcaccgaaatagaattatcgctcgtaaccttaaagtactgagtctgattaacatctttcataaaagttctccttcaccctataatgtcaagccccaaattacgatttttagggattccttgacaggtacctcaaaaataagagtcaacggtgatggatatcgttgcatcaagtgctgaatagtcgatttttgggtatggttcgcaaaacgcccacatgtcctttgttatcaaggccattttccctcagatcaactatggcagtgaaccttccgtggctatgggatctgtgtcccaacctccttcgtccactatccatacaccgagtgccagcaagctttcttacgagttcatgctcacggagtgaattcctgcttcctataatgtcaagccccaattacgatttttagggattccttgacaggttacctcaaaaaataagagtcaacggtgatggatatcgttgcatcaagtgcgaatagtcgatttttgggtatggttcgcaaaacgtccacatgtcctttgttatcaaggccattttccctcagtacaactatggcagtgaacttccgtggctatgggatctgtgtcccaacctccttcgtcccacctatccatacaccgagtgccagccaagctttcttacgagttcatgcctcacggagtgaattcctgctggctacggctcctatttgttcttgaatctctactgctaggacattcctgtgacagtcctgatttactcagtggacgctcaactgccacacctgatccaatagtaggtgtgatgataccgaagcatcatcgtttaaggttccttgttccagaacctggcccagcatccgtgtaccagatgttcggcaaggctctggaaatgttatacaatgtattttttcggtttgagttatgctgcctttgttctggaagtcttggataatgtatatcactgagcattctcatcgaatcatacttacgtcctgtcagcagggcgtatatacgaccctgagcagcttgcaggctatcacgatcaacgactgcatcttctttaacgggttctccgctgtgtcgtgtagtgctcgtgaaggctcttaaacgcctctgaatgaactactacagattttgctccttggaacagccatgttctcagtttcttgcgtcctctgtgactgatcttgtctgtcccttatgttttcctgagctgcatctacaagcccgagcccgctgatttctggatctccttcacatcatcgaacctggagatgtctcccatttctgcaatgatgctgacagaatgttctccccaaggccttcgatttcaagaacattttcaacgttcgggatctcatggcacttctggtgaagctcgtcctcaatcttgctgagttccttctgtatttctgttatctgcttgtgaaccatctcaccgcctcctttgcagccttgtctccgtccttaagaccgacgctgttttcggcatagctgacaatccgctcagcgtttctgtatcctgcgccacggagcttcgcttatgccacagttcttttattccctcagttcccagcctgattatatccgcaggaaatggcgcgttcatcagaacttcaaggtaaatgctccgtccatttttccgaatgcatccttatactcgggaaaataaaccttgagctgcttatgaagtctgtttactgcgtatcctgccttccataagctgatcgcggagagaagaaagacctcttatctctgcgtatacccttcaggatatatgggattccgaaattcccgtctttcaccaggttcgctataggcttcggatcttgcggtgtctccgtggctgttgtcctcaatctcctttgttgcttcactgcatagggatttacctggacaacgctgataccatgagatatcatccaacagcctatacagaaccagtaatgacctgttggctcaagtcccatcacaattggtctttattatttaggcagccagttcgagcatccatctcctggcacctcaagccttccttgctgttactgaaagaaaacggttctttgctcagctcgcgtcctctggtatcatagctctcacataatgagtttcactacctatatcgcatccaactataagcatgttgtcacttatgaatgagagcttgtcattcttatcgaacttgccctgagtctccagttccttccacgtggaagccttgagattttccttgatgacagtaattctcttttcgatttcctccattgaaaacacattttttgtgtgctggtgataagtgctgattttctattcttttctgtttacaattcatcgtagatacctcttgttcttttgaattttactaacgtccaggtccgtaatgattcaaatctacttgaggtatttttatatgtcaaccccctgacactttatattatacaggaggctttctttattatttagaaattcagttgcaccaatgtaaggatgtatccattttgttgaaataggctcttttctttctagttcagctttttcttctggagtgagtataaatctcaccatccctaggcatactcccaaatctcattttaggaacatcgcatattggtgtagaatgagcctcaataaatactatcggtcccgatgtcaaatatggattgataatctcagcctgctcgactgtaccattcgcgtctattatttttttaggtttttgatcatctaccatagaaaaaccaataataacacaatgaactttcgccttttcattagttcactttccaaacaaaagtagtatatgcaaaatttataaacagaataagtacagctgagatatttccaaaaagtcgtaacctgctcaccctgacaaatactgttagtcgatacaaatgcagctttgatatatgaaccacgcatatactgacatgcaagtttataccatgcgcagacataatccatttcaccgacaccatttacgccgttaaaaattgtacgtatctccattttttgagtggtgtacatatacattccacccacaaaaggcggattcccatgatataatccagcttttctgctggcactacctcattccagtctattcgtagtgcgttcgcctcgactatatttgcgttcgaagtaagtggcaggaaatccagctgctgaactatgattctttctgttcctttcatcatctgactctccgctatccagagtgcagttttggcgaccgtcccggcaaaatcgtttatctcgattccgtaaaactgagtaatcgataccttatcggtcgattgctcatcaaaaaccatctgcccacctgtcaggtcacgaacaacgcgattctctagcggcgcagagacagatatgtctctgtcaggaaattaccactgccgcaggcaggatctaacaagttcagttctttgatacaatgtctatgtaattttccggaacgtaaaaagccggaaacagcgcagttttgcgccatttctgggctttcacacgctggcagaccccgctgccgaagcgctctctctcaaggttcatgttgtctcccatcagggttccacgatcaaaacgaaacccctaacaggaaaaaaaaatgtgtaaaaccttaaaatgtttagtcgtcgaaaaagatatcatcacaacatcatctcttcgatgctgtatggctgacttttctgtcccgctgcatcctcttataattttgtcatcaacttcaatggtgcgagtttccgtgactgttttcattattcctagaagtccacgtttttcaatcggaacctcgactttcattgtgtttcatttcattcacgctcagttttaattgctttaatctgctgtaggagatcatctgacagttcattcttttcaggaactcatcctgcttctgaatgatgtcttcaaatgcagtatcaagctttcgccgacatctgttctgacagattttcttcaaaatctacagtctcggagcggaagatagtcctccaaacccatccattgacagaagttcttgaattagagcattcgatagcacgctcataaaaggctttctcatcagcggtcagatttttggaatctaggcacattgaaatacgcagagtgcccggtttattcggatttcaaagaaatagtggttccgtgtaccccagtcgctaatctgctccgtatcaggaaaaagtactgacatctgttgcgttttgaatcgaatagcgcttcgactgcgtgcttgaagtcagcctccagcagacctcatccgctttgcctgcacccatttagtagcatatcaaaaattgtctgcttctttgatcgtcaggatcatatccgccatagcgttcttccagaatcggaagaattaatcaaggtattcttactccactcggccatgaatttgccatggtggccagtctgcctcgtttgctatacttacatcttgagcgaatatgagatccacgaagccttataatcatgccctgttccaagagagcacatctccgattccatcttcgatttcatcttgacgagatttcaaatagtcaaatgccttcttgttttcatccgtgttaccttttccaaggtagaagtcaattcttgcgccatcccattgtgcacagctgacgcaaaatcctcgatcccaaaataaccattcatcgtatttgacgtactcggactgcaattctgaagcttccatttccacgatttgcttcctgtatgattggagcgcataagtccaatatcttttctgagatcgaagcgatttggtcggcagccttatcctgttccgaatcacgtgatagaatacgagatccatcggatcagcatgaaaaaggacaaatatccttcgcagaatagatatttttaatgccgtgctggtattcttctcaacatagacatcgtcatcaatttttaatggaacacgcaattcttcaggggtgctgctgaaataacgcgtagttctgttcactgctagtatgtatgaggtgtcgaaagtatggatttatcttcggcatgcagatactttattacatgctcgaatgtctgcccagctggacaggtgtttcagattctgatagtgtatttaatgatgtctcttcctttaagatcaaaatcctcatcatcaagtgcacatgaatcaaattccttttcaaccggcacaaaagtcgtagacggcattacccatatcttattggtagcagtatccaccattccatcactacgttcctgcatttcttcaggtccccagtgatccatcgtcgcaatgcgctgattcatgcgcaacccactctttttatatccgagctcggtatctcttttctcttgaaaagtgcattactcatatttgagttataagcagttagcgttagatttccaagacgtgagccatgtggcatgtatttcttctgcctctggccccagttcctgaatcatgccggaggcaaatgctgcggcataatatgctcaaagaataagtgccgttatctagcagcgtataaacgtcctttgcctctaaagttccataattttcaaatcgttcaaacagataagctttgtacttgccagcatctgatagactgctttggttgctaaagcctgtgaaaattcatcgtatccgggaagcgaccgcttcttctttgaaagagtgcataaatgaatttatgaacaaatcatttgtagtattgtcgtaccggataacctcacgattaagattcagaaaaatcttatttaatgcattagtcggcacgtcacagagtttctgcggaaaagtaatttgctaattaggaagatctgcgtcatgatctaccgacagcttttcaccgtcttggttcaggcgggagatttccataaaaaatggctccgtgacagtaatttccagccgattaagccgatacatgcagttgtccagttcttggctgttcagaccgctcttacccgtcattagcttctatagatagtgcatatttacgcatatcatctaaaagggaacttaggggaatacattcggtctccacatactttttgaatgattgataaacattgctgatggtcggcgtcacgcctgcttgatactgagatagtcacgaacgaaggcactgacgtcgtttccagtgcattcctcgatcttcgtccagtatttgtcgtagatctcatttgttttttaggatccagcccctcagaatataatttcggatcttgtcgccctctgtaagcgccaacccagtggaatttagactttcaaaaatcagctgtgcctgtcatcaaccacagtgtatgcttataatctgaagttttccgattgcttcatacagagcatctacagatatttcttctttcagaagctgatcacagaaaaagcgatagttgattgtcatatttgaggcaggctcaaattccactggatcacccggcgacaagttctccagagcactcctgtcatttttaccggacgcagttttatgcggtcgtctcccttagcccactttgcaatgataaagcgctccagaatctgatcatcaagagcttcttcgtctgatttcaccctgccggcttttaccagttacagatggcaagtaacagtagcgtgaccgttgtcaaacgtgctggccatctattatgtggaactcaacttgctgccatcggaacgacctgtgaaacaatacttccaaaaaagtggctgcttctgcatctcgtgggactttcttcaagtcctcatacagctggcggcagttatcaattttccagtcgtatttcctttgataaacgggaatgagtatcggttattcgcgccctccatgaatcccaataattgtgcttctgatcccttcatgtcctatttctccaaatttagccaatcagcttaaattaaactgtttcctgcaccactttctgactcacttacaagtgaatcttatgctattgcctgccctaagggatctgatctcactgctgagataaacaaggttcttaaagatttaaaggactcaggcaagcttcagaagataatggatgaatatatcagcgaaaagtaatttaccgctgacaatggaatggagggcgtcaaatgtctttgtcagagcatttatttcaggatttcattgctgaaaagagatacatgtatctcgtcgatggtctgaaaaacactgtgatcattactgctggagcgctgatccttggaattattctcggtgttatcgctgcgatcatcagagtgcagcatcagaataaaaagaacagttcggaaaaaacaggaccggttctttttatattaaatgtgatagtgaatttttatctgactgtgatcagaggtacacctactatcgtgcagcttatgatacttacttttgctatctggaaatccgggcagccgatacaggttgctatcgtggcattcggtatcaactcaggtgcttatgtagcggagattatccgttcaggtatacagtcagtagacatcggacagacagaggccggcaggtctttaggacttagtgagagaatgactcttcagaagatcgttctgccgcaggcattcaaaaatgtggctcctgcaatatttaacgagtttatctcattagtcaaggagacctctgttgccggttacgttggaattcaggatctgaccaagggtggcgatataatcagatcacagacatatgacgccttcccgccactgcttgcggtggcgctcatttacttagtcatcgtcattggtctgactcaggtactcaatattctcgaaaggaggatggctcgaagtgatatccgttaaaaatctccataaatcttttcatacgctaaaaggcagagccgatattttaaaaggtatcgatgtagatataagtgatggggagaaggttgttatcatcgggccttccggatccggcaaatccacttttctccgctgtctgaatttacttgaaaagccgactgaaggacagataattttcgacggggaagacattacatcttcgaatgtgaatatcgataaggtccgttcgaagatgggcatggtttttcagcactttaatctgttcccgaatatgacagtacgtgaaaacataacgcttgcacctgtccttctaaaactaaagtcccaggatgaggcaaatgaagaggccatggcacttcttgaccgcgttggtcttaaagaaaaggcagacgcgtacccctcttccctctccggtggccaggctcagcgtattgcaattgtccgctcccttgcgatgcatccttcaatgatgctttttgacgagcctacttctgccttagatccagagatggtcggtgaagttttatcagtaatgagagaactcgcagatgagggcatgacgatggctgttgtaactcacgagatgagatttgcgagggatgtcgcctcacgtgtattattcttagaccagggaaggatcgtcgaagaaaatacgcctgatgaacttttcgacaacccgcagaatgaacgtacaaaactatttctttcaaaagtcctttaaaaaaagatgttgtgccaataactgacacaacaccttttttttaaagatttgagtatgacctctctgactcttcagttaaaaatttctttaattcgggcattgacttaagctccgggtcttcggacaatagtttttccacacactcagatgcctttgcaagcagcgcagaatcattgtagatatctgcaatcttaaaagctatgtctccggactgccttactccgaaggcatccccagggccgcgcatcttcaagtcggcgtttgcaatataaaagccgtcgtttgacgcctttaagacttcaagccgctttgaaggggtcttcgagccgctggtgtctacaaacatacagtaagcctgggcatcgccgcggcctaccctgccgcgcagctgatgcagctgggcgagaccgaatttctgggcatcttctatcatgataacagtcgcattcggtacgtcgacgccaacttctatgactgtggtagataccaggatatcggtctttccggaggcaaaatcagacattaccgcatccttcttttcagatgacatcggaccataaagcttgccgatcgtgatatctgaaggcagggtattttttaatttctcatagtactcttctacgttttctccttcggcattttcagatggctcgacaagaggacagattataatcccctggtggccggcgcggacttctcttacaaacagcgcgtaggcattttttcgaagcgatgggtcgatcacggcgtttttcagcggctttctgacagaaggcttctctgtgatcgtagaaatattcatgccctgatacaggataagggaaagtgttcttggaataggtgtcgcgctcattacgactgaaaagacactcctgcccttttctataagggcgtttcgctgttttacaccgaaacggtgctgttcatctgttattacaagggcaaggtttttaaactgcaccttctcctgaaaaagcgcatgtgtcccgaccacaaaagacggtacgccggatgctgtctgctctaatgcttcccttctggccttccccttcacatggccggtcagcagcacagttggtatttcaagtcccaatcttttagtaagtgacagaagcttctgatagtgctggtttgcgaggacttcagtaggagccattattgccgaagtgtagccgttataagccatcacggccatagaacagaaggcgactatggtctttccgctcccgacgtctccctgtatcagacgctgagttatatattttccgttgaaatcgcgcagaaggtcgtttaatgcgccatcctgcccctttgtcagcttgtatggaagggatgcctttattttctcacagatcgaggtgtcgaactttccaagcgtattcggaactttctcctcttccaaggcactcagtctgtgtgagagcagaaacatgaaaaattcatcgaaggctatcctctctcttgccttcgagagcatctttgaattttcaggaaaatgaatattgttaaatgcagagggaaggccaagcagctgatatttttctaagatatcatctgagagatattcagtgatatttacttcggacagaacctggcggactgctttttctatcagcttatcggtaagtccgaaaactttcggatagacagggagctttacaccgaccttcttctggtaatcggctattgtaaaatactggggctggacgagttcaggagtcctgcctttgtaagatactctgccatagaaaacatagcggatacccggctttaatgatctcttcagatagcgctggttgaaccagacaagatttacagaaagacccattacactcagcgcagctgtcgttatggtctttccgtaagcgcagcgctcgtagatattttttacaggggcgcagatggcagcgctttctccctcttcggcggtaaggactgccgagacttccgggtacgtcttgtaggtggacggatagtatgtcaggagatcgtagacataaaaaatgcccgccctcctgaagggggcggcagttttaggtcctattccttttatggttgtgatatcgtcgttcagattcattattcgacgcttacgatgtaataatatacgttctgaccaccgttctggacatcgacctcgatggacggatatgtctggtttatcatgtctgtaatctcgtgagtctcggcttctctggcatctgcaccggtatagatcgtaataagtgcagaatcgtcgtcgaccatgtcattaagcatttctttaaaagtctctacgatagactcatttacagccttgattccgagatctgtgattcccatgtagtcaccggcttttatcgccttgccatctacagaggtatcccttacagcgtaggtgacttcgccgctcttgactttggagagctcttcggtcatccgcttctggttctcctctacggactggtcagggatgaagttcacaagtgctgtgatgccctgtgggatggtcttcgccggaatgacgatgcccttcttgtcctcaagaatgtctgctgcctggcttgcggcgagaactatgttcttattattcgggaggatgaagacgttcttcgcatttaccttctcagcggcctctaaaatatcgttcgtagaaggattcatggtctggccgcccttgatgactacgtcagcgccaagtcctgtaaagatctcgtcaagtccttcaccagaggagacggcgacgaaaccgatctcctttaacggagtttcctcctctgctggctctttcgccggcttatcagaattctcagctgtggcagctggctcagctgtttctgctgcaggagcctttccgtcgagctttatattcgtgatatggatgtcgtaggcgtcaccaagcttcaaggagtgatttaatgccttgcccggtacgttcgtaagaagagagatctgcatggtacgggaatcggctgagagctttacatcgtcaccaatgccagagaggtactcagtaaggtcagcatctactcctgtagcaaaattctccggggctttcagtgagaacgaaacgcggtaagtgaatttgactttctcctcttcttcgatctcttcctcgtcaggcttctcctcttcgatagtgatatcgatatccttgccgcagaggtagtcgtaggcaccctttaagacttcgagaagccctgaaccacctgaatctactactccagcctcttttaaaacaggaaggagctcaggtgtggattcaagagctgctgtagctgcttctacaacctttcctccgatctctatgaggtcatctgtctcgacagcagcgtcggcacaggcatcacttgcagccttcgcaactgtgagaatagtgccttccttcggcttcataactgctctgtatgcggtctctgtggccttctgcaatccttcggtcagagactctgcgtcgataacgtcaacatttctcatgaccttagtaaagcctctgataagctgggaaaggatgacacctgagttacctctggcacctctcagggagccggatgacatggccttggagagactcttcatgtcaggctttattaaatcgcttacagccttggctgcagacatgatagtcgctgtcatgttcgttccggtatcaccatccggtaccgggaatacgttaagttcgtttatatggtccttctgattttcaagatagcgggcgcctgccagaaacattttggagataagggccgcatctatagaattaactgccaatgtgtcctccttagtcaatgacgcgtacgccttcgacgtaaacatttatactgtcaactgtcaaacctgtgaactcttcgaccttgtacttcacagtctccctgagattcgatgctactgcggaaatagaaacgccgtagcttacgatacagtgaaagtcaagtgaaatgctgctgtcatcattgtagtgtacctgaatgccgtggccgagatactccttcttcagaagcttgacaagaccatccttcatattcactgctgccatgcctacgataccgaagcactcaacggctacggatcctgcgtatgtggcaatgacatcggtgtcgataatgaccttcccgagatcattctccatctgaccctgtgtctgcataaaatcctccatttattaataaaaaaaatacatggtttcttagcaatttgtcttaattatacctaaaaataaaataaaatacaacagaaaaaaagcttgcattttatataatgttttggtaaaatacaatagttgtgtcgtgaaaaggcatttgttcagattattctattagagataggaggtgctttggtatggcaaagtgtgctatttgcggaaaaggcgctcactatggtaacaaggtgagccattctcatagaagagctaacaggatttggaaatcaaacgttaagtcagttaaatgtatcgttaacggtactcctaagagattatacgtctgcacttcctgtcttcgttcaggcgctgttgagagagcataattaaagcataaagagctgtcttcggacagctctttctctttacacgtgataaatgagcggtgttttacagcaccgctcatttttagttgttggcatcttcggcagacttcttaactctctcttccacttcttccttcgcagcttccctggcttccttgtcctcagctttatcctcagacttctttcccttgaagaggtcgataaaatccgggataagatctaatagcttttccattccacttctggtgccgatatccatcattcgaacagaaccgttctttatcacaagaactgactgaggcttagccttgacaccgattccgccggcgctgtttgaattcttctcgccgttgaatgatccgcttatcataccgatagaaatatttacgagcgggatgatcgtcgtatcaccgacctgtacaggatctcctacgacagactttgacgaaaaattggaactcatcccatcgaggagagattttactgtgttttcaaaagtgtctctggtcatttttccttctcctttaaaaaatctggcagcctttacttcgcaaaaacaatcttaagaacgtaaataatcacgaggaggacatttacatgccctctggcgccgatatgtccccttaaaaaggcgtcgtcactcatcagatcacaatctaacttcgtacttttgccatacataaacggaagcgccgaaagcactccgtagatcatagcggtcgtatcgggctctcctgtagaaaagctcacatcgcagtcgtctatgtggatgcggcagtgcttaagcagagctcctgcgtttgtgattatggccttaattctttttttgatgaagtccaggagctttttctttctgtcccgtggcttttctttcgctttcttctgctttttcttctcagacttctcttccttctcctcttttttgcccccaatctttataaaataaaagatacggagggaaaatccgggatcggatgaggtgtcaaatcttagatttatcaaccgaagcggatcgtggagaaaggccttgaaatactcgtcgtcaaaacttcctctgaccccgaacgctatcggcacaaatataagatacactaagaaagctgcgattacaagcagaatcgtaagtatgatcttaaataccattttttaccttaaatatgtgtcaaacagactctttgccagtggagcggcgtgtgaagaacctgctccgcccttctccattataacagcaacagctatttttttcctgcctttttgtgcaaatccgataaaccaggagtgagcctcacgcttgttcgaagagaactcggccgttccggtctttccgtatgccgtgtaggaagatgtattcacaacgcgcccggtgccgttcgttaccacatagcgcatcagatttttaagtgtggaggcatcttttgcactgcagagcttctgggactgggtgtcaaactttcgaacaagtcttccgctgtcattttcaatgtgatctacaacaaaaggagctttcaaagtcccgttatttgctatagcctcacagatagaagccatctgaagcggggttacaagggtatttccctgaccgatagaggtctgcatcacaagagccttcgggtcagaatttttcaatgtgaaccggctcttatttatatttgaaatcttggacggtatcgatttatttatcaaaaactgctcggcagtacgcttcagggctcctttcggaagcgaaagcccgatctgagaaaaagccacgttgcaggagttcgcaaatgcctggcttaatgtctggtgcccgtgaacttctccgtcgaaacagtggatcgtgtacccgtcctgggtgtatgatccgcggcagtcgaaagtgtcagtgagctttccgccattttttaaataagatagcactgtaataactttaaaagtagatccgggcgggtaaagtccctgagtcgcacggtttataaggacagaatcctgacttgtggtcaggctcttccagttcgctgtgacagatcccggttcaaaatcaggctttgataccattgagaggatgccgcctgtattgcagtctatcgcaacgacagcgccgtggtattggcccattccgtagtatgccctgctctgaagcttcgaatcgatcgtagtcactacattgtctccgggatttttctcacccttgaggtcatttactacccggttcaaaagaaatgagtgggtacgaagcatatagaagcttgcgtcggattcgattccgctcatgccgtttgtattgtatcccacgacatgggcatattcccggcccttcgggtactgtctgacttcctttccgttgcttgttacagtctgtgccaggatcgtcccgtcggcggcttttatctctcctcttgttacgagcttttcaaagccttttactctcgggtttgcgggattatttatgaagtcctcgctcttaaacaccataaaatatacgaaataggcggtcagcgccagaaaaagtgccagaaaaacgtatgcaatgaccgaagtctcgacatttaaggtatggcgcttatttttgttatcacctgcgccagcttccatcctgcccgctgcgttcgttttccatctgccgtctgtatgtgtcctcgtagttttgtgtctcatctgtctcttctttgactcctctgtactgataaagtccttcaaccatcgcaaacaaaagcatcgtagccatcagggagcttccgccgtaactgataagcggcagtgttacacctgtcgatgggatgaactttgtgactccgcctaaggtcgtaaacacctgcgaagcgtagagcgaaccgagcccaagggctatcagtttgtagaatctgttgttgatctttaaggctatattaaacatcataaggaaatttgctatgcatataaatataaggcacagagcaaagagtccgccgagctcctctgagatcgccgagaaaataaagtcggtatcaactaccggtatcctcttaggcattccctggtagaggcctgttccaaaccatccgccggagcctatagcaaaaagcgactggcagatctggtagcctgctgaatttaccacagaaagcggatccttccaggctgtgactcttgtccttacatggctgaatgcaaaatatcctaaaactgccgctgctgcgaaaagaagaacgccatagagcaggtacgaaggcttctgcgttgcagcgtatatcataacaaggagcgtaaggaaaaatatcatcgcgtttcccaggtccttagagtaggccaggattaagatcataaggcagcagagaactactgtcttaaatacctgctttctagagatatcgttcgtcagcatgcatgctataaaaaggaccatcagtatctttacgaattcggatggctggatagcaatgcttccgatctggatatttatctttgcaccgtaagtggtagctccgacagctgcaacgaccgctaacagcaggatgcctgcaactatgtaaaagagctttaagctttttatcagctttacatttccaagaaaaagcggtacaaagcaggttattataagggcgatgcaggcaaacagaagctgccgaagtgccttagcctggttcagccttgtaagcatgataaatccaatcgataaaagcatgcacatgttgtttacgactgccggggaagccatctcgtagatcttcttgtagattatcatggcgatcgttacaaagacaatctccgccaggcccatcgcaaatatcttcgtatcactgttgttaaaaaacagcagcagattcccgtttatcaggaaaagatagatcatcgatgtctgctgagagtaaagccttttttctcttttctcagatgtatggcgctttaatgcggcaaaacagtcgtatgtatagaccgcaaaaatgacgataaatgtcagtctggatatttctgtaactaaatgcagcactactctgctcctctgtgaaaatgccctctcgtgacgtcatatgagacgtctgctctggcactttcgtaaatattttttataaaaatgtttaaaacttctttaacctgtttcgcgttttctgtcgtaaaatcgaaccgcactcctgcaaatcccatggataaaatgtcatgcacataaggcagaagggaagtcggtacgctgttgtacactacgttcgtacagaaactgcagtagtttattacaggaaacccggcttttctctcgtctttaaggaaaagcaaagtctgtcttctgtcgcagccgtcggcatttttgtgctggcaggcagatgtgtacatgactggagtcctgccgtaaatgcttaatatagatgagctgttgtctaagtgctttagctccttctggttcagctctataggagctgagataaactctggcccgtctgacataatagatttcctgcttctgtcggaccaggagtatatccttgtatcggtgataaaaggcataccggaaaggcgctcttttacgtactctatctcgtcgtaagtctgtacgatcactccatcaaagatgcgccttacttcgtcgtcatcgattgaaaaatccctatcgaatctcaaaatatccggcaggcagagccaaaagccttttcctttgaaatatctggctggaaggcgtctgtagagctcatagtttatagcaattataacagaaaaatctccggcgtcaaaatcaccaacggcttcaagctgctccttactgatacaggtaataaggatctgatccgattccctatttttatgatatctgtcttcaagtggcttaaacgggaggcattcgccacgttttacatttacaccgcctaaaaattcaaagacagcctttcttctcaggtcttttacgacacctaccggaatgaaggcatctttatctatatcgaggattacattacctatgtcgatcctgccatctccggtacggcttattttttctgtaagttcttcggctatgtcttttggctttctggcccgttctgtgacaggaccagccacggttactttactttcatcgttttctatggtgagtctgatcggcttaccgattctggcggtgagaactccgatgacctctctggtcttttctttcgggagcgtatcaggcacctgggatgatctgaaagatgaatccgtaatgcttaccatatcggagtcgttgtgagaatagaggtatttatcggtacttcctccgcgggttcctgcagcaataagcttagtcttaacggctgagagttcctttttttctggaaggcagcctgactccgcgtaatctgcggcccatctgtacatagatgaagccattgcgacatactcaggtgacttcatacggccctcgatctttaaagacatggctcctgcatcgtagagcgcctttacatcttcgatcgtacagaggtctttaagacttagagggtaatctccattgaggctgttttcggctccttcgagttcatagcatttcctgcacggctgagcgcatctgccgcggtttccacttcggccaccgatcatcgaactcataaggcactggcctgagtaagacatgcacagagctccgtgcgcgaaacactcgagctcgatatcacagttatcgtggatattttttatctcagaaagagacagctcccttgcgagaactattcttttggcaccgaggttcttgaagaaacgggcgccgtagatggatgtgacgctcgcctgtgtagagatatgaagccgcagctctgggaaataagccctgataagctgcatcagcccgatatcctggactaaaacgccgtctattccggcattgtagtagtctttcagataatcatagaccttatcttcgatctctttggttttcagtagggtgtttacagtaagataagtgcgtttgccgcgggcatgggcgaaactgatccccgcttcggcatctgcaagtgaaaaattgtgagcataggctctcgccccgaacatctctccgccaaaatatactgcatcggctcctgccacaagggcggccttcaaggtctttaagtcccctgccggtgcgagtacttctaactttctcttttcgttcatacgcttatttcttagtgcttttcctggaagaatcgccctcctcctcgacaggccctaaaagggcgtctgcgagtgaggcctcgagcttttccttcatagtgcgaagctctgcattttccttctttaaagcctcttcgcgctctgaaatgtcgttttttgcagcctgattcgtgataagctcgtgctttaaattgtagagctcgctgtccttctgcttgatctgcttctcgaggtctgagaccttgtccttcattgaaaaatagtcgtcggcgatattcagctccaggagaatggacttcatgtccgcattcatcttccggtagctgtcgagcttcgtgaaatcatcgatcttgccattgatataagccgctacccgctgaagatagtcttcctcctcataaccgctgagcgttaagactcttcctcctataacgactgttgtactcttttttgcagacatccggtgtctccttttataaaaaactgctccccttattataaatatcttcaggtcaatttacaagatgtgaaaaaatcagagctctcccttcagatgatcgagagccttccgggtgagctctctgcccttgggcgtccttataataagacctgtctggacaagatacggctctgtgacatcctctatcgttcccttgtcttcgccaacgtaggcggatagcgtatcgagccctaccgggcctccgtcgaaagcatctctgatagaggtcaggatctttctgtcggacttgtcgagccccatagagtctacatctaaaaggtcaaggctcctgcgtgcgacttcctcattgatctttccgtcaaagcgcacctgcgcgatatccctgacacggcgcagcagcctgttcgcaagcctcggagtgcctctcgacctctttgccatctcgtaggcgccactctcatcgatatccacgtcgagctttctcgcggaagctaaaattatagcttgaagctcctcgggcgtatagtactccatatgaaaaatgacaccgaatctgtcgcgcagcggtgcggaaagaagtccggcccgggttgttgctcccacaagtgtaaaatgaggcacagcgatacgggtggacttggccgttggcccctttcctatcattatatctatagcgaaatcttccatcgcaggatagaggacctcttcaacctgcctgtttaacctgtggatctcgtcgataaagaggatatcgttttccttaagccccatgattatggccgccatgtctcccggagtcgcgatcgcagggcctgatgtaatctttactcgaacattcatctcatttgcgatgatgccggagagcgtagtctttccaagtcccggagggccgtaaaaaagcacatggtctaagggctcccccctgtcttttgcagccttgatatagatggcaagactcttcttgatcttcgactgtccgatgtattcagacaggtatttaggtctaagggaattctcaggctttatatcctcttcctgtttttcagttgtgataactcttctctccatcaattgctccctaataccctaagagtctggcttaaaagatcttcgaggctcaaatcgtcagctccgtcgatctttttcatggcgcttaacacatcgcttccggaaaagcccattccggtaagcgccacgagtgcgtcatttttaacagatgagacagaagaggccactcctccctcatcagtatccttttcacttgagaggtcagatgcatcgatcttatcctttagttcgaggattatcctctctgccatctttgttcctactcccggagcgcgtgcgatcgactttttgtcaccggcaataatagaaagcctcagctcgtctggagtaagtactgaaagcactcccatagcagccttcgggccgaccttagataccccggtaagcatcttgaaaaaatccctctcttcgctgtcgagaaagccgtagagcgagaacccggtattttcattaaagccaagaagcgtatatacgcgtatcctgctgtggtctattggaagcctcgagatcgagtttccagacatctgcatctcaaagcccattccgtcatgatctacaacgacagtcccgtcggacacgctctctatatagccgtctataaatgaaatcatcttatctcctgtcttaagatttcaataaatgtccgccctgtaaagacagcataaaattacctgacaggtgtcccgtaatagtaaaatccgctgcactcgtcgagatggacatcaagtatctgcccaataagcgacttatcgcccttaaggtgtacgacactgttgttcgtgaggcggccagtcacaagggacggatcctgcctgtttacctcttcgacaaggactggaagtgtctttccggtaagcgcctttgccttctcctctccaatacttcttacagtcgtaagcagcctgtcgaagcgggcttttaccacgtcctcaggcacctggtcatctcttctggcggctggagttccagacctctttgagtagataaaagtaaatgccgagtcgtatctgacgcggtttactacatccatggtctcttcaaaatcctcgtcagtctcgcccggatagcctacgataatgtctgtagtaagcgcgatgtcagggatcttattccgtatcttatccactatcgaaaggtacttctcctttgtgtagtggcggttcatatccgcaagcagtctgtcgcttcccgactgaagaggcaggtgcaggtgattgcagaccttatcacactcagccatcgcatcgataaggtcgtcagataagtccttagggtgagaggtcataaagcggatcctctcgagtccgtctatctcgtttaccattcgaagcagatctgcaaaacttacaggatgatcgagcgtctttccgtaagaattgacattctggcccaagagcatgacttcctttacaccgtctgcaacgagcttttttatctcacagacgatagcttcaggctctctgcttctctcccgtcctctgacatatggaacgatgcagtaggaacagaaattgttgcagccgaacatgatattgatgccggacttgaatgagtattttctctcgagtggaagattttcaactatgccgtcggccttttcccttacatctatgatctttctgtgctcggaaagcctctcatagaggatctcggcgagcatgtacacgttgtgcgtcccgaaaatgatatctacgaaagggtaactctttcttaacttctctacgacctgagactcctgtgccatgcagccgcagaggccgatcatcatctctttatttttcttcttgtagccgtgcaggacgccgagccttccaaatactttgttgtcggcattttccctgactgtgcaggtattgtacaaaacgaggtcagcgtcctcagactctgactcggtgtagccgcatttaagcaggataccgcgcagcttttctgagtctctggcattcatctggcacccgaatgtcgttacatgaaaagtcaggggccttcccagctcctgaactctcttttctgttaattttttcactttatccatgaaaaaatactggcggtccggctcagttaccggaatgtctgtgtccgccgccgaaagactccccttgtattcgtatttattattctctgatctgtccatttccataaatgatatacttgcttgaaagcagagcctcaagtcccatagggcctctcgcatgaagcttctgcgtgcttattcctatctcggctccaaagccgaattcatttccatctgtaaacctggtagaggcgttcacatagacacaggctgcgtcgatttcatctaaaaacttctgagcgttcgtatagctctcggtgataatagcctctgaatgtccggtgttatagtgattgatgtggcttatcgcctcatctatatcatgaactgtctttactgacatcttatagtcgagatactctctgccgaaatcctcgtcagtcgcctctgctgagtctgtcaggtatttcctcgcggcaggatctgcgaaaagttctacccttcctttaaagagctctgcaagccttggtaaaaataccggtgccaccttctcatgtactacgagtgactctgctgcattgcagacgccgattctctgcgtcttggcgttgtcagtaatacgaagcgccatgtcgatatcagcatactcgtccacatagatgtggcagttccctgtacctgtctctatgacaggaatcgtagaattctctactacacttctgataagtcctgcgccacctctcggtatcaaaaggtctacgtacttatccatcttcatgaagcggtttacgctctcatgcgtcgtatcctctatatagaggacgcagtcctcagggagtccctgcgactttaaagatgcgtgaagtgaatcgatcatcgcgatattcgtattcgcagctgccgagcctccgcggaggattactgtatttccggtcttaaagcagagggaaaaaacatcggctgtgacattcggtctcgcctcgtagatgactcctatgacaccaatcggcacgctcttctttccgattcgaagtccgttcggacgggtccacatccggcttacctctccaacaggatccgggagagctgcaacctgtctcatgccgtctgcaactccttcaattctttcggctgtaagcttaagtctgtctagtagtccctgcgaaagcccgcgctccttaccgtttttcatatcaatctcgtttgctgcgagaatctgagtggtgtttttaacgaggtcatctgctgcacggttaataagctcgtccttctgagtcgtagaaagcttcgctgtgatgtatttattctcgtatgctctctggcatatctcttctatagtcatgctttttcctcaaaaaataaacgtaccatctgtcgtttatcactttttactgtgctcaggcagatacaaatcacaatattagatattagtctaacacaaatcgaacagattttcaatcgctggattttcctttttcaagctccctctcctgctttctgcggagcttttcctctgctatcgcagtctgcctttcgagaatctcctcttcctgtttctttaagtcttcatccgaaagagtcgtgaccataagggaggctgcgaggtttgcagccggattcctgtcctttttagacagtgacttcgtcttttcatagatatagccgaaggctgaaaagactgtcgcaccaatgcagtttacaagcagatccttcatagtatcgttgattccgatgtctaagtagccgccgtttatcgtatattttttcccggttgaggtaaaaataaccgtcttttttatgtgatcaattatgaccggtgtctgtgtatgcgtcgtatcgagggttacggtgccgattttctgcacgatgaaatccttctgcatatcgaggaaaaaaaggctgtccatcgtgtactcgaaaaattcccagatgactccgactgtcatcgaaaaacaaaagccgacgactgccatatagaacggtgagaggttgatattcttactctttctgttcaggatgtccaccagcgaaaatcctatcgcggcacagaggaagccgtttaaggtgtgaagcatcgtatcccaccccggaatcctcgtgtagtatttattcacctctcctaaaatctctgccgcgtagatgaagccgtagatgaagcactcgaaaaccggcggcaggtcaattttcattttttcctcgagaagcgaaggaactaagaaaagtaaaagcgagaggatacagagcgcgagcccctcgaaattcgcctcaaagaagcaccgcacagcggtcagaatcacaaggcctcttagtatcgtgtagagaataaacgcctttttattcagagctattctctctttcagatgtattatcattctgcgaatcttcattgggttcctcactgtttttcttgaaataatcttagtgatcagatgaatcaaaggttttttcatttgttgcatattcctgaatggaattgtgtccttcatcattctgtcatggattaaagcatatccagacaaaaaatgacggaccagaatctattttaccattccagtccgttttttcctagtattctttaaaattgatttcaaaagcactaattaaaataaatctgaatgagttcctgtacgtgacaaaaaaagaataagctcatcttcatctacacggtatacaagaagccagtctggttgtatatgacattcacgaaaacctatgaaatcacctgtaagattgtgatcacggtttttctccggaagctttttcattcttgctaattgttcaacaacatcgttgagaagattaagattatatccacgctttgatatctgcttcagatcttttttaaaatggtttgaaaggacgatgtcaagcatatttattcccctagtacatcattgattgcatctttgaaggatgaataatgcttatacttctcagggtgtgctttcatctcataatattcatttaacgcggcaactgtctctgcgttatggttttccctactgactgtaaaaggaataccttgcacacgcaaagactgcttcaggaaaatcgtaactgccgtagaaagatccattcccaggtcagaataaagttcctgactggctttttttaaatcagcatctagactaatatttgtacttacttttgacataattatcatctcctatgcaagaattatagcatgaatagtgcaaaacatcaacatgatatgcgcattaaatgcatgtcaatgcttttatagttactgttctttttccatgacattgagtttaaaaaaaccaggtgccaggcacctggggtcagccatattcattgcctcattttctttaaatgaattcaattggaagagctactaaattttctctaaggtatgttttttggctgaccatgcataaaattacgcccatgcctcttttctttccaggtatcttatccaatatggaattagcagaacccatggatgccttaggattacctgtcattttaatttcaacaggatataaaacaccattttcttcaataatcaaatctatctcattttcaccagctgtacttttatcttttcctctatagtaaaaaatctgaaattgataatccctgccttcattggaataggatttcaaaatttccgaaacaacaaaggtttcaaacatactgcctgcgacagctgaattcttcagtgcatccgctgtaagccatttcgtaagatagcaggcaagcccggtatcacgaaaataaatctttggggtttttatggctcgattcaaagtgcttgcactatatggctgaagaatatatataattcctgttctttccaatatagaaatccagcttttgactgttggctcacttacgccgatttctgatgctatattattataattaagcatttcacctgtccttgctgcaaccgcagtcagaaatttcgtaaatgtaatgctgtctgctgaaatcagtccattgatatctctctcgagataggtggcgacataggaagaataaaaatccaaccagtcacgatcaacatcatataattcagggtaagatcccttatgaatgatttcccagatatcttcataatgccttaattccttttcacgctcacagatatattgctctgtaggaacaaaatgtccgttaaaaggaacctgatatatctccctgagcgacaaaccacccaactcacatattgaaactctgccagccagagactcgcttacacctttcatgagttccagctttgcagaaccagtcagtataaactgtcccctattctgcgaattgtctactatctgcttgatttcctctaaaactgaaggctctttctgcacttcatcaatgataaggggacaaggattgttaaggaagaaaagcttcggctcctccttcgcctggagcctggtaagctgatcatcaaaagtggttctgtgatattcagaaaaatcatgttgaatcagagtggattttccaacctgtcttgcaccaactactaaagtacatttactgtttcttaccctgtttttcaggaccttagaaattgctctttctatataagccatatcaatcctccgactaattcaaagtgtgattttattatagtcggtttatgagtattttgcaaataagttacagaatacgttactttttacttgtttgctgtcagttccatgtacatcttcatcagctctgcgacacagtcggattctgacatctttgtagaaaatccgtaagctgccattactgcgcggtcatttgctgtgtgggccttccgcagttcaggcggcatggttagtggattatacagatttgcaagagaagtcagtggatataaatttcttgcatcaagaatagactttgcagtagtttcaatctgcgccttctgttcatccgaaggagatggccacggaaagtcattataaacaatatccttcgaatatctataatcactttttaatctgcctgcaacctgtctcaaccatgcattatgaacatttgacattaaaactccaaattcatattttgtcgcatttggaattaaaaaaacagaatcacttgcaataacatccgctgacataaaacccaatggcaaatatctacgttttccagaagatgtttttggaacaataatatagtccgaatctggttgagcaatttgacaaaatagcgtaggtgtagctgcagattttctagttcccgcagctttacttgatgcacgaaagtccctgactgcttcaattctttttaatacagtaggacattttgcgagctcatctggattagcacctacaagccaaaggcaataccttttcctataatgtcaagccccaaattacgatttttagggttccttgacaggttaccaaaaaataagagtcaacggtgatggatatcgttgcatcaagtgctgaatagtcgatttttgggtatggttcgcaaaacgtcccacatgtcctttgttatcaaggccattttctcagatcaactatggcagtgaaccttccgtggctatggggatctgtgtcccaacctccttcgtccaccatatcatacaccgagtgccagccaagctttcttacgagttcatgcctcacggagtgaattctgctggctacggctcctatgttcttgaatctctatgctaggacatcctgtgacagtcctgatttactcagtggacgctcaaactgccacacctgatccaatgtaggtgctgatgataccgaagcatcatcgtttaaggttccttgttccagaacctggcccagcatccgtgttaccagatgttcggcaaggctctggaaatgttatacaatgtatttttcggtttgagttatgctgcctttgttctggaagtctggataatgtatatcactgagcattctcatcgaatcatacttacgtcctgtcagcaggagcgtatatacgaccctgagcagcttgcggagatcacgatcaacgacgcatcttctttaacgggttcccgctcgtgtcgtgtagtgctcgtgaaggctcttaaacgcctctgaatgaactactacagattttgctccttggaacagccatgttctcagtttcttgcgtcctctgtgactgatctttgtctgtcccttatgtttctgagctgcattctacaagcccgagcccgctgatcttctggatctccttcacatcatcgaacctggagatgtctcccatttctgcaatgatgccgacagaatgttctccccaggccttcgatttcaagaacattttcaacgttcgggactcatggcacttctgtgaagctcgtcctcaatcttgctgagttccttctgtatttctgttatctgctgtgtgaaccatctcacgcctccttgcagccttgtttccgtccttaagaccgacgctgttttcggcatagctgacaatccgtcagcgtttctgtatcctgcgccacggagcttcgccttatgccacagttcttttattccctcagttccagcctgattatatccgcaggaaaggcgcgttcatcagaacttcaagggtaaatgctccgtccatttttccgaatgcatccttatactcgggaaaataaaccttggctgcttatgaagttgtttactgcctgtatcctgccttccataagctgatcgcggagagaagaaagacctcttatctctgcgtaagccttcaggtatatatgggattccgaaattcccgtctttcaccaggttcgctataggcttcggatccttgcggtcgtccttccgctggctgttgtcctcaatctcctttgtctgcttcactgcatagggatttactggacaacgtgataccatgagatatcatccaacacgctatacagaaccagtaatgacctgttggctcaagtcccatcacaatctggtctttattatttatggcagccagttcgagcatccatctcctggcactctcaaagccttccttgctgttactgaaagaaaacggttctttgctcagctcgcgtcctctggtatctatagctctcacataatgagtttcactacctatatcgcatccaactataagcatgttgtcacttatgaatgagagcttgtcattcttatcgaactgccctgagtccagttccttccacgtggaagcttgagattttccttgatgacagtaattctttttcgatttccattgaaaacacattttttgctgtgctgtgataagtgcttgattttctattcttttctgtttacaattcatcgtagatacctcttgttcttttgaattttactaacgtccaggtcagtaatgattcaaatctacttgaggtatttttatatgtcaaccccctgacatttatattatacaggaggctgtacctcccgtgaaaatgtttgataacttgaaaaactgagaaaaggttttctgagtttttaaagttattctaacaaagagatccggaacaaggaaggtgacgggttatttaccatttacctttgagccactctgcatggtacctttcttatcaaaataatagtatttcccgctgattttctttaatccggcaacctttttccctttttgataatatgaccatttgccgctttttttcacgaaaccattctgaggtgtttttttctttgtagtcttctttttggtagtctttttctttgtagattttttcttggcagtcttcttagtagtcttctttttgacagtctttttctttacagtcttcttctgggtggttttcttcttggaagctgttttcttttgacttgttctgttagctgctacaccagttacaacaggaacaggtttgctgtcttttttgtctgcattatcattcgcgtcagctttgctgtcttcattcgctgttccaccgtttgcgtcaggatttatgacattattgtctgtgccgccgtttgcatcaggatttgtgacattattgtctgtgccgccgtttgcatcaggacttgtgacattattgtctgtgccgccgtttacatctggtttactctcctcatttgcaacgaaaatgtttactattgcattcttatatatgtactgccaatccttgccgctgactttaccgtagcagctgcttcccctattttttttctgcttgggatttccaataattttttgaagagcagaccacggagtaccacttttcgttgctttctgcagtgctttgtaagctttattcgtcataaaaccagatttattgaaattatagagcttaccactgatgtaatagagacctttaagcttctttttattcttatcgaaataatagtattttccaccactgtggaccagtacatttttagatgttacatttctatgtgtaatccagctgtctccagagatctgcccattgctgctggaaaaactccatgtctgcatttctttatgagtgagcggataataactggtggcaaagaggttgatcttagttccagcccatttcagctcaggatcgtagtagaggccgtttatcctgacgatagcatgacgagtgaaaccgtcgctctgatgatcccttcttcccctgacacgtgttgttataacttcaggcttatatccgagagcatcggccaatgctgcaaatgtgcatgcgaagccatagcagtttccctttctcgtgctaagcatctgattcgcatattttttgatccaggatttgtcattcaaattcgggtataccagatcatatccgaaattatttttcgaactcaggtaattatatgctgcaagcagacgatcgctctttgaagcagtgcgtgatgatgatttgtcaagcatgttgatcgctttgtatttcactgaagcgtcgagcgtcattaccgcgcgtccattgtcagcaagcattatcttgtctattgtcttatcatgctgcatggaaccattctttttgctgaaatagtagagatgtcctccatatgtctgccagcctctgagagatgtcccggacttactgatcagatatttcctgcccttgcgggtaaccatcctcattacagcaccggtcttcctggattgtgctgccgctgccggaagcgccggtggtattacaaatgtgaaagaaagtaaagctgccagtaatgcagctgaaatttttccaactaaggactttcgtttttcttcatcccgaaaataattcatgttcattttcacttttccttttctccagagtatccttacactgattaattccagatgattataacacatttatcgtttttttctatatttttgcatcataaatttgactataccgatttcagttgtgttgtagttgacataaaaaatgcctcacttttcagtgagacagcaaaacacctgccagaatggcaggtgcgtttaatacttatactactttacagtgaaaacgtgtcttagtacttcgcggatcagatccgggagaatatgcatggtaacgggcagattgacacgctctgtccacttatgagcatcttttccataggtgccgagatttacagccgggatgttaagcttctttatcttatctactggaatcggatataatttattcatggccgggaaattgtcccttaacgctgctactgagctgtcgtcatcatcgatcctaagatagctgctgtctgagagagaaggataatatgggtgtatcttgtagctgacactgtattttttcccgacctctgaagcggattcccgtatgatatccataagtttcccgtctttttcagtaaaggtattgtgcggacagtaaggcgcggcatagtacaaaacaacggctggctccgtaataccggctgtctcgatcaggtatcttatcatagcaactggtatctcccttaagtcagttccattcgagagctcattttcacatatcttttcgagctccgaggggatatctgtaccaggacatctctcgcaggtgagcttatagagatcatcgtaagtcagaatctgctttttgtagtggacgctcttatatggctcatttctcatcttaaaaaaccactgagcctcggcattcagatgactttctacagtatcataagcttcttctgcagcgtgtaaaagctttttcgtgatggaatccatcgactcctcatggacatagtagttaaaatacaccagcgcttcagctgctgtctggacattataccatttctttaaatccttgatcttaagcactgaagggggaaatgtgggctcgcttccttccgtgtcgcagaaatcccgtgacagctgaattctttcaagaatcgcggctgctacggctgatgcgtcaagtccttcaaaacactgccctacatgggtttctctgccatggatataaaatgacggcaggatctttccacctacaccagtatatatatgtaaaaatctgtcgtcaggagacgacgggcaggtgaagtcattgtttatagcaaggacatagtcgagattgtatttttccttcagatccagaagtacatcgatcgaatcgatgactccagtgtgaagattttcctcgacaggatttagcatcagaagcagatttccattgagcgtatcagacgctgacagctcttccagaagtattataaagaccgcatccccgctcttcatgtcgctgctgccccgtccaaacatgtagtcagctgacttaagatctgctctgacttcgtctgagaggtcgagcattccaagtttgtcaagccgtgccatctcttcttggagtctgtcagggtcacaggcgaagtcagcaagctttccataaccggaaagccccacagtatcggtgtgcccatggaggattacagtcttttttgaacctccatgccccttaagaagtgcaaaaacagatcgtctacaaagagggtcgttatcgatgacctttgttatcacctgattcggtctatccttaaaatatggtatctctcgaagacgtttttcaaggaaaaggccgatgtccttttcaccctctgtgccgttaatgctctttactctgacgagatcttttgtcaggtcttcaatccttttcgcctcattagcataaaccattgtctcctcctcacgctgcattcgatactccgatgatctttctgatggtgacgagaacgcgttccatttctgcctctgtaccaatcgtgatcctgacaaaagtatcgagtcgcttttcgtcgtagtaccttaccaggatcccgttcgccttaagctgggcagtaagatcagctgcacttatccccttcggctggaagaatacaaaattagtctccgtccggtaaacattaaagccgagcttttcaagctcatcttcaaaccactctctggtatatttgatctttccaacgcagagtgacatatattcctcatcaagagctgcagccgtaccgccggctatcgccagggtgctgagattaaatggattaaatgaaaacttcaccctttccatgtcttttattatgtcagaagatgcaattgcaaaaccaattcttgcgcctggcatgtttctggatttggagaaagtctgcacgatgatcagattcgaatatctgcttataagcggcacgcatgactcgtttccgtaatccacatatgcctcatctatgagtaccattctatatggattggcggatacgatcttttcaatatcactcactgaaagcgcctggcctgtcgggttatttggatttgcgaggatcacatccctgtctgtatttatatagtcatttacatcgatgctatagtcatccttcagcgggaactgtttgtaatcaagtccgtatgtaactgcgtaagtgcggtaaaaatcataggtgatgtccggaaaacagaccttcattccacggcggaaaaagctcatcatcgcaaagctaagtacttcatctgctccgtttccaacaaagatatttttgtagcttaagtcatagatgcttccgatagcttttctgagagatacatagtgaggatcgcagtaatgcgttacgctgtttacttctgcaacagtcattgcgtcaagaaccttaggagatggcgggtatgacgactcgtttgcgttaagcttcagatagtctctgtcatttggcatttcaccaggttggtaaggtgtagaatttttaaattcatctaaaagaaaataactcatactaagcctccttaaaaaaatcagcctctctctagaggaaaagtcatgcagtgcggccctccgcctgctttgaggatttctgttacgggaagctctattacatccattccatggcgtaagagagcttcgtttacttcgtgatttctcgcaagggataagactctgtggtcgcctagtgcctcgagattgcacccgtggaggtaaattgcctcttccggaacatcaatgatgtcgatatcaagctttgcgagaagctttttaaaatcatccggaaggccgtcatagtaagttaccgccagattctcgtcaacgaggttaaaacacatgtccatatggagatattctctctttaatgggacacttatcacttcataaccgtatttctctaatgcctgctttacttcctcggcaccttttgcatttgttctgtcagccattccaagcgctataagattttctctaagaaatacgaaatctcctccctcaaagatgccatccttcacctcagcaatacaagggattcccatgctttccatcttcttcttgtaatcgtcatgctcttttcttctcatatcgagcctgaatctgccaagaatatagccctcgcggacgcatccgccgaagtcccttgcgaatacggaattcggacgttttttgtcagattcgaggaattccgtttcaactcctgccttgtgataggcatctacaacactcttaaattcctccgccatcaatttcttatcaagggacgtatcctgccacttcacagcaatctcattgatcggtgcggcttccagaaaatccggtggggacaacagtacccggtgtaatgtgcttactccatctttaacgtacatatgctttacctctcattcgtataaaaaaaagcaacgggctttttaaagcctcgttgctttgataggacaagtatattacgttccctttcgtcattgcaatgtaataattacaatgtttgccggaaatatttgtgattttatcaaaaatacttattacgaaatctcgccagcctgattgaaatacacggcaattatgatagctccctgaaattccacaggtctgttttcaagccccaacacctcacacgctttcgagattctgtatctgacggaattctgatgaagccccatacattcagcggtcttcgcgatcgagagatcatttctgacgtaatttattacagtgttaagaagctcggactcgtcgtttgtgtcataattcttaagactatcaaatatcgacgagcagtacgacttgagccagaaattgtctctgtttggaagcattatctgctgaattccgagattttcaaaaagtgtcacgttttttttgagtctcgctccgtagcgcgcggcatagatacactctcttatcttatgggagaggcactctctcatagagctctcacggcttactccaagaaccgcctcagtggtgcttatgccaagggaagtctctaatttctcgacagtgatcgaaggctctccaaatacagcagcaataacaccgtatctgtatgggataattctgacattttcaggggaatgctcgtttataatctcaactctgtggtagaatgcgtactctcctgtcggttgcttcaagagaaaataaaaacagcggtacggttttctcctgtcaggaaataattcatctgctacggcatcccggttcatctgtcccagatggggctccaggaaaaatgacagtctctcctccagatagtgcatgtcatcagatttttcaatggctgaagcaatgcctacaactacattttcgagatagatatccctttttggaaaaagaaagatcggaatcttatgagtgtctgcaaactccataacatcatctggcaggtgttcaaaacataccatctgtatggcaagcgcactgacaccgtccagataaagctgctttatgaccggaagaatcttttccttcgcctttctcgaaaacagaaagctcgtaattacgattgcatccttatcaaacagattgtccgcttcttctcctgccggagtttcggaatcatattctgaatccataagatttacatgctttatattgtgtgacaggccgttttttccggcaacgagtttgaaatccttacaaactgtaagacgtacgatatcttttactttaaagcccattgaggttcaccccctgaaagaaaaaagacgggcagtaaatttactgctcgcctttaagccattcgtattaaatttttattaatcatacattaaaagtccgattttttcaatccccgattcttgtaaattttataaatttaggcttcgaatttagtaaaatatccattgaccttcccgtcttcccggattatgctaggagaaaatcaaataaaaagagtcaacggagacagatcggacgacctgtctccgtttttttactcttttttacagttctattacacatgaaaggagtcacattatgaaaaacgtttttaaatctttacttgtcgccagtctgacagcaggaatggttctctcgatggcagcctgcggaggaaaatcatcagaaagcagctcggcaaaatcaagctctgcttctgctgcatcaagtactgcatcagagaagagtgctgtcgcagacatcaaaaagtccggaacacttacaatgtgtaccaacgctgaatttaagccgttcgagttcaaaaaaggaaacgatatcaagggaatagatgtcgagatatcgaaggcgatagctgacgatctgggtgtaaagcttaagatttctgatattgcatttgattcgcttatcccttctcttcaggcgggaaaagctgatatggctgctgcaggaattaccgtcactgaagacagaaagaaaaatgttgatttttcagatacatactttaatgcatctcagaccattatcgttactaaaggcagtgatataaagaatagaaccgatctgaacggaaaggtagtcggtgttcagacaggtacaacaggtgatacatactgcactaaccaggatggcaaatcagatatcaaagtaaaggaagtaagacgttacaacaagggaatggatgctgtcgcagacctgatctccggaagaatcaacgcagttgtaatcgataactacccggccaagaaactcgtagagcagaactctgataagatagctctaccggatacttgatcagttctgagatcaggatctcatgtatgtaaggcttcaggccgttcgcttttgctgtctttgctatgctgtagtagagtgcgctgctgaagctccatgactgagtctatgatgtgcccgttgtgctttctacgcagaacttccggatgctgcgttctgcatcgttgttgtcaagtggaacttccggatgatcaaggaaggtcttcaggtagtatcctgattcttggctaggtcaatgcagcgcgaagcttcgtactcgatatcgttttgctgtcaaatgtttttacccacgcaaagaagtcctctacgagtggctgatgttttctgccggttctttagccttccctcatcagaagattttgaacttattgtcgaggtggtaaaactgatcgatccgctttactgctcggcggctatctcttgtgccggtgtcagctttcgcttttgcagcctttacgatttctgcaaactttcgtctgacgtggctgtaacacccggctactgtgatatcattgctgtttttcatgatggtgtgatacggctgatatccgtccgttaccaggattcctttgtagccttcaaggtaatcctgtattacctcaccattcctcgctccagatattcataaagatatatcggaggactcgctttccggagaatgaagcacccacatgtactgctttgacttttggcattacgaaggtgtctcatcacagtggagcagcttcgattcatcagctgcttcttatcgtcagatgaacagggtcagataatacctgtagactgatatgagccatcggccatgtctgccggtcaagaatgacatcataccttctgatctcccagagaggcggttcagtgggatggcattccactacttcatgttgaagatcatggcaaaaagccctggagggagtatgctgtgagacagaattcttgcaggatgatctgccttatcacactgtcccacatggttcccaccgtatacctttacatgatgctcaaggatcttaaactttgctggtatgcattgcagtcactgtatacgtcttcggtgagctcatgcatccgtgcggaaatgcagcatcaagccttcttttgagcatgtgtatgactatctcccgctcgacaccacttagattttcctttctctttcccttcttacgggtatgctctttgactttgacaacttcatctatgtctttttcaggaggaacacgttttcagtgagagattcaggctcgtttaaaatgttattaaagagatcggacatagacatgtccttcaatctgattctctgtttcagacttctgccaaaacggttctgggtaaggatatcgatctgctggtaagatcttcgatctgcttaacaagcttttcatctgtgccagaatcttagtgtcatgcgctcagctggcgatacgcttcacgcagctgaaggaacagaaaaatgatcgtttcctttgggggattattcagttctgagtctgtgatctctggtccgttcatactatatattttatcacaaaaagagcctgaagtccgcaaaatacagcgcttcaggcaccttgatatgtatgttttcaggtgcataaatatagtaagatcctgttcagtaaatccctggaggagcatctgaaataactttttctgatcgatattcagtccctccataagccactcgtactgtcgctgcgagatcacttttgcttcggctggagtacggggccattgcagctttccattagtaaaacgttataacaatgagccagccgttgccttcataaagaagagctttcattcggtctgaaaggcgaccacagaacaggaagatggaaccaggtctgccggatcaagtccgaaagtattggtgacagtttttatgaggccatcaatgccctttctcatgtcagtatagttgagcagagatagatgtgcgtaaaacctttagcgtcactcagcatcttcaatacctcaaggacttcagctatcagagacttaggagtagactcgtttatgcagatctcagagtttcctgttctgatgatatctgagtattgaacttgcgctaaatgatcagacttttttagatatccggttcagagacggcagtggcctgtgattgaacctgaggcagctcaacaaagcctgagtctcgatgactctcctgagtttgcgcagataatagtagtactgatttctagtgtagccattctttttgcagaaatcatcaatcgtcaaaccactttgatttcgtcctgaattatgtttgaccaatctttgaggcgaacctgtttacaacttcgtttggattaacatccatgcaattggccgcgaagcgggtgcgaattgcaccgctcatttaatggctaaagcgcgaacgcatttcacacttatacaggagtaggatttggaagataaaaataaagtcacgaagttccacagagtgcctgagatccactttgaattcattcttctgatctttatattcatctatctgttctttcacctgctttcattttttacaggacatcatatcactgtcacagaggtaaagcagggacagatagttactgataaccgtttcagggccctggcacttcggaatgagactttagtcaaggctggcggcactggtgaggcatattattttctgccggatgagagccgtgtgaaaaatggagagactgtcttaagcctcgacaagacaggagacctcatttcggagattcagaaggagacgtcgaattctttttctttgagcaatgaccagaagcttcgtatcactgagatgcttaagggctttaatgattcgtattcaccggagacgtttgagagcacctactctcttaaaaaaaatgcctccgattacttatctcttgtaaacggagagaaagttaaaaaaactttaaacaaaagtctggacaagcacattaaggcaggctctgttataaacgtaaattcgccgtcttccggacttgtgtgtctctcctatgataacttaaacggtttaaatgaggagacatttaagaaatcttcgtttgatgagtcagctttaaagactaccgaggtatcgactggaaacagcctcagcccggacagcacggcctttcggcttgtaactgacgacaactggaagcttgtcacaccaatttctgatacgctgtatcagagtcttaagaacaagagtacgatagaagtcagatttgacagcgacgggactaaggtctgggcaaatatgcatattataaagcgggaaggtgtgcagtatctggttctcgaattcgacgattcgatggatagattttccggcagccgctttcttgatatagagcttttgttagacaacgaatctggacttaaggttccgaattcttcccttgttacaaaggcgaagaagggatcggacggagaatacatgcagacttacggagtgtatctggccaacaagggctatacacagtatgtcgaagtgaagcttctctataaaaatggacagtacagcatcattgagccggtacataacagctctctgaggctttacgattatatagttcttgatgcaaaaggcgtgaaggacggagatattattaacgacaagtgacaggaggaatttttacatgggaatagtaagtgataatttaaaaattgttgaagaaaatatccagaaagcctgtgacagagccggaagagaccgttcagaagtgactcttatcgcagtcagcaagacaaagcctgtagatatgctgatggaggcctataacgacggcatcaggacttttggggagaacaaggttcaggagcttaccggaaagatcgaagagatgcctgatgatataagctggcacatgataggacatctccagagaaacaaggtaaagtatatcgccggaaaggttgctctgatccactcggttgacagctacaggcttgccgaggagataaatgttcaggccaaaaagcacggaacagttattcctatccttatcgaggtaaatgtagctcaggaggatacaaagttcggggtaaagctcgaggagactgaagaccttgtaagggagtgcgctgcacttgacggtatttctattaagggacttatgacaatagcaccttttgtcgagaatcctgaggacaaccgtccggttttcaaagctttaaaagataaatcagttgacatcgcctcgaaaaacatagataatgtaactatggatattttgtccatgggcatgactaatgattatcagatagctatcgaagagggagccacgatggttcgcgttggaaccggcatcttcggtgcgagaaattataacatctaaggaggatttgaatgagttttttagatggttttcttgatgcagtgaacttaagagatgacgatgaagattacgatgaggaagagtttgaagaggaagaggaagacgagccttcacgtttcaagaaaaagaagcgtgctaaagataccgaggataagaaggcatcgaatgtcacccctataagaagtcatcagtcaggctctaagcgtgcggcttattcgattcctaccgagatggccgtagttgtgatcaagccgacttcgttcaatgatattcaggagatcgcggatactcttctttcaaatcgtacggttgttttgaacaccgagggattagatatgaacgtagcagagcgtatcatagactttatgtttggtacctgctatgcggtcggaggacgattccagaagatttcgaacttcattttcattatcacaccgaagggagttaagatttccggagatctggcacagatggtagacgatctgtccgattccatccacaagtcagacagtgacagcaacaatttcggttctaatttctgatgaaacagaattcagatgagtttataagaaaacacttttctgatctcgatggaagagcattttccagggattatcctgtctttacggatttcctcgatttaaatgagcagagcatcctgcgaaagtcagagggcagttttaagtgccatatctctcttttcgggggatatgacggtagtgagcgtcagatggctgcattcctgccttctgatgcttttttcgatatcgattttccataccatgtactaaaaattgagccggctgttcagaagtttgcagagaagctgacacacagggactatctcggctcacttatgggccttatgataaagcgtgagcttatgggagaccttatcgtaaaaaaggatgaaaactactgtatcctgttctgcgtcgaacgcattgcgggctttattgctgaaaacctgactaaggtaaggcacactgaggttactgtgaaagccctgccaaagcatgacgcaaagttttcaccggatttcagggaagaggatatcattatcacttcagacaggcttgactcgtttgtggcggcctgtgcgcactcttcgaggagcgcggcctcatctctgatcgactctgagaaaattttcctgaacggaaagatcgtgacaagccacaaagctgtcataaaagagggcgatatcatcacggtaagaggaaaaggaaagcttaaggtttttgattttaacggagagacacaaaaaggcagacttaaagtaaagattggctggtacgactgatggaagataagctggagataaaatacgatggaaaaccatgttacaacattgttttggaggacgatttcggcagactggctgattttttgaatcagaccgggaagaaatacggacgcatctgcattgtaagcgatacgaatgttgcttcgctctatatcgacgacgtaagggacgctctttatcgatgtgcatcgcttataacacagttcgtgtttcaggcaggcgagccctcgaagaatttaaacgttgtagaggatttatatgagcaccttataagggagcattttgaccgcaaggatctgctcgtagctcttggaggcggcgttgtaggtgaccttacaggctttactgcagccacttatctccggggtattgactttatacagattcctacgagccttctttcgatggttgactcatccatcggtggaaagaccggagttgacttcagatcattcaaaaacatggtaggtgccttttatatgccgcgtctcgtgtacatgaacctctcagtgctaaggagccttccggatgagcagttccagtcgggaatgggagaagtcataaagcatggacttattgcggacagcgcctacctcgattttctgatagagaacagggagaggatagtatcatttgatccagagtcgatctttcacgttgtaaagagaagctgtgagatcaagggtgcagttgtggaagaggacccgaaggagcagggcatcagagcgaccttgaacttcggccacacgataggccacgcagtcgagaaactttcaaatttctctctgttccatggccagtgcgtggcgatcggctcagtcgcagcgtcctacctttcgatgaagaaagggtgtatttccgaggatgattataagaagatccgtaaggtgttctcagattacaaactgccgacttccgtaagcgcgagcagctacaatgctgcagatatccttcgaactacaaagtcagacaagaagatgcaggccggaaagatcaaattcatcctgcttgaaaagattggaaaagctgtaatagatacatccctcgacgacgaatttatcttggagggtattaatgagattttaaaatgaagtcaaagaaaaactactatacattttttatactatatataattgcgctgataattttagatcagctgacgaagcttgccgcaaggactgctctgtcaggaggagacatagaccttataccaggagtgctggagctgcatctcctctataacaccggagctgctttttctatgcttaccggaaagtcgatagtcttttatatccttactcctgtaatatctgcggttataatctattttttcatcaggctgccattcgagaagaagtatatgccgatggctttcgtcctctcttcacttgtggccggagcagtcggaaactatatcgacagagtagccttcggcaaagtgaccgatttcatctatttttcgattatcaatttcccggtatttaatgtggcagatatctatgtgacgctttctgtgatttttcttctgattcttatacttttcaagtacaaagatgaggacctctctgtatggataaagaagagatcttaatagatacaaaagacgctgggacgaggatcgacagattcttatcggagcgcgacagcggacataccaggtcattttttcagaaggcgatagaggagaagaatgtcctcgtaaacgactcccctgtaaaaaataactacaaattaaaagatggcgaccgggtgactctgatcccaatcgaggagaaagtcttaaatgtagagccgcaggatattcctctcgatatcatctacgaggatgacgatatccttatcgtaaataagccgaagggcatggtcgtacaccctgcgccggggcatcctgacgggacgcttgtaaacgctgttatgtatcactgcggagactcgctttcggccataaatggcgtcataaggcccgggatcgtccatcggatagacagggatacgactggttcactgatcgtctgtaaaaatgaccgtgcgcacctctttatcgcagagcagatcaaggtgcacagtataaaccgcatctaccgcggcatagtctgcggacatatgaaccaggcttgtggcacagtcgatgcgccgataggaagaagtgaaaaagaccgcaaaaaaatggcggtaaatgcccgccacggtaagaatgcgatcacgcactacaaggtccttgaaaatttcagggattacgcctactgcgagttcaagctggaaacaggcagaacgcaccagatcagggtgcatatggcatcgattgggcacccgctccttggagacgaagtctacggaggagtaagaccaaagtttaaaaatctcgagggtcagtgcctccatgcgatgacgataggttttatccatccgacgacaaagcagtacgtcgaattttcagcaccactgccggaatattttaataagttgcttacgatattaagaaatcagaaataatcacaaaaaaagccagggaaattccctggcttttttatgctttcgggtccttccggtggaagtttactgcattcgcagcttccctcttgtgttcgtcttcgatcgcagcgtagtaattgatagtcgtattgatgttctcgtggcccaacacatcggctacaaggcggatatcgccagtctctctgtagagcgctgtgccgtaggtgctgcggagtttgtgcggtgtgatgtgcttgtttggaacggcgatctgggcgtatttttttacgagcttctctatagcgtctacactcatccgctttccctgcatcgagaagaacagagccttttcgtggccgggcttggccttaggaacaattgaagcccgttctccgtccacatagtctttaaggacatcgtgtacttcgtccccgaagtagagaacgtcctgcccgccgccttttcttacgatagttatcgtatttaccttgaaatcgacatcagtgatatcgagtccgttgcactcggatacacggattccggttccaagcataagcgtaagtatcgcgaggtccctctgctgagtccgctcacagaatttcctctgtctctcagtcatctggtcgttaccgttctggatagcatctagtatggcctgaacttcgtagttattcattctgatgatatttttgtcttttttaagacgcggcagcggaacgaggactgtcggatcctccttgatattcttgtggatcaggtggtagtggtagagaccgcgcaatggtgccatcttgcgggcaatagcctttttcccgttctcatggatcgttttgctgtcggagcttacatcgagttctaagtaccgctggtattctgcgatatcttccgatgtgatctttgtcaatatatcgagcctgaagtccacaggtttcttgccattatacatcggatttttctcgatgatatagttaaaaaatgtcagaaggtcatagcagtatgacaccagagtgctggtctgggacgtcatttccttactgtagatatagtcggcaacaaagccgggaagctgctttagaagttcccgaagccgcattgtctgatgatttttcttttctttataaaattctgaatcttttcccatatctatattgtagcttaaatctgaattttttcaatatagccgtcgggtacatacggagaatatcaggtgtcatttggagtgaagcagacataagcgggccatttgcagtgtaaatccgatgagacagcagcagatatttagcggataaatatctgtttatctgaaatttacagtacttttgacaggaaatctttaagccttggattcttcggcgcatcaaatatctgttctggcgttccttcttcgagaatatgcccaccgtctaagaagaatatcctgtcggcaacatcgcgcgcgaatttcatctcgtgggtgacgacagccattgtcattccctggtcagcgacttccttcataacttcaagaacttcaccgatcatctcaggatcaagggccgatgtaggctcgtcgaaaagcatcatcttcggattcatagcgagcgaacgaactatggctatacgctgtttctggccgcctgagagctgcgacggatatgcgtcggctttctctacaaggtcaactcgtttgagcagctcaatggccctctcatcggcctgctgttgggtcatacgctttaatagaaccggggccagtgtgatatttgctttaacagttagatgcgggaacaggttgaaatgctggaataccattcccatctgtgcgcggatttcatcaatattgacgcccggaacattgatctgagtgccattgaaccagacttctccggaagtaggcgtctcgagcaggttcatacagcgcagaaaggtactttttccagagccggaaggcccgataacagcgactttttcgccgtcttttatctcggcatcaatgccttttaggacttctagatcaccgtcgtcggtcttgaatgtcttgtgtaagtttttaatgacgatcactcttctgaagcctcctttcgactacatgctggatctgggtaaggccgatgactatcacgagatagatgcctgcgacaagtaaaagcggcgtaaaggcatcgtaagttatcgaacggataatatctccgcctttcgtaagatcctggatacctacgtatccgctgacagatgtctctttaaggagtgtgataaactcattaaaaatagccggtgtgacattttttatggcctgagggagaacaatcttaaacatcgtctggttggcggaaagtccaagcgaccttccggcctcagtctgtccgtaatctacggattgaatcccgcttctgaaaacctcagatacgtatgcgccggagttgattccgaatgctaaaatggcgattacaagaggacttccgctcgttaagataacgaaatacatgatcatcaactgaacgactgtaggtgttcctcggatgactgtgatataaatcgagactatgactttaagaaccctcataagtgggccgcgttttccattggcatagaaaacatttatgatagatgaaataacgccgagcgcaagtccaaggatcagggcaaagatcgtaattacgaccgtgttgcccaggccctgaagaatgtacatataacgaccctctacaacgaaatcgtcgtacagatgctggcctatagttgcaaaaaacgacatttaagaaattactcctataaaaattactggtgaattattattctgtcttgatgtatttagagttgatcttgtcaagagttccatcagactcgagcttctttaataccttgttgatctcgtcctttaagtctgatccctttggtacagctatagcatatttctcttcactcaaagcctcgtcgagctttttgatcttgccagaatttttggaaacgagcttctcagccgggaagttgtcgataactacggcgtcaattctgcctgcgataaggtcagatactgcatccataggcttgttgtatctcttgacttcattgactttgatatcgttctcacccttctcgttcgtgcagtaggtatcgcctgtcgtaccctgctgaactccgacagtcttgccgttcaggtcgcttctactggaaatcttgctgtcttttgtgacaacgatagcttgagatgcgttaaaataagaattcgtaaagtctacgttcttctcacggtccggtgtatctgtaagacctgctgcgcagaagtcatcctttcctgtgcttactgcagggacacatgaatcgaaagcaatatcgttaacattcagctttactccgagatcgtcggcaatggcctgggcgatctctgcatcgattcctatgatcttattgccgtctttgtactcaaatggctcgaactcagcgtttgtgacccagttgatagttcccttcttcttgatcgcagctacctggctggtgcctgaactcttacttccggaagccgaggatgagccggatgttgcattcgatgatgagccgcatccgatcatagagattgcgcatgcagcgacagcgataagtgataagatctttttcttcatttaaatctttccttctttccaactaacttttggttacattttaataaatatacatctaaaatgaataaaagtcaatgatatatgtgagtatgtttattttgttcatgtctgttctggttcaacgaacaatttttctaaagtctgagatatttcgatattttcaaagcttatttcgaccgagttaaagaaaaccgtttataaaattttttttctgtatcattttattcagatggctgtttcatgcatttgctataaggaggcggaaaatgaatattaacgggaaaaattacaggacatttgcagatcgtgaggaaaaagacttaaaagagattaaaaagcaaaattttgaagatgcagagaagcattttcaggccaggctcagtaagcttttagtggaccgcgatatcagaaagcaggatcttgccgacgcgatctgtgtatctccaagctctgtgagcggatatttatccggaaatcatcaccccgatatggctactcttctggctatcagcaattattttgatgtgagcctcgactatctcttcggaaagactgattatacatatataaaaactgacaacagatctcctgtcgataatgagatgctaagctattacagcaagttaaacgacggcgacaaacatcaggtgttaggagagacgaagcttctctacaagattgaaaaaaagtcgggcgcaaagtgacttaaatacgctgttttccgtcaaaaagcaaacaaatttttcgaaaaaatgtttgaaatcttatgttcgatatggtataattttacaaagtttatatagaaagaacccgtaggaaacgcatacggaggttttgacatgtacggaaagattaccgagaaacagaagcagatcctcgaatttataaagaatgagatcctgacgaagggctacccgccatcagtcagggagatttgtgaggcagtgaacctgcgctccacttcatcagttttttcacacctgaattctcttgagaagaacggttatatcagaagggacccgacgaagccgcgtgccatcgagatcctcgatgataattttaacatgactcgcagagagatgacgagcatccccgttatcggcactgtagctgccggacagccacttctcgcagtttcgaacatcgagtcctacttccctatcccatcagagtttgtcccgaataaggagtcgttcatgctccgagtgaagggcgagtcgatgatcaatgccggtatcttaaacggcgacatcatcatggttgagagatgttccaccgctgagaatggtgagatggtcgtagccttagtcgatgattcagccacagtgaagactttttataaggaggacggtcacatcagacttcagccagagaacgataccatggatccgatcatagttccagactgtaagattttagggaaggtcttcggagttctcagattatataacatgagacactgattacttttttattttttatgacattaagaaagctccccgtgcggggagcttttttgtgtgccttttatttcatcgtgataagctcgtactctctgcttccgagtccgatcttctcgccctgctctaaggtctccttccatgccgtgtttggattgctgttgagccagacgtcgtggtggtcgtggaaatcaggcgaagccatattgtcgccgagctgggagttccttataggtgtggctttctcgcagaggtctacgcaggcctgatctaaggctaccggatcgaaggatgctagcattcctatatccggaaggatcggtgcgtcgttttcaccgtgacagtcacagttaggcgacacgtctgtgataaggcttatatggaagcatggcctgccgtagcagacagcctgagtgtactcagccatacggcgtccgagaagctgcggtgcatcccagttgtcgttttcaatggcatcgaaggcgcaggctcctatgcagcggccgcagcctttacagatttcaggatcaatgtacgcttttcttactttctttccgtcgacttccttctcgggataagagatcgcgtcagaaccgcactccctggcgcatctcatacagccacggcacttctcttcgataacgtgcggatggccgctctgatgctgctgcatcttgccggcgcgggagccgcagcccattccgatatttttaatagtgccgccgaatccagcctgctcatgtcctttgaaatgagtaagggaaataatgatgtcggcgtccattaccgcgcggccgataaaagcagtcttgcagtattctccgttgtgtaccgggacctctacgtcgtcagtgccacggagaccatcgccgattatgatctgacagccggtcgttacagtgttgaaaccgttgatattcgcacagtccaggtgctccagcgcgttcttacggctgcccggatagagggtattacagtctgtaaggaatggcaggccgccctgctcctttattacatctgctactgccttagcatagttcggacgcaggaaagcgaggttgccgagctcaccgaaatgcatctttatggcgacaaacttgccgttcatgtcaatgtctccgataccggctttttttatcagcttctggagcttcgcggtaagcggcactccgagagctgtcctgaaatcagtaaaatagacctttgatttttccattgaatttcctccatcttctattgatttgagacaagagcgggcgaagcgccgtttagattcaaatcaaaaagacttttgcaacatacttataaaaagtatatcacaaaagtcttttggctgctgaattaatttaggattttaagtcaggcttcgatcattttgccatctttccagatgcgctcaagattatagaaatcccttgcctctcttgtaaagaggtggattacgatatcaccatagtcaagaagaacccaggtagatgacctgcggccctctacatccttcggatccatctgatattccctgtagagtttctcctccaggtccttcttcatggcttcgagctgtgtcaggttcgaggcggaagcgactacaaagtaatcggcgataatgctgacatttgagatgtcgatgatgtcgatgttctctccctttttctcttcgagagtttttttgataaattttgctatatcgagtgtatttgccatttatagctcctgattgttaaaggtttttgtaatattcgtaagtacggtaggtagtctcgtctatatcctttccggtggctttcagatagtctatcgtgtcggagaggatcatttggattgccagatggaagtccttgaaagcacactgacggatctctgtaagacgggcggctttatctctgttcggttcaatatagtcggctgtaaaaagtatctcgtcgagcagattcattccaggcattccggtcgtatgaaccgtaatggcatggagaatatcgggatcttctataccatactccgtccttgcgagataagctcctgccttggcatgcagaagctgcgggctcttctcttcagctggtgagatgtcgatattttttttcttacagaaatcgtagagttcgtctggtgacatgtacttcgcgcagtcgtgcagaaggccggcgataaaggccacatccatcggataacagtgtgccatagcgagagctgctgcagtgtatgcaacgccttgagtgtgggtgtatctggaaggtttaagcttcttttcgagctttttttcaatctcctgctttaattttggaaaatcagttgatttaatttcttttttcggtgacatcttaagtcctttcgtgctgccatagagcctgtgtgccataatatacgaaaaaactggcgcagggaccattaattttaattttacgatattctttggggtgatacccgaagcaataagctcccttatatcagatgaggaaatatcgatgtaatcagtcgatagaagttcgatattcgcgccgtagcgtttttttaagtccatgctgacagcttcgatatcgttcgttacatctgaatcgtgcctgacacttactgcgagggttacagatttcgctatgatctccggatggacccaggtcggaaaagtgtcgagagaatcttcacctataataaaataaagctcgtcgtccgggtagtcttttttcatctgagtcagagtcaggtaactgaagctcttgccgtcgcttttctgctcggtgtgtatgacgcgcatatagggaatggaattcacagcggcctcacacattccgacgcgttcgaatctggtgacaccgccctcgagattcttgtgaggcgggatgccgtctggcatgatccacacttgatccaggtgaagctgtctgtaggcttcagctgctatatagagatgcccgttgtgtatcgggttaaatgtccctccgagaataccgatcctcttcatggaagctgaatcaccggtttctttgcaggtctgtacaatacgatcttgcggccgatgacgcggacaactgctgactttgtcctgccggacagcatctcagcagcgcctgcaggagtattcgcgcagttctttaagactgagacctttataagctctctcttcgcgagcgcttcatctatggcttccactacctcaggcgtaacgtcgctttttccaatctgaaatataggctgcatatctgcagcgagtcctgagagatatgctctctgtttattgtttaaattcatagtaaaaactccggatcatttgtagtattcaaactcgaggttataaacctttaccgtatctccgtccttgatgcccatctcttcgagcttctttaaaatgccctgctgctttaaaaacttctggaagaacgcgaatcccttctctgaatcgaggttcgtatagcccagcatcttttcaatcttcgggccggtgacaaggtactcaccgtcactgcctacttctacggtaaatgagtcgtcttttttgaaaaattcttcaggatcgaaggtcgacggatagatattcgtctcgtccttgtactcgtcgagaatccgcacgacttcgccaatgagctcctttacgccttcacccgtaactgcggagataaggaaggttttcctgtggaatgtatcctccaccttctgtctgatctcctctgcgtcgtcaggccttgtatcggccttattgcaggcgatgatgataggcttgtcgagaagcttctgattgtatgaggcaagctcgagatttacagcccttatatcctcaatcggatcttctctctcgactccggagatgtcgaccatatggataagaaccttgcagcgctcaatgtggcggagaaattcaagccccagtccgactccttccgaagctccttcgatgattcccgggatatctgccatgacaaaactgccgccgcccggaagatctacaacaccgagaatcgggtttaaagtcgtaaacgggtagtcagctatctcaggtttggcattcgaaagccttgagagaagagtcgacttgccggcattcggatatccgacaaggccgacgtctgctaagagcttaagttcgaggattacttcgaggctcttggcgtctccgcccggtttcgcgtacttaggcgcctgcatagtagatgtggcaaagtgcatatttccaaggccgcctttgccgccctttaacaggacgactctcctgttgtcaccgctcatgtcgcagatgacctgccctgtctcggcttccttgataatcgtgccggccggaacttttaagacaaggtcctgtccgtctttgccgtgctgcctcttcttgccgccctcttcgccgttcgtagcggcgaactttcttctcattctgaaatcagagagattatttaacttgtcagagacctcaaaaatgatgtctccgccacgtccgccatcaccgccgtcagggccgccggcagggacaaacttctcacgcctgaaactgatgtgaccgtttccaccttttcccgactgaataatgatccttgcacggtctgcaaacataatgacctcctgaaaaataaaaagcctgacctcacttaaaaagcaggatcaggctgaaagtacgatttaaaaaattactcggctactgggtaaacgctggcaaccttcttgtccttgcccttgcgctcgaaacgaagaataccatctgatgtagcgaagagtgtatcatctccacccttcataacgtttgtgcctgggtgaaccctggttccgcgctgtctgtagatgatgtttccagccttaacgaactgaccgtcagctctcttggcgcctaatctctttgactcggaatcacgaccgttcttcgtggatcccattccttttttatgagcgaaaaactgaagatttaactctaacatattagtcctcctgaatgtgaatggaaagatacttctttccgtactgcttctctatctgtgataatcccaataccatcgaatccaaaagcacctgtgccttctgatcacaacctttcgagaatacagccttcagataaccgctgtcctccgatgtgagatcgatcggagtatcagtaaactgatcaatgctgttaatcgtgtttatgataaggactgaagctgctgcacacacgatgtccttcccgtaatcgtaaaaacccgcatggccgctggattcaatgctcttatagatgctgccgttcttagtgactgtaacgcggatcatcaggcgttgatcttctcgatcttaacctctgtgtatgactgacgatgtccgttcttcttgtgataacctgtctttggcttgtacttgtaaacgataaccttcttgcctcttgcttccttaacgactgaagcctcaactgtagctccgcttactgtaggatttccaacctttgtctcatctccgccaacgagaagaacctgatcaaaagaaaccttgtctccctcgtttgctccgagcttctcgactctgataacgtctccctcggaaaccttgtactgctttccacctgttgcgataactgcgtacattctaaacctcctgtacttaaactgaaacgaaatgttccctccgccagtatccggcggtgtctaaaaataaacacacttctagcctcactgggcgtcaacatcagatataatatcacgatgcaaaacacttgtcaaggtctgtttcacggacgggaatattttttctctggtgagttctaagagcccgagttttgtaaaatcttctacatttacctttgcaaaatcggactttgtgagagatctcatcagtgaaatgatctgtcctctctcatcatcagagctcattttcataaagtctattattataatgccagacaggtttctaagccgaatctgctctgcgattgcagctgccgcttccctgtttacagaaacaggcagggacttttttgccctggcgctgtttacatcgattacggtaagcgcctcggtctgctctataataatattggcgccgctgctaagccatacggttttgcttaaaagccgttcggttatagtccttatccggtagagatctaagagtgagagcccttcatctttgtaaaattctccgcagcttccgagcttttcgcagatatctgtgtcacctgtctttatctttgtaacgttaaggcgatttgccgcgaaaggaaacgcggtaagaagagtatttaagatatccaggtcttcaaagaccaaagccggcgaggtgtgattctttccatctgaaaaaatctgctccagctttttattttctgatgaaatcttctgataaagctcattttcgtctagtctggaagcagcagttcttataagaagagaacttttctcaagggagatctgggaaaacctctctctgtcttctcttttcagtttctttgaaaatgatacgccgcttccggggcgccttatcacaaaataaggcgttgacagctctattgaaaaagtggcctccggctcctttgtctttatcgcatccttcttaatctggatcaggactaggtcgccttccgagagttcttttctggggctctgtctttttatgtagacgggatttttagcatccttttcctttacaaaggcatggccctcaggaatcaccagaaatacaccgactcccgggactttcttttcgaccctcgcagagtatacgtttccgacgagagatttcctgctctgatcgaaatatctgatgtagataagctttttgtcgctttccctgaagcatgccaggaccataaaaggatggccttttatttcgagatgatcgtagactaaaaagcaatctgtcacgttcatgctttttctcccagcggaaccagctttcctgcctcgtttgtcgtaaacatatcaagcctgtgaatgccgatggtgaagaggtcttctgtgtcattttcattaaaaagtgagttcatcagaagctcaggcttcagattgtcggaacttttcgcacagactttcatatagatggccggatcattttcagagagtaaaaatccgttgtctttccaatccgggatatagtggtcacgcttttccgccgggaaacggtcgtaaacgtcgatatcatagatcagcgggagaagatctacttcccgctcactctttttggtcttttttgtaacgacaagtgaggaggctttttttactttcgaatcgatcactgactttatagccgaggtgtcaaaagtaaagtcgtctgatatttttttaaaatagacgagataggaggctcccataagctctgccatggcctttctcgaatcgtgcctttctgtaacggatcgtatctcaactccatatgccatctgtgaagaaagtttctgttgtatctcatcgactggcaaggcaaactcgattgaaaagtccatgtactcgccctcgctcgtaatgccgactccaagtggagaggcaaacgagagcaccggatgaggtgaaaacccctttgtaaatgtaagtggcagtccgcttcgacgcagagccttctggaaatatctcatcagatcgaggtgcccgacgtattttacagggccaaattttgtaaattttactctaatatccatagcaaacccccgatctgtactgtctgcatccgcagccggagcatttctcgcggcagttaggcgttatctgctgcccgccagtcgcgcggtcccactcgttttctaagaactttctcgagacgccggcgtctatgaaatcccacgggaggacctcagaggtgtcacgctctcttaaagtatagaaatcgggatctatgccgcaggataagaaagcctcgtcccagatctcagggtgaaagtattcgttccacgcgtcaaaacagcagccgtgtctgtaggcgtactctatcacttcagcaatctttctgtcgcctcttgcaaaaatgccctcgagaacagtggtctttgcatcgtgccactggtaagaaaggctcttgtggtttggctcttccttcattctgtggtttacgaccgatgccttgcgcagatattcctccggagtgcacatcgtagcccactggaatggcgtaaatggtttcggcacgaaaaatgatgtagagatatttatctggcatctgccgcctctggtctttttgtctgggagaagatcatagtagaggtgggcgatctgttcagcgagatccgggatagcctttacgtcgtcatctgtctctgtcggaaggccgagcataaagtagaacttgacctttttccagccgcccaggaaggcctctctggcgccgttcatgatattttcgactgtaagtcccttgtttatgacatctctcatcctctggcttccggcttcagccgcgaaagtcagtgagcttctcttgatatcctggactttgctcatgacatcgagagagaaggaatcgatacggagagatgggagcgttatgtttatttttctcctgctgcactcgtctataagaaaatccataagctcaggcagctgttcaaagtcactggtagacagagaacttaaggatatctcgtcaaagcctgtattttcaagcatctctaccgcatatttttttaatatgtcaagtgacttctgcctgcatgggcggtatatcattccagcctggcagaaacggcagcctctgatgcagccgcgcatgacttccagtactaccctgtcctgagtcgccctgacataggggattacaggctttgccggataagggctgccgtttaagtcagtatcgacctgacgctctactgtttccggcaccccctcctctaaaggatagaatttctgtattgttccgtctgcgttgtatgtgacatcgtaaagagacgggacatagattccagggatttcagcggcttttcggaggaaggctttcctcgaataactgccgctctttttcatcgaaatatagaggtcgaacagcctgttgtactgattttctccttctccgatatagaacatatcgaaaaatacggctatcggctcagggttaaaagcgcatggccctcccccgataacgatcgggtcatcgttggaacgctctgttgagtgaagggggattttcgacaggtccagcgcctgaaggatattcgtgtaacacatctcgtactgcagagtaatcccgaggaaatcaaaatccctgatcggatcctgggactcgagtgcaaagagtggaatatcccgttctttcattatcgcggccagatcaggccacggtgaatagactctctcgcaccatacgtccctcctgcggttgaacatttcgtagagaatctgtatgccgagatggctcatgccgatctcataaacatctggaaaacaaaaggcaaaccgcagtgaaacctgcgacttgtctttcatggtagaatttatttcgtttccgatataccggccaggttcttcaatctgcatcagtatatcgtcggtaagtgctgtttttctcatcttgtagccagttctgttgtgatgtcatcccaggtgatctcattgtcactcatcagaaacatcaggttatagatcagatcagtgatctcgtggattatctcctgcttgttactgtcttttccggcaataataacttcagccgcttcctcgccgatcttagagaggatgctgtccatgccaatatcaaatttctctttgacactcgaatcggtatttctctcactgatgatctcttttaaggtattctcaaagatcttctgcggtgcacggtcgacgtactctttttgaataatattattaaaaaagcacgatggagcgccagtgtggcaggctattcctccgacctgagagatctttgcgaggatcgtatcgtagtcgcagtcggctgtaaggctctttacatactggatgtgccccgatgtgaggcccttcgtccagagctcctttcggctcctgctccagtaggtcatctttccgatgcggatcgttgtattaaatgcctcttcgttcatgtaagccagcatatagacaaatccggtctgatagtcctgcgcaattacagggacaagtccgtcgctgttggtcttcagatcagaccagtggagctttggctcgaaattgtccataagtatgccctgatctgagagcgtcgacttaagcttcatgatatccgtgtcgtcctcatcgataaagataccgtaaatgccgcggatagattcagacgacaagagctctgttatcttatcgagatcgtactgatcctgccttaggatataaggtgtcgaagtgatattttcaatcgcggtggcgagctccggggtcataagaacgagctcgtggacacagtctttgatataacttctggtcttgaatgcaaaatttacattgtctaccgatacgagaatcttgtccttcccaaaacgctcggcggcctcttttacgaggcagagcgtctcggattttccaccatttaaaataacctcacggcagcctgcatacaggaaaagtttcacatcgtcgagacgcttgatattgccggctcctgcagtctttacatcgatcagtcggttgatatttctgatgatcgtaaggttctttaaatgctcgctctcgtcttccgagaggtcgacaagaaatatcttgtcaacgccactgtcattgtaacttaaagcaagatccaccgcatttctcggatttgaaaaatcgctgcgggtccttaccgcttttccgtctttaatgtagatagtagcaactatatttttctgttccattacagtttccctttagtagataaaactccctttattcttgggtctttcgatactgcttccctcaaagcgcgaccgaaagctttaaatgtagcttcgataatgtggtgcgaattttcaccgtgaagctcgtctatgtcgatattcatcatagctgaatacgatatcgcatagaagaagtccttgaccatctcggtatcgaaattgccgactctgtcgtttttaaactcctcattaaaaatcaggtacggtctgccgcaaaggtctattacgacacggacaaggctctcatccatcggaaggagacttgaaccaaatctggtgattccgcctttatcgcccagagcctcttttatcgcctcaccgagggcgataccgcagtcctctatagtgtgatggcagtcgacatcgaggtcgcctttgcatttgagcgtcaggtcaaaaagtccgtggcgcgcaaattcactcagcatatggtcaaaaaaaccaatgcctgtatctagcgtgtagtttccgcttccatcgagatcgatagtgacctcgatatcagtttcccctgtttttctctttactgtggcagttctgttcatttctcaaatcttacctttactgaattggcgtgagccgtaagcccctcacactctgcgaaatcctgtatatctcctgctgcctctcttagagcttcctcgctgtaggagataatgctcgatttctttacgaagtcgtctacgcagagagctgagaagaatttggcagtgccattcgtaggaagcacatggtttggtcctgcgaaatagtctccaagtggctctgatgaccaggtaccaaggaagatagctccggcgtttttgacctttgtcatatcgaggaacgggtctttggtcacgatctcaaggtgctcagatgcgatctggtttacagcatcgtaagcgtcctctttattctctgctacgaaaagatgtccgtaattttcaagggatttcctgataatatcagctctcgagagctttggcagatatccgtctatctctctggatacgtcctttgcgagctgctcgcttgtagtgataaggtttgcagctgcaagttcatcgtgctctgcctgtgacagcaggtcggctgctacatagtgggcatttgctgtctcatctgcgagaataaggatctcggaaggtcctgcgatggagtcgatgcttacatatccgaaaactgccttctttgccagggcaacgtagatgttgccaggtcctacgatcttatctaccttcggcactgactcagttccaaaagccatagcagctatggcctgagctccaccaaccttgtatatctcatcggctcctgcctcgtgagcagctacaagtgtaggaggataaattttgccatcagctcctggaggggtgcacataacgatccttggaactcctgcgaccttggcaggaacgatgttcataaggactgatgaagggtaagcggcctttccacccggtacatagacacccgctatggcgataggggtaaccttctgtcctaagaaaattcccttctcatctgtagtaaaccagctgttctgtctctgcttctcgtggaatgagcggatattttttaatgattttctgatgacgtttaagagcttttcgtcgacctttgtgtaggcctctttgatttcttcgtctgagacgcggatattctcaggagtgaggtcgactttgtcaaacttcttctcgagctcgaaaacggccgcatctcctctctcacggatgtttttgatgatctcgttaactgaagcctcgtacctgccgtagcttatcgggcttctctttaaaagttttgtgagcagtgtcttgatgttttcttcgtttaacttttctatttccattttcctgtccttctgattgaaactttatgctattgaacctgtttctgaagtttgtcaatgatctctgtaatgcgtgcgttcttcatcttcatggagacctgatttacgacaactctcgccgaaagaggagcgacctcttccaaaactacgagtccgttttcacggagggtgttgccagtctctactatatcacaaatgacctcggaaagcccgactatcggagcaagttctatcgaaccgttcagcttgatgatctctacggtctggtgcttctgattgtaaaagtagttcttcgcgatccgcgggtacttcgtagccacccggataaagtgcgaggaatcgagaagctctctggcgctctcaggtccagcgatgcacatacggcattttccgaaaccgaggtctaagacctcgtaaatattgcggttttcttccagaatcgtatcctctcctacgattccgatatctgctgaaccgtactctacataggtcggaacgtcaggccccttggataagaaatacctgatgtgttcctcttcatttgtaaaaataagtttcctcgtgtcaggatcgtggatctcctcgactcccaagccaatgctgtcaaaaagccccatcgcctttttggcgagccggcccttcccaagagctaccgtgatcatatcgtctgtatctctcatttgtcgtctcctgtctccattatagtataagaagcatacttaatgcaaagtctgtcgtggtgatccctgtcgttgtaagagtgaagaaggactctgttgccggctttcctcaaagcctcggccttctttatcgcagcctttacgctgtctttcggataaagcagcaggatcttcgcactctctacaggaaggtcgatatgctgtctttcaatagaaagcatcagttcatttataagaaatgcaaaaccgatggcaggcctgtctgctccgaaatgcccgaggaggttgtcatagcggcctcctgtgactataggctttccgcttccgaatgtatatcctgaaaaaataattccggtgtagtacttaagactccttacgagaccgaggtcgaagcttacatagtcttcaactccgtaagcgcttaaaagctcattcatctcatagagatgagaaagtgcgccgtagatcttcgggtaatttctggctttttcaagtgaatccttccactcgtccggcgtcatgaagattttcgacagcagaccgaagaggcttacgaggtcttttgagatatttttcccggataagtattcgtcgagcccatagaagttcttgttagagacgaagtcgtgtacatcagcctcttcttcggctgaaaatccggcggcctctatcagcccgttaaaaatatccgcgtgtcctatgcttatctggaaatttttaagaccgcatgagagaaaaccgtgcactataagcgaaatgatctccgcgtcggaatttatcgaagaatctccgataagctccgcgccgacctgagtctgctcgctgagctctccgcgcagtgagtggtggtttaaaaagacctttccctcgtagcagactctgagcgtctccttcgtatctgaaaaatagcgggaagatacccttgccaccgacggcgtgaaatcaggacggagcgcaagcgtatttccatctctgtcaaaaaatctgaagagatccctctccggtgtcgaacctaaggattcgctgtaagtatccaggaattcaaagcacggcgtctcaatctgatcatagccgtacgaattcaaaagagacatcagcgcattcatcacataatttctgcgcctgcactcatctcccaaaatatctctgacgccttctggcgtgtgtaagagactgttcatcttttctcctttgacactttaactaagtaatgtattaccaaactgaaacgattataaacttaaccctgccttctgtcaaggtctctgtttatcatttcgaggtaaggcaggaaacagccgttttttgatctgaaaaaaaagtcactgtcgagttcttcgatcacaaggctctttctcccgccgcttctgcttcggttccagaacttaagcgcttcctcgaaacgcagataatagtatgtatcgtgttctctgaaatatatcaggaaaaaggatattccatcctgcttttcaaagtcttccatgaaagtcatctggtgctcatggatgttgtgcatagggaaagtgtcctctctgcactcctttgcatcaaagcagaccgggatcccctgcactgctccgatatagtcgactgtactcttcttatcaaagtatgcaagcgtaatgtggcgggtctccttatctatatcgatcggcgtaattggcgtcggaatcttctggataagagccaggccgtcctcccggaggacatcgttcgtgtggtttatacagtcctcgagagaagaacctctaaggcccctcgaattaaatgtcggcatccataaacctcctgaagtaatccggaagcggatcttctatggtcccgatcccgggaatccggacagaaaaagcgtgcagatacatgtgtttttcgtgtcccttaccgtacttcgagtcccctgtcacgggatatccgagatgcgaaagagaggccctgatctggtgcttccgaccggtgtgaagaattatccggattagagtgtgtgatctcgaatatctctccgggaaaaattcggtcacgatctctttggcgccctctgtctctttatcgcttacatttacggtattgtctttattttcagtgtgccagaccctgtatatgccttctctcttaaaatgcccgtcggctatacagtagtaagtttttatgacatctctcgactgtatcagatcagaaagcattctgctgccccggtaggtctttccggctagaactataccgctggtatttctgtcgagacgatttactatagatggagtaaagccggtttccatctcacctctcgaagaaagaagaaaaagaatccttgaattgacgcagtctccgccccttttatcagactgggacagaagccctgcgggtttgtggacagcaattatgtcgctgtcttcatatagcacggtgagaggctctaggggattttgcgccggcactattcccctgtcattcgccgtaaatttgtcatatgtctcatctgaaaaaaatatcttaatgatgtctccggattttaacagctcgtttcccgaggcttttttgccatttagggtgatatttttcttgcggagcatcttgtagataaagcccatcgaagcattcgaaaggagatgcgacaggtatttgttcagtctctccttttcatttgcctcggaaataatgagttctttcatggtataagctccctgtagtcgcttatcataagatcggcctgctgctttttatccgcgtcctgccaggcggagtattcatcttctacggcaatgactctcatcccggcttcttttccggctcttatacctactgtaaggtcttcagccacaagacaggacgagggctctacatcaagtctcttagccgccaggatatagcactgtgggtctggctttccgtggagcacatcctcagatgtaacgaaggtatcgaaatcgtcgtaaactccgtttgcctttgtggcagctgttacaagaacacgggagttactggaaaccaggcctatctttatatgctctgacttcaggtattctataaactccccggcgccgggctttaacgggcagtcgtttcgatagtggtcaagcgccatatggttccagatatcgataaggtcctcctctttgtcggcgagaccgaatctcttcttaaagtatttggcatcgtcagacatcgagagcccgtctatgtcgtcgtttaagtctttcgggacctcttttccccttgagaggaggaattccctgtcgatcgccggccacatccacatcgagtcgacaagactcccgtccagatcgaagagaaaggcgttaatgccttcaagtatatttttcttcatattttaaaaataaaaaaataagccacccaaaaatgggcggcaaataattgccttaatttttgtcggcagatgcttccggtgcagcgccagatgcctgagagctctggcctgctttatcatcagcagcaacttctttcggctgagcggcagcttcctctggggcagcatttgccgcaggagccgggtttaatactttggaaagttctgcgcggttgtcatttacagtgtcgagatatttctgcatcgtaccgaggaaattcttcatcctggtatctgtagtcgtgatcgaagcagtcaggacactctgtacactgcttaaaagcgaatcagtgtatttgatggctgacatctgaatgttgttagcctgctctgtggctttggtcatgatgtcgttcgcgttcttctgggcgatatttacgacttcattggccttggcgtaggcctgctgcatgatctggttttcgctcataagctcattcgacttcgctttggcttcagctacgatcgcatcggcctgcttgtgtgcgttctcgagaatggctttctcgttcttgaggagtctcctgtaacggtttatctcctcaggagtgcgggaacggagctcttcaaggagggactccatctcttccttgtcgactgaaatcttggtgctcgagaacatcgaagtcttgcagttgtcgatgtagttctcaatattatcaataatatcttctatttcactatttgccatttaagcctccctgtcgaactttctccataataagcggaatgatctcctctggaacaaaccgactgatgtctccgccgtacgaggcgaactcttttactattgtagacgaaagataggaatatttcaatgaagttgtgagaaatatcgtatcaatctcagggctttcgactctgttagtctgagctatctgaagctcgtactcaaagtcagttacggctcttaagcctctgatcattgcgacagcgcccttctgcattgcaaaatcaatagttagtccgtcaaatgaatcgacctcgacattcggaaaatccctggtaagagattttatcatatcgactctctcttcagctgtaaaaagagatttcttcgcgctgttgttgaggactccgactataagcctgtcgaacatccgtgatgagcgctcgattatgtctaaatgtccaaaagtgacagggtcaaaacttccgggatatatcgctgttctcatttgttttttataaagacgtgctgattcgtcttgtacgtctttattctggttacctcgtaaatgctttcatcaataaaagacagatctctgtcttttgaagtttcgataattatcgtgccgtctttcttcagaaggccgcatttgtctatttcactaaggacagtgccctcgtcgtgcagtgagtaaggcgggtccatgaaaataatatcataaggcccctcactcttcgcctgatacagcgctgacggaatctgtctctgtataagagtcgccttgtcggaaagcttagtcttattgaggttcgcttttatgacctcggccggctctttgccactgtcgataagcactgcgtggtgagcgccgcggctcaatgcctcgatcgccatctgtccgctcccggcgtacagatccaggaatctgcagcctggtatctccatctgtaaaatattaaaaagagtctctttgatcctgtcagtcgtcgggcgcgtctcgtcgccttcaggcgtctgaagaggtacgcttctcgctgttcctgctataactctcaaattttctccttctcgtctaaaatgatcgctatacccaatgtaatggccattcgggctgcttttctccttacagagcgcctgtcgccggagaagacatacttcctcgtgataacattacctttgtaggaggctcctacgtaacaggtcccgaccgggcactcagatgtgccgccgccagggccggcgactccggtgactgaaagtgcaagatctgctccagaggcttttctcgccccctcggccatctcggcagctacttcgtgactgtagaccgtgtacttgtcgagagtctcctgctttacgcctaagagcttttttttggcatcctctgagtaagtcacataggcctcgcccatacactcgctcatacccggagtatctgccagaagtgaagcaatcatgccagctgtggcagactctgccgtcgtaacggtaatatgcccttttataagaagtgatgccagtacatcggcctgctgcattattcctgctcctttaatatgtcacggttctgaacaatataagtgataagggatactatggtaagtgtcactgctatatacataagcagagtctcaagcaccttgaacagcagtgcaaatggctcaactctgacctttaagatcatgactattaccatagacatctggaaaacagtcttgaatttgccccagtagttggcagctattaccctgcccttatcggctgctacgaggcggaaacctgagatgataaactctcttccaattattatgataagtacccatgcaggaagctgcccgaaactcatcaggcagatcatagctgtgcataccaaaagcttatctgcaagagggtccataaacttgccgtaatcggtgatcaggttgtactttctggcaatctttccgtcggccatatccgtaaggcttgccgcgatgaaaatgatctcggctatgatacgtgtcatgtaattatccgatcctccgacgagtattactatagcaaataccggaacaaggatcatcctgagcgttgtcagtttattcggcagattcatcttcttcatcttctataatctctcctatcagatcgtactctttagcttttgtcacttttgcacgtacgagatcgccgctgagacggtcgtagtctctgtccatgtaaatatatccatccacatcaggcgcatctctgtaggtacgtccgacatatacaccgtcatccggcagttcgccttcgataaatacgtcaaactcttttccgacgagctctttgttcttctcaaatgtgatgtgctgctgcactctcatgacttcatcgtaccagagctgttttgtcacatcaggcacctggtcaggcatatcgtaggcaactgtgcccttctccctcgaataagggaaggccccgagcctgtcaaaacgcatctctttgatgaagctgatctgatcctggtgcatctcctcagtctcgcccgggaaaccgcagataagtgtggtccgaaggcagatgtccgggatcttcgtacggaggcggtttataacatctacaatatctgctctcttagtacggcgtcccatccggcctaagatgtagtcgttggaatgctgtatcggcatatcgatatagtgcaggaccttcggattcgaagccatctcatctataagctcgtcgtctatctcctcagggtaagcgtagagaagtcttatccatgcgagacctttgatctcggagagttttctaagaagctttggaagggtcttcctaccatatatatctgtaccataaagcgtggtctcctgagctacgaggataagctctcttacgccctgagctacgagtgatttcgcctctgagagaagcttttccataggaatggatctgtagtgccctctcagcttcggaataatacagtaggagcagttcttgtcgcagccttcggcaatttttaaatatgcgtagtggccgccggtagtcaggatcctgcccttatcgacaggtgttctcgagatatcctctacatcttcgacgtacttttccccttttaaaacgcggtcgagtacgtcctttacttcgtcataggagcttgctccgacgactccgtccacctcggggatctctgcgccaatatcgtcagcgtaccttgtcgcaaggcagcctgtaactataagagccttgagatttcctgtctttttaagctccgcgagatcgaggatagtgtttacgctctcctgagctgcgtcttctataaagcagcaggtatttacaattataacatcggcctctttctcgtcctcggtgatctcataaccatcggcgtggagcagggccaacatgtgctcggcatcgactaaattcttgtcacaaccaagcgatacaaaaaacagcttttttttcatgagtcactttctgatgtgctgtcggaagagttctcgtctgtgtcgtcaaaatcaagatcatctgcgactgcatctacatcttctgtatcatcagtcacgtcgtccgggttgtcctctgcggcatcagcgccagctttggccatctcctcttcctcctgctgtctggcaatggcttcggcctcctcacggcgctttcttatgatagccttgacctgctgctccttctcagcagcttcagcagcttcttcctctgtcaggatgcgaagatctccgctgtttaattccctgacggctatagaaagcggcttgtccttttcgtggtagtcgaccatcggttctttgccgtcgattatctgtctggcacgcttagcggtagcgcagacaatggtataacggctgtttacgactggctcctcgcctacgtcagttcccttgttcactaccttcataagttctacataggacggatgtatcatttaatttctcctttcgaaaatgccttgagctcttcctgtaactctgcaatctgttcagtgtttctcttcgtagagtaatgcgcactctgaatgatcgagtggactctctcgacgctgtcttctattttatcattaataaccaggtaatcatactgtggcatcagaagcgactctttcgatgagatcgcaaggcgctgcactacgacctcagccgactccgtgcccctgccgacgagtctgtttttaagctccacggctgaaggaggcgtcacgaaaagaagaagtgcctcagggaaaatcttcctgacctgaagagcaccgttaacctcgatctcaaggataacgtccttcccctcgtctaaaagcttctgtacataggctttcggcgtcccgtatgagttcccgttaaaagtggcatgctccaaaaactcaccgttagcaaccatcctgtcgaactcttcacgagtcttgaaaaaatactccctgccatcttcctcacctacccgcttggagcgcgtagtagctgagatcgacaggttgtacatccccggatacttgttcaggagatgcttcatgatagttcccttgcctgctccggagaaacccgagagcacaactagaagtcccttcttgtctgccatatcaagcctgatccttttctatagtaagccttcctgcaatcgtctctggaaccagagccgagagtatcactcttccatcagttgaaaaaatgactcccttggtctttctgccctggctggcgtcgataagcaagccctcgtctttggctttcgagacgagtctgtgaacaggcgccgaatcaggggaaactatgcagagaatcttctcggaattaacgaggttaccgtaacctatattaataaactgcatagtatgcctcctgttttcagaacataatctaatgtattatatgccaaataccctgtttagtcaaatgctcttgtcattttttgcgatagcgtttacaataataagcagtctgtaaaaaggagttttgatatgtcatttgacggaattacagtgcatgcattgaccagagaattgaatcatgcacttcagaacggccgcatcgtaaagatcgcccagccgcagcctgaagaacttattataactgtaaagaataacggctcgaagtaccttcttcttatgaatgcgaacgcttccctgccgcttatctatcttactgaaaaaaatgaggtctctccattgaaggctcctggctttcttatgctccttcgcaaatatataggaagcggcatcatagaagaggtttcccagccaggccttgagagggtgatctgcattcatataaggcatttggacgagatgggcgatgaggctcacaagaatctctatatcgagatcatgggaaaatactcgaacatcatatttactgatgacaatggaaagattttagactctataaaaagagtcggcgccaatacgtcgagtgtcagggaagtcctgccgggaagggactattttattccggcgcagaaggacaagtacagccctttcgagatcactgagaccatgttctatgaggacattttaaagcgtccgatggagtgtgcaaaagcaataagttccggagtcgtgggtttttcctatgtcacctcaaaccagctctgccttatggcatcggtcgacccgggagagtccacggcagcacttacctacgatgacagagacaggctgtatcagggatttaagacgcttctcgatacgatcgacaataaacccgcagagcctgtcatctactctgacccggtaaacaaaaagcctctcgaattttcagcctggccactcgaggcgtacagagactcagactgcaggaagctttcttctgtaagtgaaatgctttacactttttacgcttcgaagaatacctattcgaatatgaaacagcgctccgcagacctcaggaagaatgtgaaaaatctcctcgagcgcgagtcgaaaaagcttaacatccaggaaaagcagctgaaaggcaccgataaaatggataaatacaggctctacggtgagcttctgcacacttacggctattcagtcccggagggcgcaaaggagactgttgtgacaaattactacacgaatgagccgttgactatcccactcgatcctgaaatgaccgcgatggagtgcgctgagaaatatttcaaccgctacaataagctgaagcgtactaaagaggccgtaactgttcagatcgaagaaactaagaaaaatatcgatcagctcgactcaatcctgacttccctcgatctcgccgaggatgaaggtgacctctctgagattaagacagagctttcgaatgcgggctttattcacaaatcctcccgtaccaggaaggaaaaggacctgaaggctgaacctctgcactttgtgactgaggatggttttgatatttttgttggaaaaaataacttccagaatgaattcgtgacgtttaagaaagctgatccggatgactggtggttccatgcgaagaaagttccgggttctcatgtcattgtgaagtctggtggtaaagaattgcctgacgatgtttttgttatagctgcacagattgccgcgtactattccaagggccgggacaacgaaaagacggaagtcgattatgttaagcggaaggaactaaagaagaccaatgggggcgcgccggggttcgtgatctaccatacgaacttttcaatgactgtgcacccgcaggttagcggggtgaagaaggtgtgagtgaaagtcggtagtctggcggcgcggatggacgagctgctgaaagtcagaagccgggtgcagatggacgagctgctccttagaatttttctgttctctcgcgcgcgcctatttgcggccttctggccaatgtatggttttgatgcgtttatggttttggcgggtggccacccaggccgcagctagcgcgctcgctcactgcgaaaaattctaaatgtcgcccgctcgtctcatctgcacccggcttcctcttaacccagtatctgtacccggattcctcttaatcaagcatctgcgcccggcttcctctttaacccagcatctgtgctcggcttcctcttagatctgcggagctgcttgatttttaacatacgacgatcttatgccattcagctccaaatcggaataacttccggctccgcggagctgcttgatttttaacatacgacgatcttatgccattcagctccaaatcggaataacttccggctccgcggagctgcttgatttttaacatacggcgatcttatggcgttaagctccaaatcggaataacttccggctccgcgttacggtggattatcaacatagggtgattttcaggcaatctggaacagtggctttcgaaaaaactttaacatggatcggggaggaagctaaatgtgacaaacgaattttggaactatcaatatgcgtgagaagctacacaatctgctccaaatctcattttttgcgtctcaacatagaacaaaatttttttgattagctccaaggccttggagctaattagttttatatgaagtcatgttgataaatcaatatttttataatataacgatgctgaagatgtttggtgaagtttcgcaatgatgaagtccatattgagaatcccgtaattgcggggaatttttaatattttaataatgcgatataaaggcaaaaagtcacgcgttgtccgcttgcagtcagatagaaagattacatccaaacgattcatagaactatctggattaaaaaaagctacattttacaatctcatgaccgagtacaagaaaattcaggaggcaaaccagcattatatcgaaagatacaattagtagtacaattttgtatatcttctgttaatacaggcgcctccaccggcatattcttgtctttattatcttactctctggatgatatatggtgcgctgccctttttctggcaaagggtgtagactgaaaagccattccagcggtaaactttctcttcgccaccttctatctcacagctgcttgaaacagcggttgacgcaggctgtccgatttgtgcgatcaggccctgtacatcttttccgatatactgctgggcaacggattttaagttggtctttttttctgcctcatttttctgagcggccttctttttggcttctgcagcggcttttttcttagcctcttcggcggctttctttctggcttctgcggcggctttcttcttagcttctgcggcagcttttttcttagcctcttcggtggctttcttcttagcttcttcggccgctttcttcttggcttccacatcggcttttttattggattcagcttttgacaatgtggttactttctgctttacctcaagagtttcctttttctctgctttaggcttatctgcttttgcttcctttttggagtcattctctttcgtatcagactttttatcatcggtcttttctttgtctgacgaagagtctttgctctcttctgaatctttggatgtatcggagctttcgtctgctttagaatccgaggacgcagaagtgctctcgtctgctcctgaatctttagctgtggaagaagcctcagatgaagccgtcatggcctgtttactagttccactgccgcacgcagctaatccgcaagccataactccaatcaatgccaataatgcaagtcgtttcatttttttcatcctttcatttgtaatgttagtttttactatgatgcgatctttacagacgtcaaatccttagacctgaaaattttatcattcatgtcaagtgctgccgagacctgataatccccagaagggatttctttcgtgtctgcatacagtgcaaatccatcctccgggtgttttttatctttagatccttcactcacgtggtaagcttcatacagatagccgaatccagcctttttattgtagaggcttatatagattttgggatcacgctttgcattcttcgaatccagacttccttttattttcaaatagccggattcagcatcggactccaaatgcactgcgggtttcagactgttatccctgtcttccggcagaagaactttactgcttatgtcttttgaggccagcacaggcgcattttcctgaagctgattcagatttctctcaaccagctctactataacggtatcagccttgtgctttccgtaggctttaaagacctgatacggaaccagcctggaaaagtatcccttgccgtactcatccgctgtaaaaggaagaagcgaatttccaaaagagtcgcggaacattacgactgagccatttttcttcgggttcgtcgtagaaatgatcgaatcgtaggtactgtctattttattatcgtatgtataatcgcgctttttgctgtagtaatattcgcggtctctccagtccgaagtcggatagagcatatggtacagatcgccacgaaaatcctgacgtttttcgacggaatatttggaatagtccgtgctctttctgccggcagccgacagaagagctttgtttaccattgctgctcctctgttgtcccagtgagaatctgtcttatgatatagtacctgcttctgacttttaaagagctgatacagatccacataatttacatcacttttctctagaagtgcacgcattctggtgctgtttctgtcagacggctttatcctgtaaccggaaggcatatactgctgatagagactgtttttatttggagctatggcaaatacgaatttcttgttgtccgccttaagcgtcttctgcatcaattccaggttctctactgcctctctgacctgtaaatccgacatagtcttctttccgaggtaatcgtccatcgaagatccgtagaacaaccagccgttttttccaagtaccacattggactgggaagacgtgtgaaataatgcgcttttaatcttcgcatcagctgtgaccagattctggcgaaaagcaaaattataagtgaaataatcaccgagctgactgaaataatggatattcagcgtgtttttcatggatttctcattataagtcacgatagatggcatcgcaaccattgcctcttcactctccgcattctgtcttcctcctataggaaacaaaacgataggaagcaggattacgacgatgaaaatgattatatatacaattttacttattttttttctcatttccatatttttccccgtatcagaatctgaagtaaataaatggattgtaagaggcgttcgcaatatttaatacacagcctgccagaagaatgagactgagtacataggaaagtcctcttacaactcttgtctgcttctctccggcatttaaagcccagctgtcaattgattttaggattgggaagcatgcagccaccgaagctgccatcatcgtaatgacataagggcttaaaatctgatgcaatgtattatatgtcgtaagatttcctgatccgccggcaaacattgcggcaatcatcacaccaccatctgaaagcgtgtcagcgcggaagaaaacgaacgctacagttacaattataatggtataaaaccatcccaaaaaacgactgaacggaccctttcgcctggtaactttaccatttctctcgcggaaatactttacacagtcttccgccacaagcgagataccgtgaatcatgccccagaggacaaaattccagctggctccatgccaaagtccagtaaaaaagaatacgatcagcttgtttacttcagtgcggacttttcccttgcgatttcctcccaatggaatatagaggtagtcgcggaaccaggtggacagagagatgtgccatctgcgccagaagtcctttatgcttgtcgcaatatatggatgatcgaagttttctaagaatgggaagccaaacatagccccaagtccgatcgccatatcgctgtatcccgagaaatcgaaaaagatctggaacagataggctactgctccaagccatgcggctggagcggacaagtctgacttcgggagggcgaaaaccttatcagccacaagccccatagtgtttgcgagaaaaagtttcttcgacagtccaagaataaaacgtcgaattccacccgccacttccgctactgtctggtgtctgctgtccagatatttataaatatcgtggtattttacaatcggtcctgcaatcagctgtggaaaaaaagaaacgtacagcagaaccctggtaaaccgcctctgcaccatcgatggatcgcggtatacgtcgataacatatgagagaacctggaaagtaaaaaatgatattccgatcggaagtgtaatttcaggcaccggaatattcattcccgtaacctgatctatcactttaaccgcaaatccagcgtatttgaatacacctaaaaacgccagatttgcaattacggctattactagaaatatttttttattcttctcaaagtctgcgataaataccgcaagaacccagttgacaaagaccgaggcaatcatcgcaagaacaaataccggctcaccatatccgtaaaaaaacagactcgctaaaatcagcaatgcattctgagccttgatattccgaatacaggaatagaggatcagaacgattggaagaaatatgaataaaaaaggtacagaactaaagaccatgagttttaagttcctctgttacagttaatctgataaggtaaatgttttatttacctggtattctgagccctctgaatcccggatttcatcataagtcttgtagaaatactggtttccgctcttattattgacatcgtcgtagcagctgtccagaacatactggtcatttacaacaacccacgcatgctcagttttctctccaccggccgaacgggctgccactcctgtctcaaatcttacattaaatccaagtgcatttgcactgagtcctgtaagggcagcgtagttgtaacattttgcgtcaccgtatttaaacatgttataagcacaggtatagatccactgattcgaactcagatctgctggatctgaaatcgtatagttatatttattgagaatgtaattatagaccacactaagtttctgatcctgcgtcatagaattactaagctttgcaccctcgatcacagaagcgactgcctgattgccttctgtgttaccgcaggaaataaatccttttccagtattcgagaaatacagggttttaccactgactttttttgtcttatttacaagcgcaggtgctttgccatctttcgcttttgagaaataatacgtcacaccattgagctgctttgagcgtaaatggtagataacccgtcaccttcaaaaaaaattcttgacgcgttactattaaactttgaccttcttcaggttccataagtttcaaaaattccagccctttcgggctggtttattcttgcttattttttctttcggcagatctccggtattgattctgaccacggcatgagtttttcaagttcatcgcctggaaccttagcatggagcggttgttatgctgccgcgagcccgaagggcgaagtgggagcatataaaccgcccatgcgatagccgtccgcgattggcgagcccgaaggcgaagacagagcggaaacggcgaaccggctgcagctttatgtcaagtgttttttgtgataattttgcagaaatctgcgcatgaaaaaaagccaggaaagccgcaatttacgggctttctggcttaggttgaccacgttggtgccaggcactgttaagagggattcataattccgataaagtctgtataatggtgtaaattaaaaaaataagtttactttcccttaaggtgaagcaacattgcaaaagccccatgattagtgtataatattacgtgctgattttttggaaagttttcactttataggaagctgttaagcgtgaagaagtgagttatcaattcaaaacactgcttgtagctcataaaacaaagttttttaaggagatatataaatctatgaaactgggaatcgtcggcctcccaaacgtaggcaagagcacactttttaattcactgaccagagccggggcacttgcggccaattacccatttgccacgatcgacccgaatgtcggagttgtaaacgtccctgatgagagaattgagaaactcactgagatgaaccacagtaagaaaactatacctgcggtcattgaattcgtagatatcgctggactcgtaaagggcgccagcaagggagagggccttggaaaccagttcctcgcaaatatccgtgagtgcgatgccattattcacgttgtacgctgcttcgaggattcaaatatagtccatgttgatggaaatatcgatgcgaagagagatatcgagacgataaacttcgagctgctctttgcagatatggaagttctcgaccgccgttatcagaagatcaagaagcagtcgaatatggacaagtctttaagaccggaggtcgctcttatcgagcggctcagaccattcctcgagaatggcaatatggcaaaggcttttgagtgtgagaatgaagatgaggaagccattatgaagggctacaacctcctgaccgcaaagcctacgatctatgccgcaaatgtcgcagaggacgacctcgcagacgatggagcatcaaatgcccaggttcaggctgtaagagagtgcgcaaagaacgatggctcagaagtcttcgttgtaagtgctgagatagagcaggagatttcggacctcgacgatcctgaggagaagagggaattcctcgctgacctgggattaaaggagtcaggacttgacaaattagttaaagaatcctattctctacttggacttatctcatttttgactactggagaggatgagaccagagcctggactataaagaaaggcacgaaggctccgcaggcagcaggaaagatccacacagatttcgagagaggatttatatgcgctgagaccgtttcctatgaagacctagtgaagtgtggttctgtggcagcagccagagagaaggggcttgtccgtactgaaggaaaagactacgttgtacaggatggagacgttattctcttcagatttaacgtatgaccgtcatcatgtagatgagaacgagctgaagacgaagttcgaattgaagacgaagttcgaactgaagacgaagttcgaattgcatgcgaagttctaactgcatgcgaggccgttctttgagattaatgagagcgagtgaaaacgaagctcgaatttagagaaaaggacttccttaaaagctttcttgtaacagaaagaaggagtagaaaaatgaagtgcccatattgtggatcagataataacagagtcatagattcgagacctgctgatgataatacttctatcagaagacgccgccactgtgacgactgcaacaagcgctttacgacttacgagaaggtggagactatcccgcttattgtgataaagaaagaccgcggtcgcgagcagtacgacaggacaaagatcgagaagggtatccttgcagcctgctacaagagacctgtgtcagcgatgcagatcacgaagatgataaatgagatcgagcgggatattttctcaagagaggaaaaggagatcgaaagctcactgatcggcgagatcgtcatggacaagctgagaaatgtcgaccaggtagcttatgttcgttttgcttctgtttaccgcgagttcaaggatgcgaatacgttcatgaatgagctgaaaaagatgataaacgagaagtaatgtgatttgttttttgaaaaaaacattaattttttcgatatctgccgatatagagagtgaaggagagagaatttaagtgaggcgatagacatgaacatatcagctgtttcaaatacatcacatatcagggcgcaggaattcaacgccatcagaagacagaagccggtagatgacgatattgcagctgttacgaacgcctattcggacaactctaaggtcactgccagacagaatactgagtcgaatgctgctcagtcgaagaagcaggaggagtcatttggtgcttacgattacgccaagctctatgacccgaacaagactttcgatttaagcggacaggatctctcagacctcgatgcagttggtactttaggccagctcagaaaggacgaactgatgggacagtaccagaatctcacgaagcagaccactgcttctgttcgcccggaagagaatttcagtctttaaattctacgatcgccgtctttgacggcgatttttttgcaatttttttctcttgcaattagtgatactataatgtaaaatatatgggtaatttttgaaaagacgcaaggaggttttttatatgatttcagccggcgattttaaaaacggcgttactattgagtacgacaacggggtttaccagattattgaattccagcacgttaagcctggaaagggtgcagctttcgttcgtaccaagcttaaggatataaagaatggcggagtcatcgagacatcgttccgtcctacagagaagttcccacaggctcatatcgacagaagagatatgcagtacctttacaatgacggtgatctgtactatttcatggatacagagacatacgatcaggtttctatccctaaggaagagatcggagattctctgaagttcgtcaaagagaacgagatggttaagatctgctctcacaatggagacgtattcgccgtagaacctcctcttttcgttgagctcgaagtcacacagactgagcctggacttaagggtaacacagctactggagctacgaagccggctactgttgagacaggtgcagaggttcaggtacctcttttcgtaaatacaggagataagcttcagatcgatacccgtacaggagagtatctgaagagagtctgaaatggagatcgattaaatgcagtatgagaatgttcctctgaaggatctgctttcagacaggaaagtgtttggtattttcgacgaggaatttcggaatggaggctggctcgatgttacagcactgcttgattcagagagcctgtttcgtgacctgtatcaggacggcacagtccctgagagggttctagaccggataagacaaagactgactgatttatagagattaaagttgagggcgctctgggcgcccttttactatgctatgagtattttttcaagaaatagaactaaggaaataacacttaatcaggccataaatatcacgaggacgacaacgaagaccgccctcgtggatatcagggacaaggaggtattcaagaaagaccatgttcctgatgccataaatattccgctgaacaacatcaaggtcgtccacaacaggatcccggatacagatacgactctttatatttacggcgattatgagacgaggcctaagaagtcgataaaggctttcaggaacgaaggctacaataaccttgtaagggctggctgtctggaagaccattatataagggagtacagataatgactcgtacaccaagagaatggaaagatttttatctaagtagttctttttcatcaaaatacgattatgatggacagctcggtgctttcgcggatgagcgcggtacgacgtttactgtctggagcccgtgcgctgtgaatgtttcgctgagattcttttcacatggttcgcaggaagaggatggcacagatatcgatgttccggtcatggtctatcgtatgcagcccgggaagaacggcgtctttacccttcacacgagaaagaacctgtccggcacttactatgactttgagatcgaacacgaagacaagacagtgaccacgcctgacccgtacgctaaggcctgcggttcgaacggaatgcgaagcatggttatcgaccttcgcacgactgaccctgagggctgggaagcggacaaacctcctgcaaagacagacgagactgtcatcagcgaagttcatgtcaaggatttttcgtgggataagtccggaggattcccggatgatgtaagaggcagatacctcgcttttacgaaaaataagacgtatctcaacggagatgacaagtcttttcggaccgggctttcatatttgaagaatctgggagtcacacatatccagctgatgcctgtttttgattacggaagcgtgaatgaggctgattcgttcgcatttgacctcaaaggctcgaagaacggagaaccttttaactggggctatgacccggtgaattacaactgccctgagggaagctattcgagcgacccgtacgagggcgatgtcaggataagagaactgaagagcgcgattatggccattcacaaggctggtttccgtgtcataatggatgtcgtctacaatcacacatacagtctcgaggattcttcattccagaagaccgtaccgtggtattattatcgcattgacaaggacggaaagcctgcgaacggctcgggctgcggaaatgatttcgcatcggagatgtatatggcacatcgtttcataaaggattcagtgctctactgggccagcgaataccatatggacggattcagatttgatctgatgggacttctcgatacggatcttatgaacgatatccaggcttctctcgacgagatatacggcagtggcgagaagcttgtctacggcgagccgtggggagctgacaactccagtctcgagggaaaggctcacccatcagacaaggctcattttaaagagcttgatcctgagatcggtatgtttaacgactgtatcagggattcggtaaagggttctgtctttgaaaagcatgagccgggttttgccgatggtgataaggatgcttctaagcttgtgaagggtatcctctctacaattggcgggaaagattttccggtccagaatccgggacagagcattacatatgtctcctgccatgacaatctgacactttgggacaagctctcggaagtgaactggcttaagccgaccggggatccggagaagaagaggcttgcccagaacaggctctgcgccgcaatttatctgatgagtccgggcagggtatttttcctgtcgggcgaagaaggcgcgagatcgaagaacggtgatgaaaattcgtacaacgcttcgatcgaggagaatgccatcaagtgggacgagctctacaggcactcggaccttatagaatattacaagggacttataggattaaggcggtccctgccgctccttaacagaaaagatgctgcgttagcagaggatttcagagtcacaggcggatcttgtgattcgcttccggatggcctcgtgctcgttcagggcggagacgaaagcggagagatccttatgatcttcaatggctcgaatctttcgcagcttatggctctgccatcgggaaagtggcagctctgtgtcgatggagacagatcggactactggacagaggacgagccggttttagctgatgaaaaaatcgaatcggagccgatgacggcgatgatttttaagaagataaccgaggaggcaaattttggcagacaagaagaataaaaacattatcctgaccggggacagacctacgggaaagctgcatttaggccactatgtgggatcacttcgcagaagagtcgagctgcagaacagcggcaaatttgacgagataaatattctcgtagctgatgaccaggcacttacggataatgctgacaaccctcagaagatccgtgacaacatgatagaggtcgctttagactatctttcggtaggcattgatccggataagacgaatatctgcgtacagtcgcagatcccggctcttcacgccatgactttctactatatgaacatggtaaccactgagcgcctttcgagaaatcctactataaagaacgaaatccatctccgtggtttcgataaagccggaagcgatggacttcctgcgggatttttcacatatcccgtttcacagactgccgatatcactgctttcaaggccaactgcgttccagcgggcgaagatcaggagcctatgcttgagcaggccagagagatcgtaagaagatttaatatgacctacggcgaagttcttgtagagcctaagataatgcttccggattcaaaggcggctcttagacttcctggaatcgatggcaaagagaagatgagcaagtcgcttggaaatgctatcttcttatcagatgatgctgcaactcttaaaaagaaagtcatgagcatgtacacagacccggctcacctcaatatcgccgatccaggtcatgtcgagggcaactgcgtatttacttatctcgatgcgttcagcaccgatcaggacttcgagggcacagactacgcgaacctcgatgagatgaaggaacactacaggaagggcggacttggcgacgtcaagtgcaagaagcttctgatcaaggttttaaaccgtatactagacccgatccgcgagagcagacacgaatgggagaagaaaatcccggacgtttatgatatacttaaggcaggcacagctcacgcggttgcagagacaaacgagacgctgcacgagatgcagaaagtcatgaggataaactattttgacgacgactctgttatcaaagagtggcaggattggattgagaggtaagaatggcattaaagaaaaagccggtcaacggaatgaaagatattctccctcgtgagatggagatcagggactatgtgaccggtatcatcaaggatacatacagaagctttggatttactcctatcgagacgccgtgcatggaggacatcaggaacctgacaagcaaccagggcggcgagaacgagaagcttatttttaaagtgttaaagcgcggtgaaaagcttcacctcgaggacgcgaagaatgatctcgatgtctcagacttaggactccgctatgatctgacgcttccactctcgagattctacgcaaacaacgagaacgacctcccgcagcctttcaaggcacttcagatcggaaacgtctggagagcggacaggccgcagagaggcagatacagacagttcacacaatgcgatatcgatattctgggagagccttctgatctggctgagatcgaacttatcctcgcgactacgacctgccttgaccgaatcggtttcaagggttttgagatcaggatcaacgagagaagaatcttaaaggccatggctgattactgcggctttgatgaggacagatacgacgagctcttcatcactctcgacaagatggacaagatcggaatggacggcgtaaaggatgagcttatcgaagagggctttgatgctgcctctgttgaaaaatatctcaatatttttaacgagcttcagggaaaaactgaggtaaaggatggaattgatacattggtgtctatccttggcaacaagctcgacccatcggtagcatccaatatgaaagaaatcgcagagaacgtaaatacctgcaagaccgctgatttcaagctggtattcgatccgacactggttcgtggcatgggctattacaccggcactatttttgagatagctatccctgagttcggcggaagctgcggtggcggcggcagatacgatcacatggtcggccgctttgcggggcacgatgtaccggcctgcggtttctcaatcggatttgagcgtattattatgcttctcttagagcacgatttcgaggttccgacaaagaagacgaagacagccttccttatcgacagaaagctcgacagttcaaagctcccggcagtttttaaagaggcaaacgagcttcgtgcgaagggcgatgtcgtccttattgagaagatgaagaagaacaaaaaattccagaagcagggccttatagactctggctatactgagataaaggagttttacaatgacacaatcgagaactaatacctgcggagagctgcgcatcggagatgtcggcaaaaaggtcacgctctgcggctggctcgaaaatgacagggaagtcggagctggactttctttcatcgttttgagagatttttacggtgtgacacagatcactgcagacacagaggagatggtaaatacattcaaggccatcacaaaggagtctactgttcaggtcacaggaaccgttcgcgagagatcttcaaagaacccgaagcttcctacaggagagatagaagtagtacctgagtctgtcaaggttcttggaaaatgttcccacgattcactcccgttcgagataaaccacagccgtgaggctgatgagagcgtaaggcttaaatacagatacttagacctcagaaatcctgaggtgaagaacaacattattttaagaagccaggttatcagggctctgcgtgaggctatgtacgatcacggatttatggaggttacgactccgatccttacagcctcatcacctgagggcgcgagagattatctcgtaccagccagaaagcatccgggcgagttctacgctcttccacaggctccgcagcagttcaagcagctccttatggtgagcggattcgacagatatttccagatcgctccatgcttcagagatgaggacgccagaggagacagatcgccgggcgagttctatcagctcgatatggagatggcattcgccacccaggaggatgtgttcgcggtttgcgaggatgttcttccgcctgtctttgagaaatttggcacctacagccgttcgacaaaagctccgtttgtacgtataccttatcttacagctcttgaaaaatatggcacagacaagccggaccttcgtattgacctctctgctgctgacgtaacagagcttatgaaaggcctcggattcggaccatttgacgcagagggtgtttctgtaaaggcctgcgtgatctcggatttccacgagagcagaaaatttatcgacaaaggctgctgcgatgtagaagtgataagcggcgccaagccttactggttcagagtcgatgagaatggcgagatcgccggcggcatcgccaagtttgtaaagccacaggctgacaggataaaggaggctttgggacttaaagagaacacgctcgttgttctctcctctggaaagctttcacaggcccagaagactatgggctcagttataaagacatttggtgagagagttccgggacatatggacaaagaacagtaccagttcttatggatcgtagacttcccgatgtatgagatcggcgaggagtcaggcgagcttgagttctgccacaatccgttctcaatgccgaagggcggccttgagacacttgagaaggcggagagaggcgagatcgatcctcttacgataatggcagatcagtacgatctcgtcgtaaacggcgtcgagctctcatctggagctgtcagaaaccacgatcctgagatcatggtcaaggctttcgaactcgtaagacttaccgaggacgatgtgaagcagaagttcccggcactttacaatgcgttcagctacggagcacctcctcatgcgggaatcgctcctggaatcgaccgtatggtaatgcttcttgcagccgaggactctataagggagattataccgttccctatgaacaaaaatgccgcagatcttatgatgggtgctccgggcaaagtcacggacaaacagcttgaggagcttcatataaaggttacagagtaagaaccttacagtgtccatttttgtgaggtggaaggagaaacgattacatggatggagaatttcattttaacaaacaggaaaagaagtacctgtcagcgttcccagggatgctggttatttttcaggtacttgacggtatggacagagtcattctggcaagtgacaacatgctcgattccatgaacctgacgtatgatgagcttgccacttatttcatcaatggattcaaaccgctgatcaggtacacgccgcttaaaggcgagactcagtattttgccggaaaatctgtgacacagaagagaaagcgtgcagtactccgctatgtgacgtatgccgacgtgacgaatatctacaacaagcttcataaattggaagaagattcgtcgggtcaggactttgtatataagcagatcttagatgctataccgacaggtattttctggaaggacattgatcgtaaatttctcggggcaaacaaggcgtttctcgacgcctatggctttagttcagaggatgcgatcatcggaaagaccgatgaggatatgggatggcatccggaacctgagcatttcaaaaaggttgaagaggaagtgctttcggagaaaaagacaaagacagcccgcaccaagaacctgatccagggcagggagagagacatagtcgcccttaagtctcctttatatgacaaggatggaaatgtaagcggcattgtgggatcttttatcgatgtgactgaggttgaagacgaggattaaaaaaaggcaccggggttccggtgcctttactagtgcgttttttggcaaaaaaaaggaagcatcccgggggaggatgctttcaaaaaggggggttataaaaatataaaaggggaaatgatttaaggaatctttgaaggggttcattccttaagtctcttatagtataatccggagaagccttttttgcaatagtcaatccaacaaatttcacaaaaatgacgactgatttttgtgcaactttaccaaaacaagtgaacccaatataaaaaacgatgattttttggcagtagtttgctaaaatacctgtatggaaaatttaaaaactcagctcgacaatctgaaaaataacactgatctgcgccagacactttcgaccattagaaagacattgaaggaagacgcgggcgtaaagaaaactatattaaatgacagggaagctcttgaagcgatactggggtgccttaaagcggacgacgccaagtcccgcaaatcggcggcacttcttctgggagaactctccctggcctcggatgacgccgcaagggcggcgctaatcgatgcataccggagtgagacgacactttttgtaagagagagctacctgaaagctcttgcagtgggcggcgggaaggaaaagctctccgaagacgagattgaagcgctgcgggagcgcctcagggagatagactcaggcaggtttgaagaatccgatatgaagcatatcttagctgagaggaaagcgattgcagcgctgcttccgaaccagtccaggaagagagctttattttctgtgccaaaggactcgatggtcctgatggtgccgcagaggcgtttctatgagactttaaaaaaggcactgaatgaacgcggaatcgaaaaagggttttctccgctgggagttctgctatatccaaatgatatagcaggtgtcagggatcttcgcatttatgaccaccttgaatatatcatccccggtgcttttacacttgaacctgaaaaaacaggtcaggaaatccgtcattcggctattgcatcatttttagaaaaagtttataatggaaacgtttccgtcagagtgcgtatccatgagactggagacagggccgaaaagcaggtgaagcgattcacaggagagcttttaaggtcatctggcgggaagttcttgaatgaacccccttatgatacggaacttcatttttacaggaagaagtcaggcggttatatgctctttatgcggccgcttgatgcggatcagaggtttgtctattgcagaaaccggttgtccacatcgatgcagcctgtaaaggcggcacttatggcctacatgttagatgactgcctgagttcctacgcgagagtatgcgatctctttgcggggaacggaacccttctgcttgagcgggacgagctgcttcggacaaaggtgatgtttgcgctcgatacgaatgcggatgcgatcgaagcgggcagagagaacgcctcactcaagggcagaaaagtaaacttcgtccacagatcggcttttacctttgaaacagaggagcctttcgacgagataatctcggagcttcctgacctctttgaaaaagaagagtcagacaggcaggagtttttcgagaagctcgcgaaagagagtgtgaagattttaagagatggcggaaaggccttttatctgacttccgagggaaatgagataaaagccatggccaggagatcgaaaaacatcgaatttattgacgagatgccgtttgatgagagacgcagcatttttatattgaaagtagaaaagtaaagaacacaatgtcagatataataagtgatttaacagacacactgagagaattcttagagatcgagcagatttcagcctgtattttacaacgcggcagtaagaacgtttttgaatattttactgacccggatcaggagaaatatttgagatcgcagatttctgcagacgagctcagaaatgcagcgtcttcatttgccgattacgatgtcgcagatgtaagcgatatccagatcggcgagaacgggaagatcaggggacttgccatccgcaatccggatggaaaagtgagatttgtgatcttcctttttacagatggcactgatgatacgcagttcgacaggattacgaaagtcttatcggagagtctcaccacatactgcaatctgaaagaagaactctcacaaaggactgacgacatcaggaaaaatcgcgatgacatttcaaggctcgagagatcgagacggatgtttaagtccctttccaagctgacagaggatataaatttcaaggtaagctttgacagggcggctgacgatatcataaagcagtcgatgctgtgcgtagatccggatgtctcacttatcgtaaaggaagatagtggagtggcgcagatcataaagcaatccgggagtgccggaacggcttcacttggatcgcttaatggtatgcctgtatctgatattccattcatggatggaaagacctataccatctcctcagattccattatttcaaatgaatttaagcagttctttgcgaagtgcgggataagtgccggcattttcgtgtccattggaagtactgaagacggactctacctttgcttcctgaagaaagattctgaaaagacctggcagagcgacgagatcagttttgtgcgccaggcgggagaaatcctccggacgaaagttgagttcgccggactttcgaatgctgtagcagaagcagatgattttataaggacggtatttgacaattcttcttcggcggtggctgtttttgatgcgtcgaccaaggaagatctgtatatgaacgaggctgcaaaaaagctttttgaagactcattaaacgacgagcttttcagaaggcagttccttatccccggaccttctgaggaccaggataaaatgacaggagagttcgcggcttcaggcaccggagatatttaccaggtaaatatgacgagagccagccagcgcggcggtcttaaagtcttagtctttgcgatctcagacatcacgaaacagaagcagtatcagaagaaactcacagagtcggccgatatcgacgatctgaccgggctttacaacaggcaccgttttcacgctgattttgagacatgcataaatgacgcaaagcgcggacaggggatggggtctctgatacttttagacctcgacgatttcaatgagctgaatgacggacttggccatgtccttgcagacaaattcttgaaaaagacggcctggtctatccagcagatcgtaagaaaagaggcccagtgctaccgtgttggtggagacgagttcgcgatccttattccttcttcagatatcgaagagatgaaaaagctgatgcagaagatccagagccgtttcgaaaagccgttttcactggacggaaacgactactactgtacagctggaatgggcgccgtaaatttccctcaggatggtgacgaggaggacggtctgctctcgaaggcggattttgccctgcacgaagccaaggccaagggcaagaataagtctgatatttttgcggatgtagagataaaaatgccgccagacaggcttaatgtcgagaaggcactgcgcgaggctgtggcagacgactgcagggaatttctcgtgtactatcagcctgttgtcgatatcacaaacggagagagcagatgctgcggcgcggaggcactggtgcgctgggattctcacaagctcggctttatgcctccatcaaaatttatcccgatggcggagtatttagggcttattatcccgatcggagaacacgtgctgatcgaggcctgcaggacctgccaccactggaacgagtttggacacccggagtacaaggtaaatgtcaacctctcagtcctccagctgctccagaacgatgttgtgcatacgatagcgaatgctcttaaagtgtcaggcatagaaccggacaatcttgtcctcgaagttaccgaggggatggctataaatgacatggacaagataaaaagagtcctggaggatatccatgagctcggagtcaggttcgcgctcgacgattttggaacaggctactcgtcgctttcacacatgaagcagcttccgcttgacgagttaaagatcgacaagtgctttatagacgatatcgattctgacagctactcggatgccttcgtgcgctcggtctcacagctggctgatgccgtcgacttgaacgtagtagtcgagggagtcgagcgtgagaagcagcaggacgtccttaagaatatggatgtcgatatgatccagggattcctctatgacaagccgctgccgaaggatcagtttgagaagcgctggctgtaatagtccaaaaataaggattttttgaaaaaatataaaaaaatgaaaaaaaggcttgacattcgacagggcttttgatattataatgaagtcgtcgcgagagagatcaaaacggagacagaatttaatagctgcggaagtgtcggaactggcagacgagcaagactaaggatcttgtgatagcaatatcgtgagggttcaagtcccttcttccgcatagatttttgagacatccggtgccgaaaggcgccggatgttttttatatgatctggcatcggaggcgtgtgcatgaggtagttacttaagaaaaaatgcttgacatgttttcataaaaagagtaatatatgatgtatccgtgtgaacggagcagaagcaggaatggcggaattggcagacgcgcaagcttcaggtgcttgtgatagcaatatcatgagggttcaagtcccttttcctgcattattttttaaggaaaggagcggttattttcagataatccgctcctttgttgtcttattttctttgaaggtggctttttggacaacgaaaggggatatgcttatgctgatcagagagaggctggagcagatggagaaagaggagctttctccgtatgcgactctggacaccgaatccaggggcagggacagagaggagaagcagtgcgacatcaggcctctgtttcagagagacagggacaggatacttcacagcaagtcgttccggaggctgatgaacaagactcaggtctttttgtatccgatgggtgaccattacaggacccgcatgtctcatacgctcgaggttgcgcagaatgccaggaccataggaaaggccctgagacttaacgaatcgcttatagaggccatagcactgggccatgacttagggcatacgccttttggacatgcgggggaagctgtccttgattcagtggcgaaggacgggttttcacattctgagcagtcagttcgcatcgtcgagaaactcgagaaggacggacagggcctaaatcttacctgggaggtccgtgacggcatcaggaaccaccagacggaaggccatcctcatacgccggaaggggcagttgtacgaatttctgataaaattgcgtatatctacgcagatgtagacgatgcgataaggggcgagatcattactgaggaggagatcccgaaagagatcaggaacactctcggcatgaatgccaaggagagacttaacactatgatccacgatgtggtcatgacgagcatagattccccggatatcaggatgtcggatgagatccgcgaggcatcgcacgacttaagggcatttttgttcaggaatgtctacaagaatccgaaggcgaagggcgaggaagtcaaagccaagaggatgataaagctattatttgagtattacaacgatcacccggatgcgctgccggagaagtactacaatgctatcgggcgcaacggagatacgcaggagaggatcatctgcgactatattgccgggatgactgacagctactgcagaacgaagttttcggaatttttcgtaccaagggcctgggaggtggacggttattgagtcattatgatcagaacaccatcgaagaggtcagacgtgccaatgacattgtagaagtcatcggcgaatacgtccctctgaagaaaagcgggtcgaactattttggactctgcccgttccacagtgagaaaagcccttcgttttctgtgaatccacagaggcagatgtaccactgctttggctgcggtgcgagcgggacggtataccagttttatgagaattacctgcacatgtccttcccggaggctgtcagggcacttgcacagagggctggcatcactttaaaggagagcgcggatacgccggagcagaagaggaggaggcagagacgtgacctgctcctcgctgcacagaaggaggcagcgtattactactattcgctccttcacagcgaccacggaaaggcctgcctcgcatattttaaaaagcgcgggctgtcagacaagacgatgatcagtttcggactcggctactcggatgctttttcagatgatctgtacagacatctaaagaaaaagggctataaggacgatatattaaaagatacaggtctttttacgtttgacgagcgtggcgttcgggacaagttcttcaacagggctatgtttccgataatggatcagtattcgaaggtcataggctttggcggacgtgtcatgggagacggacagccgaagtacctgaactctccggagaccgagatttttgacaagagccatacgctctacggactttttctggcgagaagatcgaggagagggtattttatcctctgcgagggatatatggatgttatagcgctccaccagggcggttttgactgtgcggtggcgtcgcttggaacttcccttacgaccggtcaggtgtcggtcattagccgctttacgaaggatgtgtatctctcgtatgacagtgacggggcaggcatcaaggcagctttgagggccatcccgatgtttagaaaagagggcatcaccccgaggataattcatatggatccttacaaggacccggacgaatttataaaggctgtcggttcaaacgagtaccagaagaggatagatgaggctgagaacttctttatctttgagataaggcagcttcagaagaactacgatacgacagacccgggtatgcggacagagttccagcgggagatcgcgaagaagctctgcggctttaaggaacagctcgagagagacaattataccgatgctgtctgtaaggagtttaatatccctgtagaagccatgagaagcctcgttaaggagacggcggcacaggagattataaagacttctgcaagagccagatcgcgttacagcgcggggaatcaggatcctgtcaggccacacggcaagggacctgccgcagggactgttgacaagagccagagtcttttgctgtcgtgggtatcttacagaccggacctcttcgaggtcgtatttaaatttttaaaaccacctgattttcaggagggagtgttaagaagcacagcgtacgagatgtacgatcagatgcaaaagagcgggatcatgaatcccgctgctatcatagattcgtttgacgaaatagaggatcagaacgtcgtgtcacgtatttttcacgagtatgtgagagatcttcaggcgacaccgaaagatgaaagaggcagagcctttacccagaccctttcgagggttgttgcgaaggcatacgatgagcggatgaattcgcttgaagcgaccgacgtggcccgttttgaacttgtacgacagaaaaatgaatcactttcggagatcagcaaactgcatattccgaacgcataaggagaatttttatggctgaaaaaaagcagacagagacaactgaaaagaagacgacagctaagaagactactgccgcgaaaaagtcttctgcttccagtacaaagaagtcttctgctgcaaagaagaagtcgaccaaaaaagagccgactactgcagcaaaggaagctctcttcaccaagaagcttcaggatatcctcgatgttgcaaagaaaaagaagaatgttttagagtacgacgagataaaagattatttcaaagagctgaacttaaacgacaagcagttcgacaagatactcgattttcttgagaacaactccatagaagtgctccgcacggatgacgccggagacctcgatgacgtacctgagccggacgatttcccggatacagatgaggaagaggtagatatgagcaatatcgacctctcggtaccagacggtgtctcattagaggatcctgtccgtatgtacctaaaggagatcggaaaagtacctctccttacagctgatcaggagactgctctcgcaaagcagatcgagtcgggcacaccggccgagaagagcgcggcaaagaagaagctcgcggaggcaaaccttcgtctcgttgtatcgatcgccaagagatacgtcggcaggggaatgctcttcctcgaccttatccaggagggaaatctcggactcataaaggctgttgagaagttcgactacaagaagggctacaagttctcgacatacgccacatggtggatccgtcaggccatcacaagggctatcgcagatcaggcgcgtacgatccgtatcccggtccacatggttgagactatcaataagcttatccgcgtttctcgtcagctgctccaggagttaggccgtgagccgaccccggaggagatcgcgaaagagatggatatgccggtagaccgcgtaagagagatcttaaagataagccaggagcctgtttcacttgagacacctatcggcgaagaggaagattcacaccttggagatttcattcaggatgaaaatgttccggtaccggcagatgcagctacattcacactgctgaaggagcagctcaacgaagttttagatacactgactcctcgtgagaaaaaagtcctgatcctgcgtttcggacttgaagacggcaggagcagaactcttgaggaggtcggcaaggagtttaatgtcacacgtgagcgtatcagacagatcgaggccaaggccttgagaaagctccgccacccgagcagaagcaagaagctgaaggactacctggagtgatgagtgtgaagttatcgaggcggcttgacgccgcctgtgaaatggtgactagtggaagcgtggtcgcagacgtgggctgcgatcacgcttttttatctattgcgttagtttctggcggccgtgcagaagaggcctatgcctgcgatgtgaacagggggccgctcgggagagcgaaagagcatattaaagaagcgggtctcgaagagaagatacatacagttctttcagacggcctgacagctcttgaagcgccggtcgattcgatagttatctgtggaatgggcggctctcttatcatatcaatccttgaaaaaagcatagagaaggcgagaagcgcaaaagagcttatcctctcaccccagtcggatgtaaaaaaggtaagggtatggctttacgaaaacggtttttcgctgatcgaggagagagctgttttcgatgcaggaaaatactatgttcttatcaaggtaaagccggagggcaacgcgtccggatgggatcttcctgagaatgtatgcgatgaggatcttgcgatggagtacgggccgtacctcatttcacacagggacccggtctttatcgagtatataaaaaagcgtatagcagccttaacgcagattttacagggaattgacaaagaaaatcaccgttataaagagcttgaaaaaatattgaaatgggatattatttttattaaagagaaaaataattgaggagcatgaaatccagaggaggcggttatttgtgagagagttttacgaggtaaagatagaaggagaggacgagccgagggaggtcccggcaggacagactcttatggacctctcaaagaagatatacggagagaagagcgacaactacgttctggcttttgccgatggaaagcttacagaactgactcatcaggtgaaaagcgacagtgtcgtcagatttttatcttcaaatgacaaggacggacagagggcgcttcgcagaagcatcgtattcgtgatgcacaaggcgctccatgatatttttccggatgaaaagcctacggtcttcgtccagttttcgctcggcgagggatactactgtacgcttggcggcggaaagaaggtcaccagaaaacttctcactgacctgaagagaaggatgaagcagcttatagatatggatctgcctgtcacgaagtcagtctacccgacgttcgaggcctgcgagctgtttttggaggaggggatgcctgacaagcagaagcttctccactacagggcaaattcgaacacgaatatctacgagatagacggagtccacgactatttctatgggtacatggttccttcgaccaggtatataaaggcatttaatctcgtcccgtttgatgatggctttgtactgcagttccctggaaaagatggtaaagtggctgagtttaatcctccgaagaagcttttcgccactttgaaaaagaccagagagtgggccagcgccatggacatagatacagtcggtgctttaaatgacgctatctctgccgggagaacgaaggagatcgtcctgatgcaggaagcctttatggaggagagaatcggagccctggctcaggagatagcttccgacagaaacaagaagtttattatgatagccggtccgtcatcttctggaaagaccacattttcaaggagactctcgatccagcttaaggccaggggacttactccgcacgccatttccctcgacaatttttatctgaatcgtgaccagatgcctctcgatgagaacgggcagaaggactttgaggctctcgagggacttgatatcgagcttttcaatgaagacatgacaaagcttttaaatggcgaaaaggtcatccttccgatatttgattttacggccggaaagaggtcgaacgacggcattccgatgcagcttggaaaaaatgacgtcctggtcctagaaggcattcacggattaaatgacgcgctaagctacacgcttcccaaggagtcaaagtacaagatctatatttcagcattgacgcagctttctatcgatgagcacaatccgctgtcgactacagacggccgtctgatcagaaggattgtccgtgatgcacggacaagagggaccacggcggaggagactattgcgatgtgggactcggtacaccgcggcgagatgaagaatattttcccgttccaggagtcagcagatgcgatgtttaactcagcgcttatttatgagatggcagtgctgaagatctacgcgcagccgcagctttacgctataagccaggacagccctcagtatacagaggccaagagacttctgaagctcctcgactacttccttccgatgcctgcggatgatatcgcgaacacttcgcttatccgtgaatttataggcggaagttgctttaacgtctgaaaagtagtagaatacttctcactgaggtagatcacgtggccgctggcacatatagccgaaaggctgtgcgggaggaaagtccgggcttcacagggcaggatgccggctaacggccggcggaggtaactccagggacagtgcaacagaaatataccgcctgtttttgacaggtaagggtggaaaggcggctcaagagaccaccgttcctgtggcgacacaggaagccatgtaaaccccatccgaagcaagaccgcaaaggaacataaggctgcccgcctgttccaggtaggtcgcttgagacctgtggcaacacaggtcctggatagatggccatgcaacgacataacccggcttatcgatctgcctcatttttttagtaaaagtgcacaaaaatataagcttatttttgtacaacattccccggtgacaaaccggggactttttgttatcataatggaaacgggatacggaattttagtttcccgtttccgttttttcttttttgagtttatcggaggacctatgttaagagaagaaatactcgaagctaccatgaccgtgtacaagaaaaagggcatcaagttcacgatggatgacctcgcgaaggagatgaagagaagcaagaagaccatatacacagttctaagggataagaagcatctgttcctcgaagaagtggacttttttttcgacaagatcaaagccagagagcaggagatcacagatgacccggatttaagcactgaggagaagctgaggggcgttctctcagtcatgccggagaactactctgaggttgattttccggcgatctacacttttcaggacaagtacccggctgtcttcaaacggatcgaggagaggctcgaatccggctgggatactacatttttccttatagatcaggggattaaagaaggagttttcaaaaaggtggacaaacagcttttcaggctggtatacgatgcagcggttgagaaattcctctcatccgatgagctctcgaagctttcgattcactataacgatgcactgaaagagcttacggatatgcttatcgacggtattaaggaggaacagtaaaagtggaagaaatatttggaaacaggctgacacctggcgaggcgagaaagtctcttaaagcagcaaaaggatttaagaagagctgcccggatgacaaggatgtggactataagatccgcatcagaaagaacaaatcactgtacgactatctcggaatcatggacattcgcctcgaaggtgagaatgaagcacagtttgatacagaaaaggggatcatcgtatcgaatatcagaatgggattcggccactaccgcatctcgatggctatggcaagcgcagcaagagccttaggctacacgccgtactggctggatcttaactcatttcccaagacagcctcgactaagatcattacaaagcagaacgacatgtattcactaggttcgagactttcgaagaatccggtctttaacaagctcgtctgggagcctgtcaactactatttatttaaaaaactgacatacaatgcctcagactgggagacttcgaagctcctggctcctgtctaccagaacattcctaaagatatccctgtcatcgccacccacgcatggcctgcacagtcggctctggctggcggcatgaaacatgtcgttgaggcgatacctgataactggccgatggctctgcaccttgcagagggagccattcacacgatacagacccacaactcctatcttggatacagagtattaaacggcttctatggcaaaaaggtcttaaaccctattccagggaatgagctctactataccggacactatatcgacgatgagctcgtaaggaatattgaagccgactgcaggagaaggatcgaccgcctgcacgggaagaaacctgtcagattcatgcttagtatcggcggcgcaggggcccaggcagatatttttgaagcgatccttaagtaccttatgccggctgtaaagaagggcagagcatccgtgatcgtaaacgtaggagattacagaaatgtctgggatgagctccttgtgaaagtcgacgggttaaaggacgtatctgctgagcactttgagaatttccgcgaggcagcaggctttgcagacgacatgctcgatgcagacatgacaggtgtacacgctttttaccataaaaatattttcgaagccgtatacatcacgaatcttttgatgagagcctgtgactgccttatcacaaagccgtcagagctcgcattttacccggtcccgaagcttttcatcaggagggtcggaaagcacgagatgtgggcagctatccactctgctgagcttggagacggaacatatgagatcagggacatcccacacgttctgcagatgataggccttatgataaaagacccttatatcatcgagagcatgtgtcactgcattgagcagaacaagtcaataggagtttacgacggagcctacaactgcgttaagctggcggctgccgcgaatcagaaataataaaaccggaggttataaaaatgtcaagcacaaaagagcttaaacctattacaaaaaagatcatctggctttttgccattggtcagctgggatggtcactgatgagcgccatccttacgaactttatcgagtcgttctaccagccggatgacgtttcagtaaaagagggtatgatctatttcatccctcagggacgtgtgatccttggagtatttacgatcatcggcggtatctatgccattggccgtgtatttgacgctgttacagatccctggatcggaaatctctccgacaggagcaaaaatccaaaaggacgccgtatcccgtttatgaagagggcagcgatccctcttgcgctgatcactattatggtctacatctgcccgacggctggaaatcctgtagcttcaaagctcggcacaaacggcatcataaacggcatatgggtacttgtcatgatgctccttttctatcttttcatgacgatctactgcacaccttacaacgcacttattgcagaactttcaagagatgagaagacacttgccgatatttcaacagctatctcttttacatttatcttaggttctgcacttggatatgtcgcaccaactatctggagcgccattacacctgcagtgggaagccgtgtctgggctatgagaatagtctttatagtccttgctcttatcgctatggtctgctgcctggtacctgcccttacgataaaagagactgaatatgtagatgtcaagccgacagagggcaatgctttctcctcacttgcaaagtgcttttcaaacaagaacttccgtattttcgtagcaagcgatatctgctactgggttggaatcacaatgttccagacaggacttctgcactatgttacagtccttatgaagctccctgaggcatattctactatcctctacatcgcaatgacgcttctctctgttatctgctatgtacctgtaaataaactgatgggacattttgagaagaaaaaactcgtattcttcgcattcctcggcatgtgcctcgtattccttatcacaggactttcaggaatgttcggacttccgggaatcgtaagcggaatcctcgttgttgtctgcgcagctttcccaatggcaatccttggaatcattccacagacgatcgttgccgatattgcaaagagtgacgcgatcactactggcgagaaccacgacggaatgtttttcgcagcccgtaccttctctatgaagctcggacagtcactttcaatccttcttttcacttctctgggaactatctcagttgccacaggtttaggataccgtatcgcagccttcgcagctgtagcattctgcctcgcaggagctgtaatccttcacttctacaatgagaagaaggtccagggaatcctcaaaggagctaattattaatgataagagtattaaaaggtgacagaaccgcctttgtcctcgacaccccgcacacgactcttgtttttctgacacttccgtcgggacagatcgagacagcttactacggaccatcgattcagctcgattcggcggaggaagctctctccctctctgaaaaaaatgagttttctgtcggagattcaatcgaatacaatccagagaataacaaatattctctggaggatgtccgccttctcgtaggagagtacggaaaaggagatatcagagagccctttgtagaggctgtctcatccgatggaagcacgactctggattttatatattcatcttttgacattacagatggaaaaaatatcatagatggccttccgacttcgcatgagaagtcggaaaacgatgaggacaaggcacagacacttgagcttaaacttactgacaaaaacaacggctatctgcttcacattttctattcggtttatccggacagcgatgtgatagcgcgcagcgcaagattcgaaaatgcctcggattctactgtacgacttaaaaggctgctttccggacagctcgatgtcttcggaagcgggtacaaggtcacgacatttacgggcgcctggatccgggagatgaacagaaatgacactatagtaagtgccggaaatttcagcgtatcttctgtagtgggctcttcctcaaacagggcaaatccgtattttatcgtctcagatcctgactgcacagaagagcatggccgctgcatcggctcaaaccttatttacagcggaaatcactatgaaagtgtctctgtaaatacatacggaaagaccagaatactgacaggaatcaatccggtcgatttcgatttttcactcgctccgggtgaggatttctcggctcctgagtctgttattgcgtttacaaatggcggctactcggcactttctgtcattatggccgacttcgtcagagaccatatcctgaccggcgagtgggcgaagagagacaagcctgtcgttttaaattcctgggaagcttcatattttgatataaacgagaagaaacttctctcttttgcaaagaagggaaaggagcttggagctgaacttttcgtaatggatgacggctggtttggaaaacgtgacaacgacaagacatctctcggagactggaccgtaaacacgaagaaactcacacacggcctctcataccttgccgacaggatccacgagatgggcctgatgtttggtatctgggtcgagccagagatggtaaatgtggactcagacctctaccgtgcgcatccggactgggcaatcgcaatccctctaaaagagcactcagagggccgcaatcagagacttctcgacctgtcgaaccctgatgtcgtaaaatttgtgatcgatgcgatgagtggtattttttcatcggctcagataaattacgtaaagtgggactacaacagaattttttcagatgtctactcgccttaccttaaagagcgaagcagtggagagcttttccaccgctatatcctaggactctacaagattatgagttcccttgtgaaaaaatttccacatattttattcgagggctgcgcttctggcggcaacagatttgacctgggaatcctgtcgtattttccgcagatctgggcctcggacaattcagacgcgatctcgaggcttacgatccagcagggactctcgttcggctatccgctttccgtgtctacaggtcatgtcagcgactgcccgaaccaccagacgcttcgaagaactcccctcgattcgagattcaatgtcgcagcttttactagttacggcatggaagtaaacccgaatgacctctcaaaggacgatttcagggagctcgcttccttaaatgagctctacaaaaaactccgccacactcttcagaccggtgatttttaccgcgtaagcaacgaggagaattcagtcaaatgggtaactgcatcaaaggataagacgcaggccgtaggaatgatcgtaataaaggaagtaaagccgggactccgctacgagaacctgaaattcaaaggccttgatcccgacaaaaagtaccacgtctacaacatccctgctgatatcgacgtccgcacctttggcagcatgataaatacaatgtcacctgtgcacttaaagtcgggctcagtagccgagagcgccgtagcaaaattcgtaaagctgaagaccgaagtcttagacgagaccgtctccggctcgctccttatgaatgcaggcatcaatcttccagccggcttcatcggcaccggctacaacgacaaagtccgcgttatgacagacttcgcatcacgcctttacatcgccgaacaagtgggacagtagggacggttctttttgtcccatttttggggacaccggggacggttctttttgtcccaaaatctgaattttcagattttgggacaaaaagaaccgtcccctctgtcccatgcggtcacaaaaaattcacagaattttttgtgactgcatgatataataaattttaggtttcccagaccgctgcctccgggacaggaggcatatgacttacgaagatttcagatcacgtcttttagacacactgactgttgagcttggcgcagaagtgcagcccggcttagatgatgttgccagtgcagggctttctggcagtgccaaggaagcatgcgttctacagattccgaacaggagactttctcctgttatttatcccgattatttttaccaaaagtacacgaacggctcttcattcgaagagattgttgagaatgtaaaggatgctatccggtacactgatgaggactcgtttgactttgacgaattctctgattaccaggtggctaagaagcatttagtcccaaggcttataaacttagcggataatcaggaaatgcttgaaaaaagggcttacgcagagtatttaaatctcgctgtgatctttacttatgtgataagctccgagagcgaggaacttgtaacttttacgatcactaatgaccagctcagcgggtggaaagtctcgaaggaacagatttttagagattcgatcaaatctgctcgaaagatcatgccatacacgatcgaccctatccgtgaactgctgccagagacctacagagatgacccgtccaaccctttctacgtactcacgaacacgagaaagcagtacggtgcggcttgtgtcctgtatgatcacgtgctctctgactttgcggatcagattggcgagaacttctacctcatcccgtcatctgtgcatgagatgctgcttcttccagagagcctgggtatttctccatgggacatggagaagatgcttatcgaggtgaacagtgcgatcgtgaagccggaggaagtgctgtcggataaggtgtactattttgacaaggagaccggaaagctggattatgctgagaagaattagaataaaaatgccggaaaccctcaaaacacaaggattccggctttaagctttgagccggactcgaaccggcgaccccctcattacgaatgaggtgcactaccaactgtgctatcaaagcagctttgtgacatatttcgccacagcaagaattattatacaggaagtttttgatatttgcaacaactttttggggcaaattgtgaaaactttttctaaaaaagtgctttacactaatggggtaaaggggtattatttatatgtattaaattttatactgttttaagatttgacagagaatccataattccttagttattcttgaaagcagcatttttatggaggtagttttattatgacaggcacagttaagtggtttaacaaccagaagggatatggatttatctcagacgattcaggaaaggatgtcttcgttcactattcaggtatcgctggagagggattcaagactcttgcagagggagctaaagttgagttcgacgttactgagggaaccaagggaccacaggcagttaacgttaaggttgtagactgattttgcactgggtatcgcatgataccatgttttttaagatgggaaagagcttatctctttttcatctttttttttatgatgaaatcatttataattaggttcaagtgtcaaagaaataaaaagtttgtatgtttatagaggaacttttatgtataagattatagttgacagctgtggggaatttacgaaggctatggaagccgatacggagcatttcgcgcacgttgcactgactcttcaggtaggaagctgggagcagccagacgatgagacatttgaccagaagatttttcttaaaaaaatgaaggaatccaaggagccgcctcattccgcctgcccttcgcctgctgcataccttgccgctatagaagacaatgatgcggaccacgtctacattataacgctctcgtcgaaattgtccggatcgtacaacgccgcggtccttgcgaagagcctttacgaagaggaccacgaggatgaggacgacatcaagcgtgtccatgtttttgactcgaagtcggcttcgataggacagacgcttatagcacagatcgtagatcaggctgagaaggccgggcggtcatttgatgaagtcataaagacggccgatgaatttatcaagggcgagcatacatttttcgtgctcgagtcgcttgagacattgaggaaggccggacgcctcgggtcacttaaagctatgctcgcatcgacgcttaatatcaagcctgtcatgggatctactccagaggggagcatccagcagcttggccaggcgcgcggaatgataaaagcgcttgataagatgatcgagtgcatgaaggatgtcacgatgaatccgggagagagagttgtcgcgatttcgcactgcgcagcgccggatacagcatcttctcttaaagagaaagtcaagcgcaccggacttttcaaggacgtttttgtgctcgatacaataggagtttcatcgatgtacgcaggtccgggcggcatcataatggcagtatgagatatgtacactgatctggttcaaaaaatagaatcattgaaacgctttggaaataagagcgggcgggaagtcacagaacggcttttaccagagctcggttccccggaccgtggaatgaagataatccatatcgcaggaaccaatggcaaaggatcgacagctgtatatatcgctgccgggcttcaggcgaatggctataagacagggctttttacatcacctcaccttataacgataagggagaggatgcagatcgatcgtgagatgataggcagggacgattttacaagacttgccgggaaagtcctctcggtcgggatgcctgaagagtacacacccactttttttgacatctgcctcgcgaccgcccttctctggtttaaggaaaataactgtgactatgtagttcttgagaccgggctcggcggaaggctcgactcgacgcgcggaatttcagagactcctgtcgcaggcactatcacggcgatagggcttgaccatacagcaattcttggagacactcttgagaagatcgcggccgaaaaggcggggatcgagagagaggggatgcctgtcgttatcgcccacaataagccttcagtcagaaaagttttagagaaaaatgccagttcatttctcgcggttgacaagataagtgataccgatgagagaaaaacaaatgggcttttttctctggcgttaaaagcgagggacagggataaagaaattacgcctccactcgaaggggatttccagtatgacaacctggctgcagcgctttttacattgtatcttacagcaccggatctggacaaagataaggtcataagtggaataaggacagtgacctggcctgcgcgcattgaagaactttcagacgatccgctttttatagttgacgggtcgcacaatccgcagggggttgaagctttaagccgcactttaagggaggctcatcccgggatgaaattcgtatttcttatggcagcgatggccgataaggacgtaagccatatgatagaaggcacgaaggacattgcggaatactatatctgcacgaaggcagatacgccccgcagcctcgaagccagccgtcttacagagatggtgcgctctcacggcgcgaaggcagtctgcgctgagacgcttgagaaagccctggaatttgccagggggtcgggagcaccagtcgtatcatttggttcgctctacctcgcaggagaagtgttaaaggcatatagagattaggagaaattatgtttttgatagatgctaatgtcggagtatttcagcagtggctttcaaaattcatgtcgaatggactggattttttctggagcgttgtcattgcccttttagtctggttcatcggatcgaagatcatcaaatttatcaggaagcttatcagggcggctttaaaccggcgtgaagtggacaagggcgtagttcagtttactgacagcgtcgtgaagtacggtctttatattgtccttatcattgtcatattaaatgtcttcggaatccagacttcatcagtcgcagcggctgttgcgtccttaggtctgactgcaggtctcgcactgcagggctcactttcgaacctcgccggcggagtgctgatccttcttttaaagccattcaaggtcggggactatattatcgaggatactcacaagaacgaggggacagtcgccgagatctctattttttacacgaggctcaggactgtagacaacaagatagtcgtggtccctaacggaaccctggcgaattcttcacttacgaatgttactacgagtgacagaaggcagatcgatctgacttttgggataagctacgacgacgatctgaagaaggcgaaggaaatacttcaacatatagcagagacgaccgatgagagggttaaggacactgacattcagatcttcgtcagagagctcggcgcatcttctgtaaacctcggattcaggatctgggtcccgatggacgattactggaatgtcaggtggaaattaaacgagagagtcaagctgacgtttgataaagagggcatcacgataccgtatgatcagctcgatgtaacggttaagaaagaggccaaaaaataattattgttttttatttaaggagattttcagatggaaaaaatacctgaagagtacgaacttgttttgcagcaggaccttagtgatatccattcgaagggaacacttctgcggcacaaaaagagcggagcgtatgtcacactgatagagaatgacgatgtcaacaaggtcttttatatcggatttaagacgactccggaggattcgacaggagttccacacattatcgagcatacagtactttgcgggtcggacaagtacccggtaaaggacccgtttgtagagcttgtaaagggctcgatgaatacgtttttaaatgcgatgacatatccggacaagacggtttttccagtcgcatctacaaacgataaggattttgacaacttgatcgacgtctacctcgatgcagtatttcacccgaatatttacaagcatgaggagatcttccgtcaggagggctggagatatgagctcgaggacaaggattcaccgcttactattaatggtgtagtctacaacgagatgaagggcgcctactcttcgcctgaggatgtgctcgacagagtaattatgaattcgctctacccggacaacacctacggcgtcgagtccggcggagatccgaaggatatccctaacctgacttatgagaactacctcgcattccaccagagatactatcacccgtcaaactcctatatttacatctatggcgactgcgacatggcaaaaaagctcgaatacctcgacagagagtatttaagccattacgatgctatcgacccgaagaccgatatcgtaaatgagcctgctttttcaaaaatggcagaggttaagatgccatatccggtttcggcagatgagagtgaagagggaaaaacttatctctcactgaactattcgatcggagatgcagaggatacgaagctcgcggctgcgctcgatatcttagactatgtgctgctcgaggcacctggtgcgccacttcgacaggcgatccttgacgctggtatcggaacagatgtctatggcggttcgacttcgatccagcagccttattttcagataacagtaaagggcagcgacccatcgaaaaaagaccagttcagggagcttgtagaaaagactcttatggatctctccgtaaacggcctcgatcacagatcacttctggccgggatcaattccgatgagttcaaataccgcgaggctgatttcggtggcttcccgaaggggcttatctggggacttgggatcctggacagctggctctataacaagaagcttccgtttataagactcgagcttctgccgatttacgcagatttaaagagagagatcgacaacggatattttgaagaccttatcaggaaatatttcctgaataatacacacagttctcttgtcgagatctatcctgaggcaggcctccagaaaaaagaggatgacgccttcaaaaagcagatggcagagaagaaggcttctctttcagatgaagagatcgaaaatatcgtctcttacacaaagcatctgaaagagtatcagtctacaccttctacgcaggaagatctggcgaagattccatgcctttcgcgctctgaccttgacagaaatcaccgtccgctcaacaaaaagatatatatccgagagggcgttccggtcgtatttacagacacagagacgaacggcatagactatctgaacatcatgtttgatgtgggacatataggcctcgacgaggcgcctgctttcgcgttcggaatgagacttttggggctgattgacacgaaggattacagctacagggattttgcgacagaggtaaacctccatctcggaagtctctcagcagatgtctcagttgtaaaaaccggaaatggagatatagagcctctccctggtggaaagactaaagggtacaggttctttgcagacataaagacaaagtttgtctacgaagaggctgactcagctatgaagcttctctaccagatgcttttcacctctgatttctcagataaaaagaggatcagggaagtacttatggaggagaagaactccgtagagatgagatttatgacatccggacatgcagcagctgctgtaagaggactttctcatatcagcagatcttcagctataagggatgctgtaaatggaatcggatatttaagatttcttcaggattttgcagctgacttcgaccagaaggtggacggattcgtaaagacatttacagaagagataaagaggtcatttgccctgaataccatgataatctctacgactggccgcgaccaggttatggatatcattgacaggtatcagatgaaggcagcagagatccttcctaaggagaatgacctgcctgcagcagagattacgctcgactccgattcagagaacgagggattcaagtcagcttccaaggtcaacttcgtaagtgaagttggaaacttcaagaagcacggatttaaatacaacggagctttttcaatattaaaagtcgcattaagctacgactacctctggataaatatccgtgtgaagggcggggcttacggctgcgctgcaaacttcaggagaagcggaaacgtaatgtttacgacttacagagatccaaaccttaaggattcgcgcgatattcttctgaatacacctgactatataagaaacttcaatgtatcagacagggacatggataaatacgttatcggagcgataagtgcgtgcgatacgcctcttactccttcgatggaaggacagagggctgttacagctgtgatagccggtatttcagatgaccagctgcagcgtgagagagacgaagtgcttgaagcgactcaggatgatataagaaaactcgcggagccggtagaggcagcacttaaggattcagttcttacagttgtcggatcagaggatatgatcgacgctgacggtgaactgtttgacaggacggagaatttatttggctgagacaaagagcggatttgtgacgctgatcggaagaccgaatgtcggcaaatctacactgatgaaccggatgatcggacagaagatcgcgatcacatcgaataaaccgcagaccacaagaaacagaatagagaccgtacttacagatgacaggggacagatagtctttctcgatactcctggaatccacaaagcgaaaaacaagctcggtgtctacatgcagaaggtgactaagtccgcaatgaagggcgttgatctgatcctctggctcgtagaaccggacgagtttgtcggcggcggtgaccagtatatcgcagaacatttgaagaatatccagacgaaggtcatcctcgttataaataagacagacactatcccgcatgagaatatccttactacgataaatgcctacaaggatcttctggatttcgcggagatagtcccggtatcggctctcagaggaaagggcattaaggaccttgtagatactatttttaaatatctgcctgaaggcccttacttcttcgacccggatacgatcacagaccagcctgagagagctatagtctcagagatgatcagggaaaaagcccttcaggcgctttcagatgagatcccgcacggaatcgctgtgatgatcgatacgatgcacgacagagaggacaagccgatctgcgatatttatgcgacgatcatctgcgagagggagtcccacaagggaatcatcattggaaaacacgggagcatgttaaaaaagatcggaacgaatgccagattcgagatagagcgacttttaggctgcaaagtaaacctgaagctcttcgtaaaggttaaggagaactggcgagattcggaagtgcttctggctaattacggatttaaaaatgaggatgacgagtagtgtctgacgacaaaaattttctgaaggccaggggtatagtgctttcatccatgccgataggagagactgacagacgaatcgtagtcctcacgaaggaactcgggaaagcctcggcatttgtcagaggtggagcaaagcccaaaagtccgctgctggccgcgaccaatccgtttttcttcggagatttcgaattctacgctggaaggaattccctgacgcttcggggagcaaagcagcaggccaggttcgacgatatcttaaaggacctggacgatacttacctcggcatgtattttctcgaggtcagcggctatttcggaaatgaggcggcagatgagagcgagaggataaatcttttgtatgtggcgctgaagatcatcctcggtcatcggatcgacaggaagcttattcgaaatatttttgaactcaggacgatgatgataaacggcgtctacccggacccgttttcctgccaccactgcggagaacaccttgatgtgaatggtgagaactatttttcaccggcacaatgttttttctatgatgcgcagtgcagaaatctcataaaaggccagcctgtgcgggtttctccatatgtgatgtacgccctgcagtttgtgctctctgcccctgtcgggaagatcttctcatttaatctgaaaggagaagctgcagaggatttttcttatatagtaaaaaggcttcggaccgtatttttcgatcacgagttcaaaacggagcgtttccttaactgaagttaaacgttatttaacttgaaaaaggagacaaaaggcgtataattgtcaaagtatggataaaagagataaggtgacgccggaacagatcagagtttacaggcggagaaaaaggataattcaaaaaaaacgccaaagaaggcgcagacagctgatcacagccgcggtgatacttgcagcggttatcgtagtgctttttacagcactttcgggcatttttgaaaagaggagccggagtgacctgcttacgctctcaagtgacgggtcggtcatttttgaagagaacagcacgatggatgatgcggccgggcttaaggatttcgtcaataaacagatctcgtcctacaacagcaaaaatggagagggttccgttcagctgaagagatttgcgagatcaggtgaccactactacgtcaggactaagtacaagaatatggcggtctattcggacttcaccggatacgatgcctacagtggcactgttgaaggtgccaaggaagccgggtactcttttggcgatacaagttttaagagcacttcttccaaggcgtctgccgatgccagtgcagatgcgttcaagggacagaaagtgcttatcataaaggaatggggcatcagtgtaaaggttccgggagaagttaccggcacttcacttgccgaaaatgtcacctgcgatccgaaagatggcacagtaaagatcaaaaaacagtctgacagcggtacagcaccgcttacttatattttttataaataatagagaggaatttatcatggtaaagagtctggacacaatagtacagctggcaaaaaaccgcggattcgtatatccgggttctgagatttatggaggtcttgcaaatacctgggactacggtaatctcggtgttgagcttaagaataatgtaaaaaaagcctggtggcagaagttcatccaggagagcccttacaatgttggcgtagactgcgccatccttatgaacccacagacatgggtcgcatccggacatctcggcggattttcagatcctctgatggactgcaaggagtgccacgagaggttcagggcagatcagcttatcgagactttcgcgcatgataacaatatcgagcttgagagctctgtcgatggctggaccaaccagcagatggagcagtggatcgaggatcacaacgttccatgtccatcatgcggcaagcacaatttcacagagataagacagttcaacctgatgttcaagactttccagggtgttacagaggacgcgaagaacaccgtttacctccgcccggagacagcacagggtattttcgtaaacttcaagaatgttgcccgtacttcgagaaagaagatcccattcggaatcggacagatcggcaagtctttcagaaacgagatcacaccaggaaacttcacattccgtacccgtgagttcgagcagatggagctcgagttcttctgcgagccgggaacagatctcgactggtttaattactggagaaagttctgccatgactggctcctttcactcggcataaacgacgagcacttaagacttcgtgaccacgatccagctgagctcgcattctattcaaagggtacgacagatatcgagtacaccttcccatggggctggggcgagctctggggcatagcagacagaactgactacgaccttggccgtcatcaggaagtatcgggacaggatctgacatacttcgacgatgtaaagaatacgaagtacctgccgtatgttatcgagccgtcacttggcgcagaccgtgtcgttttagcattcctctgcgaagcatatgaccaggagaacatcggaacggaggagaagcctgatatccgtacagtgcttcacttccacccggcactcgcacctgtaaaggtcggcgtccttccactttcgaagaagctcgcagagccaacacagaaagtctattcgatgctctcaaagagatataactgtgagtacgacgacagaggcaacatcggaaagagatatcgccgtcaggatgagatcggaactccattctgcgttacatacgatttcgattctgagaacgaccactgtgtcacagtccgtgatcgtgactcaatggagcaggagcgtgtcgctatagatgagctgatggattacttcgacgacaagttcgatttctgatcattgggagattttaatctatgaaaaataaggttggaggagtcatcgggctgattctaacagcccttttgctcgtactttatctgcctccgctcgtaatgtacggaattcttgatatcggtggcatcataggatttgtcctggcggcgcttgcacttatatttgcaatccagcagttccgcaaggcagcagatgacgcaccgaagagagaatatgacaagtcagtttccggaggcacgcgcggcagacttcacaggatgtacaaccacgacatgggcaggagtacagtgcttatagagcgcggcggtctcggaaggtttaccgcagatacctcgatcggatacgatggggacaagacatcccacgccggacttattgcatggatcgtaatcctcttgatcatcgtggcattttttgctcagggacttgtaaggatgttctctgtaaatgaggccggctccggcagcagctcaaacgttattgtcttaggctgtggtgtcagaggaacgaatcctacgataatgctgcgtcagagaatagaagctgcacgactctatctggcggaaaatccaaaggcagtagccgtagtaagcggcggcaaaggccctggagaggatataagcgaagcagagtgcatgaagcagtaccttacagatgctacaaaggcatcttctgataaagattatttttatcaggcatgtgacatgcacggagtgccggaaaaaaactacagcgaagtacctgttatagataaaaagcgtatcctgacagaaacaaaatctgtcaatacgagacagaacatttcgaactcaatcaacacgcttgtgatgagtaagaaagatgtatcgaatgtggtcatcgttacgcagtggtatcatgagtaccgcgctgcaaatgaagctctcgtgcacggatcaaatgccctggcatattctgccgctatagactggtggggtgtggctacttatacgacgcgcgagtgcttatcgattctctactattcatttttataaaaaataacagtaaaactggcggcatttatctgccgcctcatattttacacatacaaaaaggagtaaattaatgatcgagctcttaaaagccgctcttttcggacttgtagaaggagtaaccgaatggctccctgtctcatcgacagggcatatgattctgcttaataactgggtaaaactcaatgtttcgaagaatttttacagtatgttcgaggtcgtaatccagttcggagctattatggccgttgtgatcatgttctggaacaaactctggccatggtatatgaagaaagtaaaggtgcatggtcagatggctacaagacagcgcccggcctggaaaaaaggctctctcgatatgtggatcaaaatcattgtctgctgtattccggcagcggtggtaggagtcctctttgatgataagattgatgagctgttctatcatccggtacctgtagcacttgcgctgatcgtagtcggtgttatttttataatcgttgagatgacggccgggaaaagatctcctaaggccaactcgatcgctgaaatgagctattctatggtcgcctggatcggtatcgcacagactctggcagccatcttccctggaacatcgagatccggagctacgatcatcggagcactcatggtaggcgtaagccgtggggtagcagcagagtttacattctttctggcagtacctgtaatgcttggagcatcacttcttaagatcgtaaaattcgttcacgcaggttacgctatgacaggactcgagggaggaatcttagccgtaggctgcatagttgcctttgtcgtatcgattgtagtcatccgtttctttatgagctacataaaaaagcatgatttcaaggtatttggctggtacagaatcatccttggaatagccgtgctggctttagtccattgatctggagaaaaattctctgattaatggaaaaaaatccgattattttttcaggagggatacagtgactgtttcactctgcatgatcgtaaaaaatgaagagaaagttctaaagcgatgcctttcttcaatagcgccgctctgcgatgaggtcgtgatcgtagatacaggctctactgactccacgaagtcgatcgcctccaattacacaaataagatctacgattttcagtggatcgacgatttctcggcagccagaaatttcgcgttcagcaaatgcagctgcgactacatctactctgcggacgcagacgagtacttagatgaggaaaacaagattcgttttaaaaatctgatcaaagctatagatccggcgatcgagatagtgcagatgcactattacgagccgggaatttccgatgtcctgaattcaaaatcagagtacaggccgaaactcttcaagaggcttcggactttccgctggattgacccggtacatgagacagtctctacggatccgctcgtatttgattctgatgtagtgataaaccatgagccggaaaaattccacactgcaagggatttttctatctttgaaaatatctaccacagagacgggaagttaagccgcaggctctacgcaatgtacgcccgtgaactctacaaaaacggcactccggagcagatcaggcgtggctgcgacatcttcagggacgcgatttcaggagatatggatgtggacacgctccagatgcttctcgcggtccttgcaaaggatgcccgccttaacaaaaatgctccgggaatgctcctctatacatcgaggcttctcgcagtgccagagccctgctcggaggtctgcctggagctcggagaatttttctatgacagtggtgaatacaatgatgccgcactgtggtacttaaatgcctctcagcagcagccactgatggatgtccatgccgcgggtgacgcggccttaagaggccttggccgcagctacgcgaaactctcagagcagacagacggagaggagagcgacaggtaccgcgacctggcagaggattacgaggcaaaagcagacagctgggaaatgcctgaggaaatttagtagaactttttgaaataatttgaaaaaattacaaaaaagtccttgacagataggccagtttgctatagaatatatcttgcgtttgcgagagaagtgaaaagcgagcgcaggttattagcgaggtgtggctcagtttggctagagcacctggtttgggaccagggggtcgcaggttcgaatcctgtcacctcgattttgttttaatgttttttcatagagacatagagaagttacgcaggtgtagttcaatggtagaacaccagccttccaagctggatacgtgagttcgattctcatcacctgcttttatgtgtctgtagctcagctggatagagcaacggccttctaagccgtgggtccggggttcgaatccccgcaggcacatactgtggtgggtgtagcgcagttggctagcgcgccagattgtggctctggaggccgtgggttcgagtcccatctcccacccttggtgtttatcaccgtatacatatcagttggattcgttgggctatcgccaagcggtaaggcacaggattttgattcctgcattcgccggttcgaatccggctggcccagagatggggtattagctcagttggtagagcacttgacttttaatcaagttgtcgggggttcaaatcccccatgcctcacgaatatttgaaagctctgaaagccttgatttataaggcttccggagcttttatttttaataaatacagatgttcgaataaaatgtggtaaaatactgcctgtttctgcaaaaaaagagggtacccagagggtaccctggttaaaagacttttaacttgatttattaaatctgatatcctgcttgacaaaatatcagcagatgatatactatcaattgatggtaaaacagagcggaggcgattctaattcaactaagtatccaatcaaaaaagaatgaagtcattgcttttctggataagttaaagtcagtacttgagaatccagaatttgatatagataaagattttattttgattagaaaacacaaacatgacgaagaccagcaatattcgacaccatatactttattggatcttgattacgacatggaagatgtcgtagcgaggttgaaagaacttgtcttggaagaatattctgagacactgatagataaagatgatttaaatccacctttattatttgtgtttggaaaatatataaacagaaagcttatatatgtgaagttgaaggttaaaggagatcagcagcgacatgtattatgcgtgtcgttccactatgcgaagcatgaaatgactttcccttatgcataattgcaaaattaaggagacaagacagatgaaagacagcacattattgagaaaggttcatatggattgtcctgtatgcgacaagacacatgaagtagaagagagaaaacgtactacatcaattgtgataaagggagaagaggtaacttacgatgagagattttatttttgtgccaattctgatgagaatgagaatgaatttgtaacgggctcgatggccaatgagaatctcatgaatgcgagaaatgcttatcgtattaaaaaaggcctgcttagttctaatgagatagtggagacaagagagagatatgggctgtctcaggttgatttagccaagcttttgggatggggagaagccactatttcacgctatgagagtaaggcaatccaggatgaggctcatgatgctatgcttcgcctgatcaaagataatccgcttaaagtgttggaattcttaaagaaaaatgcggataaatttacccaaaagaagaggacggaaataaggcagaaagttgtcgaaaatcttgattcatttggtaaggaatatctgtcacgccaaacttttgaaggcgaatatgttgagtttgaagaaccatctgattcaaatggttttacggtattgaatattgacaggattgaggcaatgatttcgtacatcgcggagaatgtttcaaatttatataaggtaaaacttatgaaaatgttgtggtattccgatgccctgtcatttattaataatggagttgccatgactggattggtttatagacatgaacctatgggggctttgccgattggccattatagtctgatgaatcttgagaacatcaacgttaaagaagaggttagctataactatgatacgatgattcatatttatccaactgtaggaatgaattactctgtattgagtgatagcgaaaaggccattttggataaagtgataggaaagttcaaaaattataaggccaaggacattgtagattatatgcatgaggagaaggcatataaggagacgaaagcaggagaaattattccattcagtttggcaaaagaaataagaaagttttaaaaattataaaaatagttcttttaaaacagaaatatcttttttctgtttatggatatgtttcagattttttttatactgagaagtcatgacaaggtcaagtattgtctttgtcctcttttagggcatcatcaagcattgtatcaaatggcttaaatacggcatttatctgcagacttttaatcaggttgtcgcggcttcaaatccctcatgcctcacgaatatttgaaagctctgaaagctttgatttataaggcttccggagctcttttttttacatttcattcatggcaaaatatttataaagtatcaacacagaaatatggacagtaagaaagcggtggtagttttatgagtatcggtggcttagaagttattattttagtgggtgttatttttgctgctggggtgattgtgatcactatcatcaggaaagttatttcggatgcagattacaaaaggcagctccggaagctgttccagaagaaatgaaaaagctgatcatatggtacaattcatgcagtagcgttgatttagaaactctggctgagctgcatacaagatttgaatttctcggagcaggaaattttcactttatgtcattctaagagtagaacgtaacaaatgctcaaatgactagaatattataaaagtgctgttttatcactataagctatcgaaatgcaaaagcgtaaaatggctttgtaacaaagcattctaatttaagcgcatagagaaaataaaaaaattagatttgttacgatttgagcggaacattacttattctatagcaaaatagtcatataatcaaatgcgtggctgaatgccccgtttttcgctgattgcagaaaatatcccttcctgcaatggcctgtttatggtacaataaaacttaacggattgagaaaatctgtaagaaaagtataagggttatattgtaggaggagaaaagatatgcctagagaagttaatccccggatccacgtcaatgaacgtgactttccgcagaaagattttgttgaaaaagatccggaaaagcgcgagcttgtaaagaagcttgctgttatgatcacggacaatatcccgcgtaaaatgcctggtggaatgcatgaaaaccacatggatttctggattcttgacagacttctgaccaaggacgaagtcaggttcatgctgagctttaagaaaagacgtgtcggcgtgaccacgaaggaactggctgagcgcaatcatatgacggccgaagaggcgcagaaggtgatagatcacctgctttggatcggcatcattgagcagaacagggtaaatccggatcaccatatccagtactgcattccgaagtgggttgtcggttcgggcgagtacatggtagaacatccgacgctgatggacgaacatccggaagttgcgactatgttcaattacgctccgcaggagccgcttgagcttgctgccaaattgataccgccaggtggtgctggtatcggaatgcacgtcatcccggtcgaaaaagcaatcgacgcggagagcagatctgtttcagtcgaacacctttcacactggttaaataaatacgataaattctgcaagatggtatgtgcctgccgaaaggcccagaggcagagaggcgagggcgtaggcgacatcgagggttatacctgtatcggtgtcggtgatatcgccgaattcctcgttgagagcggaaaggacgccaagtacatcacccgcgaagaggtgatggatataatcatgcgcgcagagcgcaagggctatgtgcaccagatcacaaatctcgacggaccggacaggatagtcggcatctgcaactgctcacctggcagctgctatggactgcgtacttcacagcttttcaatacgccgaacatgtcacgctctgcgtaccgtgcccatgtagatcctgccaactgtgtcgcctgtggcaaatgtgttgaagtgtgtccatccggtgctgcgcgcctcggacagaagctctgccgcagtgatggcagcagagtaaaataccctatgcacgagctgcctgacgatatgccgtggggtgaggacaagtgggatcctgattaccgcgatcacaacaagatcaactgctatgacaccggtacatcaccttgtaagacagcctgcccggctcatctggcagttcagggctatattcagatggcatcggaaggccgctatgatgatgcgttaaagcttatccgtcaggacaatccgtttccggctgtatgcggcgcgatctgcaacagaagatgtgaggaccgctgcacgagaggcactattgatgcgccgcttgcgatagatgagataaagaagttcctggcgcgccgggaactcacaaaggaataccagtacattccgccttgcgagaatcaggacggtgagcagtggacaaagtatccgatcgctgttatcggtgccggccctgcaggccttacagcagcatactaccttcgccaggaaggctatccggtcaccgtatttgaaagggagaatcgtccgggcggtatgcttatgaacggcattccgaatttcagactcgaaaaggatgttgttgaagctgaaatcgatatgatccgtcagatgggcgctgacatcaaatgcggagccgaagtaggaaaagacgtgacactcgatgatctcaggaaacagggcttcaaggcattttacgtagctataggccttcagggaggccgggcacttggcgtacctggagaggatgctaagggcgtcgagtctggtgtagcgttccagcgcagaacgactcaggataatactattaagcttgatggtgatgtagttgtagtcggcggaggaaatgtggcagccgatgtagcgagaaccgcactccgctgtacagacggcagggtcactatgctctgccttgagcagcgcgacgagatgccggcttcaaaggatgaagtggcagagtgtgaagctgagggcattactgtaaagaacggctgggggcctaaggagatcctcaccgaaactgatcaggatggaaatcgtatcgtcaagggcattgtctttaaaaaatgcctgtccgtaaaggatgctgacggaagatttaatccgaaatacgatgaaaatgatacgatcactatttcatgtgaaaatgtcctgacggctatcggacagagtgcagactggggtcatctgcttgatggcagcaaagtgaagctccgcaggaacggaacggccgaagctgatccggtaactcttcagactgctgagcctgacatttttgtcggaggagatataaaccatggtgccagatttgccattgacgcgatcgcagacggcaaggagggaatggtttcgatcaaccgcttcgttcatccgggacagtcacttacgatcggacgtgacttaagacagttcatcgaactcgacagagacgacatttttgtcgacagttacgacaactcaccgcgccaggtacctggaatgaaaaagggtgaagcaaagggctttgaggatccaagaatgccacttacggaagagcaggttcagaaggaagccagaagatgccttcactgcggagctacctgggtagatctgaaccagtgcataggatgcggtctctgcacgaccagatgccagtttgatgcgatccaccttaagagagatatccctgaggccagtgacatgcacacggcagaagagatgatgaagtgcgtcggaccatacgcggcaaagagaagcataaggattttgaaacataaaatgaccggtaaacatgactatccaaccgaacagtcataagaggcatttttctaaaatgtatttgataaggcagtaaactgcagcggggttctgcagatagaagaggaaaaacaggaatgaaagaacagaagaaccgtatgacaaatgagtatgattacaagcttccggaagggtttaagtacccggatgaagagaaggagaagcttcttatcaaactcgctgagatgattacagaccgctatctggataaatacacacatcagataaaaagagatgatccggaggtctggtgtctcaatgaggtcatggacaaggacgaagtgaagctgatgctaagcttcaaaaagaccaggaccagctactccagggatcagctgatgaaaatgaatccggaatttccaccagagaagttcgataagatgcttgatcatctgatgtgggtcggctgcattgagacgaaccgtgaaaatccagctgatgagctgcagtacgatgtgccgatttttgtgcctggcattgcagaattcatggtaatgaatgacaacctgatgaaggagcatccgaacatcgccaccttctttaatctgatgacacagctgccgcttgagggcatcacgactatggtgccgccaggaggcgcgggtgtcggcatgcatgtcatcccggtggagaaggcaatcgatacgatcagcgagtcagtgccaatcgagcatatttcccactggcttgaaaaatacgacggcaaaatttcagtcggcgtatgtacctgcagaagacagcagagaatccgcaaagagggcgacggatctatcgagcaggaatgctgtatcggatttggtgatctcgccgagtggtgtgtaaataccggacgaggccattatatttcaaaggaggaggcactggagatctgcgcccgtggcgagcgccatggctttgttcaccagacgacaaatatcgacggtgaaaacaagatcgtaggcctctgcaactgcgcgccgggagtctgcaatgctataagaacttcacagctctacaacacgccgaacatgtcacgctctgcttaccgtgctcatgtggataaggaaaactgtgtggcctgtggcaagtgtgtagaagtctgcccggtcggagcagcaaagcttggtcagaagctctgtaaaaaagatggcagcgagatggaatatccgctgacccttcttccagatgagaccaggtggaacgctgaccgctggaatatccactaccgcgaggatgcgaagaccaactgctatgcgacaggtacatctccttgtaaggcagcctgcccggctcacattgctgtacagggctatgtcaaaatggccagagagggaaaatatgacgaggccttaaagcttatccgtcaggacaacccgtttccggctgtctgcggtgctgtctgcaaccgcagatgtgaggatgcctgtaccagaggcactgtcgataagccggtggcaatcgatgagatcaagaaattcgtcgctctgcaggagctcgatccggaattcaggaagagcattatcccaatctgtgagaaagatgagggcggattctgggatgacaactacaagatggctgtcataggcgccggtccggctggtatgtcctgcgcttactatctgaggactaaaggctatccagtcactatcttcgaaaaaaatgaaaagccgggcggaatgctgacttacggaatgccttcattcagactgtctaaggatctggtggatgctgagatcgatgtgctgcgcgagatgggaattgagttccgctgcggagtagaggtcggatcttatgtcacgatcgatgaacttagaaaacagggctacaaggctttctatatggccataggactttccggcggaagaaatacaggtgtaatgggtgagtcagcccagggcgtagaatcaggaatcggattccttaacagggcaaaccgcgatcacagcattaagctcgacggagatgtcgttgtagtcggaggcggaaatgttgcagtcgatgtagcgcgcactgcggtccgtatgacgaacggacatgtgacgatgctctgcctcgagggtgagaacgagatgccggcttcagacgaagaggtaaaggaagctctaaacgaaggaatcgaggtcaggaacggctggggtccgaaggaaatcctctcagaaaacggaaaggttacaggcattgtctttaagaagtgcaccagagtaaaggacgagaacggcagattcagcccgctttacgatgaggagcagaccatcactatttcatgcagtgaggtcctcgaagctatcggacagtcggctgtatggggtgacctgcttaaagggaccagagctgaaacgaggcgtggcggtactatcatcacagatcctgttacgttccagacaggcgagccggatatttttgcaggcggcgatataaatcatggtgccagatttgccatcgatgctatagcagagggcaagaagggcgcagagtcaatgcaccgctttgtacatgaaggccagtctctgaccatcggaagagatttaagagaatttatcgagcttgacaaggacgatatcacgattccggatggctatgatcactccgcaagaaatattccgggaagcagaaagacagacaactgttttgacgatacgagacttccgcttacagaaaagcaggtgaatgcagaagcacatcgctgccttggctgcggcgcgacgacagttgacttaaaccgctgcatcggctgcgggctctgcacgacgaggtgcgaatttgacgctatccatctgtatcgtgacctgccggagaatacaaactatatacgcgcagaggacaagatgaagcttatagctccgtatgcggcaaaacgtgcggtaaagatagtcttaaatcatggaaaagacgcaaaggaagcagaaaggcagcaggcagaaatggcggctgcacagagatgataagctttagggagatattttttggagaaataaattatgcatgaaatggggattgtatttcacatcgcaaaaacgctggatgagctggctcttaagaatcacctgacaaaaatcggatctgtgactttagatgtcggggaagtttccggaattatgaccgattatttcacagactgctggaattatttccgtggacgtcatccgatcttaaaagattcggagcttaagattgagactattccggcactcacctggtgtgacaattgcaagaatacttatcctactgtaaagtacgggcgcgagtgcccgtactgccacagtggcgagacctggcttctgcggggaaacgagtgtgtgatcaaggagattgaagccgagggtggagatgatgaagaagagcaggaggagcagattctcgcgaaccaatagaaatgtcttcgtgaaatgtttacatagcaaaatcatcacctttaaaaaacaaatttatcatggaaaaacatcagaaaacagttagactatacttataaggaggtctatatcatgcttgtaaatatgaatgacatccttcttccagcgaagaagggacactatggagttggattttttaatgcggtagacgaggagatggcaagagccattattgacacagctgcagagctttcttctcctgtcatgatcggaactgcagaggtgctgcttactacgacggaactcgatcaggtggctgattatctgatcccgatggcaaaggccgcttctgttcctgtggctgtccactatgaccacggccttacgtttgaccgctgcatgcaggccttaaaactcggattttcttctgtcatgtatgactgctcgacaaaaccttacgaggagaacatcgaggccgtagctgagatggtaaagatctgtcatgcgatgggcgtgactgtagaaggcgagcttgggcatgtcggagataatgagggagccggaaagctggctaaaccgagcgactatttcacagacccggataaagcggtagattatgtaaagaggaccgggatcgactctcttgcgatcgctgttggaaacgcacatggagattataagttccctcctaagcttgatttcgacaggatttctgtaatttccgagagaactgatctgcctctggtgcttcacggtggaagcggactggctgatgacgatttccgtgaggctgtcaagcgcggcatctgcaagatcaatattttcactgatcttgacaaggctggaaaggaaggcgcaaagaagggccttgacgcgggcgcggcaacaatgagcggactcattccttatgagatcgatgctatgaaggctgttgtaagcgagaagatgcatctgttcggaagtgttggaaaagcctgaagtcagattttttaaaatatattaggagaaatttatgggaaaaaaagttatagcggcaggacacatctgcctcgatatcactccagggttccctgacagaaaagtgacagatgcggcgcagattttccaaccgggaaagcttattgaagtcggaaatgcagacgttcacaccggaggctcagttgccaataccgggcttgcgatgaaaattctcggagccgatgtcaggctgatgggaaagatcggaaatgacgcttttggcgatatggtcatggcgatcctcaaaaaatatgacgcggaccgcgggatgatccgcaccgacgagagcggaacttcgtactcggtcgtgctggctgtaccgggtattgacaggatgtttcttcacaatcccggcgccaacgatatttttcatgcaggtgatgtaccacaggaagcactggacgacacggcactttttcattttggatatccgcctcttatggcttcgatgtatcaaaatggtggtgaagaattgactgcacttttcaagcgtgtacatgacgcgggagttgcgacatctctggatttagctgcagttgactcatcttctgaagccggaaaacaggattggaagggaattctcgagaggacgcttccatacgtggatatttttgtgccaagtatcgaggagctttgtttcatgctcgacagagaccgttttgattcctggcagaagagagcggcaggcagagatataacgacgatcttagatcctgaaaccgatatcagaccgatagcggatcagtgtatgaacatgggagttaaaatcctcatgctcaaatgcggagcgcctggcatgtattgctgctgtgcagatgaagacacattaagccggataccatctgttcttggaattgatgcccgtgaatggagcggttttaccagatttgagagaagttatgtacctgaccgtattctctccggaaccggcgctggggatacgagtatcgcagctttccttacagctgttcttaatggttattcaccggaggactgccttcatctggcagcagccgaaggagcgtcatgcatcactgaatatgacgcactaagcggtatcaggcctcttgacgagctgaaggagagaatcgattccggttggaagaaagcataagaatactacttccatctgggtttgaatcagactggggttacacagactttacattaatttcgttgacaaatcaccgtaatctgttaaaatttccttaacaaaacaatttctttttcagggaaagagaggcagattatggggattttttttatcgtgatacttattgtagtgatcatcgttctggcggcgactattaagattgtcccggagtcaaacgagacgatcgtggagcggcttggaaagtacaaccgtacaatgcatgcgggtgtcaattttaaaatcccgttcgtcgagacggtcagatcacgggtgtctttaaaggagagggtgctcgattttccgccgcagcctgttatcacaaaggacaatgtcacgatgatgatcgattcggtcgtgtacatgaaagtcttcgactcaaagctctatacctacaagatctcgaaccctaatcagggtgttgagactctctcggcgacgacactcaggaatttagtcggcgcgctgacgttcgatgagacattgacctcgcgggatacgataaatgcgaagcttcagaccgaacttgatgaggcgacagatgagtggggcatcaagatcacccgtgtcgaggtgaagaacattcagccgcctaaggacattcaggaagtgatgaccaagcagatgagggctgagcgcgaaaagagacaggctatcacagaggctgaggctcacaagcagtcagtcgtgactaccgccgaaggtgataagcaggcaaaggtccttgctgcccaggcagaagctgaggcttccgttgcaagggccgaaggtgaggcaaaagccacgagactccgcgccgatgcagaggcttacgctttaaagactctgactgaaacaggcgtttcacctgagattttaaaactgaaggggtacgaggctattcagggtgttgcgaatggaaatgctacaaagattttcatgcctgcttcacttatcgacgaagtatcaaacgctgagatcttcggagagggtctgaaatctgcctttgcagacgcttcaattaaaccgaaaaaggccccggatatgagcgatcctcacatgaatatcgccctttctccgaggtctgacagtaagattcatcagcaggtggcacgaacttcaaaagcaatggaaaatgaagaggaagctgacgaagaaaatgaagagaatgaggattgatcagtcctcattctctccagctatctcatcggctacaaatactccgctggcagaggcgtgggacagtgaatgtgtcacgccggtgccatctccgatcatgtagagacctggatagcaggtctcgagatggtcgtctaattccacctgcatattgtaaaacttgacttcaactccatagagcagagtgtcgtctccggcggttccaggggcgatcctgtcaagagcatagatcatttcgataattccgtcgagtattcttttcggaaggacaagtgagagatctcccggtgtggcattaagagtagggtgaacagtgctctcttcaatacgctttacagtcgagcgtcttcctctctctaagtctccgaatctctgaactataacaccgccgccgagcatatttgaaagtttcgcgatgctctcgccgtagccgtttgaatcgtggaatggctcggagaagtgctttgaaacgagaagcgcaaagttcgtgttctctgtctttttcgaggagtcttcgaaactgtgaccatttacagtgatgatcccgttagtgttttcatttacaacaattccatgagggttcatgcagaaagtgcggaccttgtcttcgaatttcttcgtgcggtagacgatcttgccctcgtacagatctttcgtgatgtgctcgaatataggggcggcaagctcgacgcggacaccgatatccacacggttgctcttggtgttaattcccaggtcgtcgcagacggactccatccacttcgaaccgctcctgccgactgaaacgatgcacttcggcgcatcgtagtcttctgaatcagtgtgaatcctgtaaatatagctctcgccattctttacagcttcgatagatctgaccggtgtattgaagtgaaaatccactttgtctttaagcatgtcgtagagatgctcaaggactatgtagttcttgtcggttccaaggtggcggacagacgcgtcgagaagctgcaggccgttctgcatgcagagtgtcttgaatgctgagccggctgtcgagtagagcttagtaccttcgcctccgtttgccatatttatattgtctacatatctcatcagctccatggccttgtcgcggccgatgtactcgtagagagtgccgccgaagtcatttgtgatgttatattttccatcagaaaaagctcctgcgccgccaaagccattcataatagagcagctcctgcagtgaatgcagctctttatcttctttccatcaataggacagtgacggtccttaagaggggttccctcctcgaagagaccgatcttcaaatcaggggccttctttgtcaattcatagcaggcgtagataccgcctggacctgcgccgataattatcacatcataactattcataataatttcctcttttaatgtaaaaaatcgagttattattttaccataaaaagagccaaaagacaataaagcattttttcttgttaaaaccatgtctaagtgttagacttaccttgtacctgcatgcaggggatatctttgaattctggaggctttgatctttgagtaaaattagtgatttagcgcaacagcagataattttggcagatggcgccatggggacgtattaccagagcctctatccggacgacgagaacatcgtagagatggcggtgcttgataatcctgatcgcataaaaaatatccacaagagctatatcgatgccggggcagttcttatccgcaccgacagctttgcctgcgtggggccatttatcgaatcagatgaattaaaggccgagatcgcttctaaatcgtatgagctcgcaagagaagctgcaaaagaatccgggagggatgtgatcgtcgctgccgatatcgggactctctttgatccggcgatggaagggcatatcctctctgatataaagccggtgctggacgcctttttagccgccggagcggatgtattcgacttcgaaacccagactcagacagagggactttcagagattttttcgtatattaaggaaaagaacccaaaggctcagatcatcgtgactttctctgtaaacaagaatggtatgacgacaggcggactctcggctgacaatatcatgcagttcggggcatcagaggaaaacatagacgccttcggtttcaactgcggcgtcggagcctcacacatggcagatatcattaaaaaagtgtcattttatactgacaagccattcatggtgctgccaaacgccggctacccttacaacttaagaggcagacagatattcagtggcgacagcagcttttttactgaaaaaatgaaagatatcgtctcaagcggagccgatataatcggtggctgctgcggtacgacccctgagtttataaagaaacttggggagaccttctcagggaaaaagtccggggaaagaaagatagttgaggcatttgacaagaaaacgagaacgttttcttcattttacaagaagcttgtgaacgacgaaaagccgatcgtagtcgagcttgacccgccttttgggagcgatatcacaaaggttatgaattcagccaggactctctctaaagctgacgttgacatcataactctttccgattcgccaatgggaaggagcaggatggatccgatgcttctaggtgctatgatgcagaaggagaccgggacagatgtaatgccgcatgtggcctgccgcgacagaaatctgatcggacttcgcggctgtcttctgggaagctatgcggcaggactcaggcattttcttatgataacaggggatccggtgcctgccgccgacaggagccaggtcacatcggtttttgattacaattcgatacgcttcatgaatatggcgaagctcttaaacgaggatgatttctcggctgacaggattgtctacggaggcgccttgaattaccacgggagaaatgccgaagcgatcgcaaggcgcatgaagcttaaaatggagcagggatgctcttttttcctgacacagccagtgtatggagatgacgatatagagcggctttctctccttaaaaaaatgaccggtgcgaagataatcgcgggtatcatgccgcttgtaagttataaaaatgccacttttatggcgaatgagatgcctggaatccatgtaccggaaagcattgtaaacctctacagtcccgacatgagccgcgaagaagctgaaaaggtcgctgtcagcgtaagccttgacattgctgataaaatgagagaaatgacagacggctactactttatggtgcctttcaacagggtgaagctgatctgcgatattattaaacaaatcaggaaatgagggagaaatttgactgttactgaatttaaagatctttttaaaaatgcacatccggtgtttctcgacggagctgtcgggacaaatatgatgaaggctggtatgcccgggggagtctgccccgagaagtggatggctgataaccccctgccaatatcaaaacttcagcacgactacatggaggccggaagccagatagtgctcgctccctcttttgctgcaaacaggataaagctgaaggaatacggactcgaagatcaggtgtactcgattaatgcaacacttgccagaaataccagaaaggcgactgacggaaagtgccttgtcgccggagatatcactatgactggccagcagcttgcgcctctgggagaactcgatttcgaggatctcgtagacgtttacaaagagcaggctgctgcccttatcgatggcggcgtcgacttatttttcatagagacgatgatgagccttcaggagacaagggctgcacttctcgcggtaaaggaaactgcccctgatatgccggctctgacttcgatgacctacaatgaggacggaaagactctatacggaactgctcccgcagaggccactgtagtgctccagtcgctcggggctgacgcgataggcttaaactgctcgacaggtcctgagaagatggtcccgctgatcgaggaaatgagaaggtatgcgactgttccgatcatcgcaaagccaaacgacggaatccctgagctgataaatgacgagactgtctacagactctcacctgaagaattttcagataacatggtgtctcttgtaaaggcaggagccacgataatcggcggctgctgtggaacgactcctgcccatataagggcgatggtcgaaaagaccagggatctttgcacactaaaaccggatcctgtcactgagagagttatctcttccgagagaaaagtgcaggagatcgagccggggaagcagtttttagtcattggcgagaggataaatcctactggaaaaaagaagcttcaggcggagcttagatctggttcactcgatatggtaaaggattttgccagaagccaggaggagaacggcgccgcgatcttagatataaacatgggcacgaacggaatcgatgagaaggagatgatgcttcgcgccattgacgaggtgacatacgagaccgacctgccgctctgcatcgatacgagctatcctgaagttatggaggcggcgcttcgcagatacccgggaagagctcttatcaactcgatttcaggtgaagaggagagaatggagaagatgctccctattgccaaaaaatacggggctatgtttatcgtacttcccctctcatctgccggacttccgaagactcttgaggagaagcatgcgaacctcgaaagagttcttgcggcagtaaaggcagcaggcatgtctgaaaatagagctgttgtggacgttcttgtagctacagtaggagccgatcaggagagcgctgttaaatgcttttctacaattgactactgccacagcaggggacttcctacggtctgcgggctttcgaatatttcgttcggcctgccggagagagcatttgtaaatacggcatttttaaatatggcaatagctcacggccttacgatggctatagcaaatccttcgcagaagcttcttatgctgaccgctctggcaggtgacatgctgctctgcagagagggagcgacggagagatacttaaagaccgcagctgaggctgatgttactgtctcgaccgtcggaagtaaaacttccggttctgttcaggagaaaaagtcggacctctcaccagtgatggaggctgtagtaaagggcgatacgactcacatccaggagcttgtaaaaaaagacattgccaacggccgcgacccgaaggaaatattaaatacagatcttatcgcaggcattcagatggttggagagctatatgagcagaaaaaatatttcctgccacagatgatatccggcgcgaacgcgatggagaagggtgttgcagtaattgagcctctccttaaaaaagactcttcagagcagaaggagacggtagtctgcgcgactgtcgagggtgacattcacgacattggaaaaaatctcgtagtcctcatgcttaaaaactacggctacaatgtcattgacctcggaaaagatgtaaaggcagaggatataattgaggctgcgataaacagcaaagcctcagttatcggactttcagctcttatgactacgactatggtccatatgaaggaagttgtaaagcttagaaatgagcgctacccgtcgtgcaggatcgtgatcggcggcgcctgtatcacgccgtcttacagtgatgagatcggagcggacggctattcagctgatgctgccgaatgtgtaaagcttgtcgacagacttctggctgaagataagcagcagaataacggaaaagctctggctatgtaaaatatttttaaaataccccttgacattgctgccggggtttggtagtatattcaagtcgcgtgaaacaaaagagcgcgaattgaatatgggatcttagctcagctgggagagcatctgccttacaagcaggaggtcataggttcgagccctataggtcccattcaggaacttatttatagtttctgtggcgagatagctcagctggctagagcacacggttcatacccgtggtgtcaagagttcgaatctctttctcgctactgtttctaagggctgttgcatctcggatgtgacagccttttgttttagaggtgattatatgcgtattggaaacggctacgatgtgcaccggctcgttgaaggcagagaccttatcatcggcggcgtacatattccatatgatagaggcctgctcggccactccgatgccgatgtgctgctgcatgcggtaatggatgcgctgcttggcgctgcggggcttggcgatataggacttcattttccggataacgatgacagatacaagggcgcggactcgagggcattgctccgcgaagtcggtcagatgcttcttaaagagggctatgtggtcggaaatatagacgccacgatcattgcccaggcaccgaagatgcggccgtatatagaagatatgaaaaaaaatattgccaaagaccttcagatatcagataatatggtaaatgtaaaagccacgactgaagagaagcttggttttacaggaagaggcgaaggaatttcagctcaggctgtctgtatcatcgattcgctttatgaagctggaagacagatagggccgggatgcagcggatgcagcggctgcccgaaagtaagttaaggagattcttatgttaaagatttacaacacacttacgagaaaaaaggaagaattcaaaccgatcgaagaaggcagggtcaggatgtatgtatgcggacctacggtctacaactacatccatatcggaaatgcccgtccgatgatagttttcgatacggtcagacgttactttttatataaaggatacaacgtcgattatgtttccaactttaccgatgtcgacgacaagatcataaatgaggcgataaaggaaggaaagagcgcctccgaagtagctgagttctacataaaagagtgcaaaaaggacatgaagtccatgaacatcatgcctgccacggttaatccccgtgctaccgaggagatcgacggcatgatcgatatgatctcaaaccttatcgataaggactacgcctacgtcgcatccgacggcacagtttactacaggaccagaagatttgcagggtatggcaaactctcccataagaatatcgatgacctcgaggccggacaccgcgacatcaaagtgactggtgacgagaagcaggatccgctcgatttcgttctctggaagccaaagaaggagggtgagccttcctggagatcgccatggtgcgatggaagaccgggctggcacatcgagtgctctgtgatgtcgaagagataccttggaaatactattgatatccatgccggcggagaggaccttatcttccctcaccacgagaacgagatcgcccagtctgaggctgcaaacggcgtaccgtttgcccactactggatgcacaacggtttcctcaatatcaataatgtaaaaatgagcaagtcgctcggcaacttcctcttagtccgcgatattttaaagaaatacaacggagatgtgctcagattctttatgctgtcagctcagtacagaagccctctgaactattcggcagagcttatggagtccgccaagaacggacttgacaggataaggacctgcggcgacagattaaaggacctgatctcaaagtccacaaatatggagatgactgaggaagaggacgagcttctcgacacgacaaagcagtatgtcgagaacttcgagaaggcgatggacgacgactttaatactgccgacgcgatcgcagcgatcttcgaccttgtcaaatttgcaaatacaaatctcgacgaggagagctcgggagacatcctgatgaaagtcttcgagaagatcgaaaagcttttaggcgttctgggactcgcatttacagttgataaagatgagatcgatccagaagttgaggaacttatcgagaagcgccagcaggccagaaaagagaaaaactttgctctcgctgaccagatcagagatcagcttctatctcagggcatcgagcttaaagacacgagagacggagtcaaatggaagagagtataagtgcgattagaagcacttttggaatagcagaacgcgatatcaggacatattcaccgctcaccctcgcgttcttaggtgacggtgtctttgagatcgtgatccgctctatagtcgtggcgggaagaaacgtctcgccatcaaggcttcacaacgcatctgcccacattgtaaaggcagagtcgcagagaaagatcaccgaagccattgagccgcttttatcagatgacgaggcggatatcttaaggcgcggacgaaacgccaaaagctacacccattcgaaaaatgcctctgtctccgattaccgaatggcgacaggctttgaggcacttttgggatacttgtatcttctcggaaaagacgagaggatactttttcttataaaacagggactcgagttgacaggcctttttaaggaccacactggagaatttgaggaaataaatcatgcatgacgaaagtacgataatcgaaggcagaaatgccgtattggaagctctgcgttcagatattacagtggagcgcatatttgttttgaagtcgagttacgacggaccgattcatacgattctccgcgaggcgaagagacagggcataaggactgattttgtagacaagtccagactcgatgagatctgccctgataaaaaacaccagggagtggccgcctatgtagctgctttttcgtactcatcagtcgacgacattcttgcaaagtcgaaagagaagggcacagatccgttcatttttatcttagatgagatcgaggatccgcacaaccttggagccataatccgtaccgcaaatatggccggtgcggacggtgtcattatccctaagaacagagccgtaggcctgacctcctcagccgtaaaggcttcggccggagctataagctacgtgccagtggcaaaggtcaccaacctttcgaggacgatagacgagttaaaggaaaaaggtatctggatctacgcctgcgacctggacggggagagcatctacaggacttcactgaccggacctctggctatcgtcatcggaaatgagggcagaggtatttcaaagctcgtcaaggagaaatgtgacgcagtcgtaagcattccgacatttggtgatatcgactcactgaatgcttcggtatcatgcggtgttgtagcttttgaagcagtaagacagaggcttgagaaaaagtgatctacttagacaatgcagcgacaactcagatgaagcaggaagttttagatgagatgcttccttattttcgagagaactatggaaacgcatctgcagtctacgagcttggaaacaagagtaaatacgctatcgatgtggctcgtgacagggctgcggcacttcttgatactaaggctgagagaatattttttacatccggaggttcagagtctgacaactgggcgctgataaaggcttcatccatgatgaagggcagaggaaagcacctgatcacgacttcaatcgagcatccggctgtgataaatacgatgaaagcccttcaggaagaaggttttgaagtgacttttctgccggtcgatcagaagggatttgtaactcctgagcaggtggaagctgcgataagagatgatacgactcttatctctgccatgtttgcaaataacgagatagggaccatcgagccgatcgcagagatcggcagagtcgctcacgagcatgggattcttttccacacagatgcagttcaggcgttcgggcagcttccgatagacccggataagatgaatatagatatgctctccgcaagttctcacaagatatacggacctaaaggcgtaggactattgtatttaagccctgcggcttcaaagatcaggtcgcttatccatggcggtggtcaggagagaaacaagagggccggcaccgaaaacgttccgggaattgttggctttggaaaggcctgcgaactcgcaaaggagacaatccagaagagaatggagcaggagtcgaagcttagggattattttatcggacgggttttaaatgagatccctctgacatacttaaacggagctgaaggatctgaaaggcttcctggcaatatcaatatcggctttaaatttatcgaagctgagtcggagcttatccttctcgatcagaagggcatagcggcctcgagtggttctgcctgcactgcaggttctattgacccgtcgcatgtgcttatcgcaataggacgcgacgagacagaggcccgcgagtcgctcagatttaccctcagtgattcgacgacagaggacgagctcgataagaccatagatgtcttgaaagagacgctcggaatgcttcgcgcgtcgaatcttttttatcaggattatattaaaaaaaatggctaaagtagtagttggaatgagtggcggcgtcgattcatcggtcgccgcttatttattaaaaaaacagggatacgacgttatcggtgtaacaatgcagatctggcagaatccggatcaggcctgccgcctcgaggagagaggatgctgcggcctttcggccgttgaggatgctagaagggtcgcaggagttcttggaattccttactacgttatgaatttcaaagaggacttcaggaaatatgtcatggactattttgtcgacgagtacagccatgccaggactccgaatccatgcatcgcctgtaaccgttacataaagtgggagggcctcttaaagcgcagtatggatattggcgctgacttcatagcgacgggccactatgcgaggatcgagacgcttccaaacggccgcattgcgataaaaaattctgtgaccgctgaaaaggaccagacctatgtcctctattccctgacgcaggatcagctcaggcacacgcttatgcctgtcggagactatgacaagccgaccataagaaaaatagcagaagaggccggtcttcctgtcgcccacaaacgtgacagcgaagacgtctgctttattcctgacggaaacaccggaaaattcttagatgatgagatgggcgataaagcttttggcgagggaaattttgtcgacaggaacggcaaaatcctcggaaagcacaagggcatcacacactacacgattggccagagaaagggccttggtatgggattcggtcaccgcgtctttgtgcagcacttagaccctcttacaaacgaagtggttcttggcgaaaatgaggacctcttttccgatacgcttgaagccgaccatctctgctatatggcagaggagcggttcgacgagaacaggctctatctcggaaaaatccgctactctgatccgggaacaccgtgccatgtaaagtacagcggcgactctttaattgtcacctttgaaaaaaaggtgcgcgcggccactcctggccaggcgctcgttctctacgacggagactatgtagccggcggtggtgtgataaagtgagagggagttgctgactttgcaggcagtcggtttttctgaggcgatatagtgataatttcaagctccgcggagctgctagaatgagattttctctggatgtctgtttttgtagacattgaaccaggagaatcctattttttttagttccggtattactttttcgtagcctatcgccacatccttcggttcgtgagcgtccgctccaagagtgatgtttcggccgccgagattgtagtagaatttgagaatctcgtatgatggatttggctcactcatcccatatctgaaggctcctgtattcacctcgagcgatttcccgtgttcaataaggtgctttagtattttttcaaaagtgtttttgaaatcatcaaatctgcagtccgcttcaggcgagccaaagtacttgagaccatatctgacgacatagtccaggtggccgagagtgtcataatcgtcgaaagcgcagatattttcatagacctgatcaaaatacatccggtaagcttcctgcgggctcttatcatcataaaagctcttgtagtacggatcatatccgctgatgacgtggacagagcctattacgaaatcaaatgggtattttcttgtaattgcatggtgcgtttctgcgagataaggctgaaggcccatttcaattcctgttccaatccagaaatcgggagactcattttcctttttaatctgtggcatttttttgaaatattcatcaaaatcgagatcaaagaggtgtggctcctctctgtaatcgatatcgagatgatctgtaaaacagatgcctgcaagacgtttttctttggcagaatttatcatgtcgagaggggatgcgtcgctgtctcccgagaaacttgtgtgcatatgtgtatcgtataacattgaattcctcccaattgataaaacaagtggctccgcggagcctgaaattatcactatatcgcctcaaaaaaaccgactgcctgcaaaccagcaaaacaagcagctccgcggagcttcacattatcgcagtatcgttttaactctcactatattagcacattttcgcaattttttgttaaatttataacaaaggcgaaatcagctcttgcaaattcagttgaaaaccgttattatataaattgtttatggagattgttccattaacaaaacaaaataatttttcgtaggaggaattacaacatggcagttagagtagcaatcaatggatttggacgtattggtcgtcttgcattccgtcagatgttccaggcagagggttttgatatcgtagctatcaacgatcttacaagcccagagatgcttgcatatcttcttaagtatgattcatcacagggtcgttatgcaaaggctgatacagttactttctcagaccattcaatcacagtagacggtcaggagatcgagatctacaaagaggctgatgctcataaccttccttggggaaagcttgatatcgatgtagttcttgagtgcacaggcttctacacatcaaaggctaaggcacaggctcatatcgacgctggtgccaagaaggtcgttatctctgccccagcaggaaatgatcttcctacaatcgtttataatacaaaccacgagacacttacagcagatgacaacatcatctcagctgcatcatgcaccacaaactgcctcgcacctatggctaaggctcttaacgagctcgctcctatccagtcaggtatcatggttacaatccatgcttacactggtgaccagatgatccttgatggaccacagagaaagggcaacttccgtcgtagccgtgcaggcgctgagaacatcgttcctaacacaactggtgctgctaaggctatcggtcttgttgttccagagcttaacggaaagctcatcggatcagctcagcgtgtacctgttccaacaggttctacaactatccttacagctgtagtaaagggtgacgttactgttgaccagatcaacgctaagatgaaggcttctacaaacgagtctttcggatataacgaggatcagatcgtatctaaggatatcgtaggcatgacctatggttcactcttcgatgctacacagactatggttcttccagttggtgatggaaacacagaggttcaggttgtttcatggtatgacaacgagaactcattcacatcaaatatgtgcagaactatcaagtatttcgctaagttccttaacaagtaatttctgcgaattacagaccttgattttacaggggtccggcttaagggccggactccttttcttttaacgaaaggaaagaacatggaacttaataaaaaatcagttgatgatattaacgtaaagggaaagagagtcctttgccgttgcgattttaacgtacctcttaaggatggtaagattacagatgagaacagactcgtagcagctcttcctactataaagaagcttattgctgatggtggaaaggttatcctctgctcacaccttggaaaagtaaagactgaggaagacaagaagactaagactcttgctcctgtagcaaagagactttcagagcttcttggacaggaagtaaagttcgctgctgatcctgaggtcgttggtcctaacgcaaaggcagcagttgcagctatgaaggatggagacgttgttcttcttgagaacaccagattccgtccggaggagacaaagaacggcgaggctttctcaaaggatctcgcttctttagcagatgtcttcgtaaatgacgcatttggtacagctcacagatcacactgctcaaacgttggtgttgctgaagagcttcgcaaagagggcaagccggctgttgttggttaccttatgcagaaagagatcgactacctcggcaaagccgttgaggatcctgtacgtccattcgtagctattctcggtggcgcaaaggttgccgataagctcaatgttatttcaaatctccttgagaagtgcgatacactgatcattggcggtggaatggcatatactttcattaaggcccagggttactcagtaggaaagtctctctgcgacgattcaaagatcgactactgcaaagagatgatggagaaggccaagaagctcggcaagaagctccttcttcctgtagatgctgtcattgttgacgatttcccggatcctatcgatggagatgttgatacggaagttgtagacgttacagctatccctgatggcaaagaggcctgcgatatcggacctaagacagctgagatgtttgctaacgaagttgcatctgctaagactgttgtctggaacggacctatgggcgtatttgagaacccgacacttgcagccggcactttaaaggttgctcaggctcttgcagattctgatgctacaaccatcatcggtggcggcgattcagctgcagctgtaaaccagatgggacttggttcgaagatgagccatatctctacaggcggcggcgcatcactcgaattcctcgagggcaaagagcttcctggaatcgcagcagctgacgagaagtaattcacttaatgagaatgagcataagtgaagctcgaatttaatgaattattcgttacctgcagcttaacgagagcaggcgacagcgccgttcgagttcagtgcaggtaacttctttagatagtttacttttgacttcgatcaggaggtttataaaaatgagaaagaagatcattgccggaaactggaagatgaacgagactcctagcgaagctttaaagctcgttgagactttaaagcctctcgttaacaatccggatgtagatgtagtttactgtgtaccagctatcgatatcgtacctgtagcttctgcagttaagggcacaaacgtacacgttggcgctgagaatatgtatttcgaagataagggcgcttttactggtgagatttcagctccgatgcttaaggacgccggcgtagagttcgttatcatcggacattcagagagaagaggatatttcctcgaggacgatgcacttctgaacaagaaggtcaagaaggcattcgaggccggacttacacctatcctctgctgcggtgagtcacttgagcagagagagcagggcgttacacttgactggatccgtatgcagatcaagcttgaccttgcaggtgttacaaaggagcaggcagcttctatggtcatcgcttacgagcctatctgggctatcggaacaggcaagactgctacagctgatcaggctgaggaagtctgcaaggctatccgtgatactatcgctgacatctatgatacagacacagctgagaagatccgtatccagtacggcggctctatgaagccggctaactgcaaagagcttcttgcaaagcctgacatcgatggcggacttatcggcggagcttctcttaaggctgatttcgctgatatcgtaaattacaacaagtaatttactctcatttagaattgaactgaaacaggatatcacagtttgtgttctgttttttggcacctgtccggaaactttccggacgggtgtttcttaatgttgacgtgttttttgtaattgttttttacactgctttatggcatcagaaaggaattttatggcaggatatacagtcgaagaggcactgcagtacgtggaagagaacgatgtacgctttatcagactcgccttttcagatatgcttggaaaccacaagaatatagccattcagccggatattctgggtaaggcattcgattcggggatagcttttgatgctttcaggatccttggatacgatgacccgaagtacagggacctctatttgaaaccggatccgaatacgctctcggtcctgccttggagaccacaggccggaagggttatcagattttactgtaatgtagtgacacaggatggcactccatatccttacgattcgagaaaatttttatctgacaccataaaagagtgtaaaaaagcaggtttctccgtaagactcggactcaggagtgaatttttcctctttaaaaatgacgaagatggctttcctactcaggagccgatggactccgccagctactttgatgtggcgccactcgaccgcggcgagaacataaggcgtgagatctgcctgacactatcggacatggacgttccgccaatctccagtcaccatgaggttggccctggacaaaatgagatagaattcagatcagccggagcccttcacagtgcagatcacttcatgacctacaaaaatgtcgtaacgacaatcgctgcgagaaacgggcttacggcgtcatttgagccgaaaccactcgagggacttcctggaaacggtttccatattaagataagcctcttcagagaagcgcagaatctgtttgacacagatcccgagatggtattctcatttatggcgggaatttttaacaggataagggaaatcacggtatttttaaatccgaagaaggaatcataccttcgttttggagaggattctgcgcctaagtacctcacctggtctcaccagaatgaatcgagaatgatcaggatcccgatggttcatgggaagtacgatttttgcatcctgcgttcccctgactcgatgatgaatccgtacatcgggtttgcgatgatgatacaggcggggcttgagggcgttaaaaataatgaaaaactccctgagccgcttgaaaagccgggctatctgataacagaggaagaccgctggaaatactcaaagcttccgctctctcttgcagaagcctacgatgtggcaaaggaatccggatttttaaaggatgagaagagagcagccatcacagagcggttcttaaacacattaaaggacaatgaactttaaggaggtcccctttggatagagctttagttatcagtgatgctccaaaggcgatgaaatttttcaaagactttctttcagcaaatggatacgacaagataaaactggcctccacagccgaagagggcagacaggccatggaggaattttctccggacatctgcgtcataaatgcgcctatcggaaacgcgagcgccgaagaactctcggaggagctggcatctgatatcagctgccaggtgatacttttcgtaaaggacgactatttcgaagatatcgccggacatgtgcagaaggcaggtgtaatctgccttgtgaagcctataagcaagtcgatgtttttttcggcactcgactttgcggaggcggctgacagccgaatgaaaaaggccgatgcagagataaagagactcgagagaaaactttccgaggtaagaattgtcgatcatgccaagagcatccttataaatcaaaaaaatatgaccgaggccgaggcgcacaggtacatcgagaagactgcgatggacaggcgtgtgccgagaggtcaggtcgcagaggagatcatagactactatacggattaattttacatatttaagtcatatgttgaatgttctccggaaataagatataatctaaaagttatctgagaaaaattaaactatagtgcagcgcgaaaggaaaagaaatggcaaagaacacaaagtttgttttcgttaccggtggtgtggtttccggacttggaaagggaatcacagcagcttcgcttggaaggcttttaaagacccgtggctacaaagtcgcatcacagaagcttgacccttatatgaatgttgatccgggaactatgagcccttatcagcacggagaagtgtttgttacggaagatggcgcggagacagaccttgacctcggccattacgagcgtttcatcgatgagaacctgaacaagttctcgaacctgacttccggtaaggtgtactggaacgtactgaaccgcgagagacagggtgagtacctcggacagacagttcaggttatcccgcatatcacagatgagatcaagcactttatttatatgggtgctgagacctcgaatgccgatgtgcttatcacagagatcggcggtaccacaggtgatatcgagtcacagcctttcctcgaggccatcagacaggtttcactcgagagaggtcacgagaacacgctgttcatacatgtgacacttgtcccgttcctcgctggatcgaacgagcacaagagtaagccgacacagcactcagtaaaggagctgcgttcactcggtatttctcctgatatcattgttgcccgtgcgaatgagccactcgagcagagcataaaggataagatctcacttttctgcaacgtaaagaaggactgtgttatcgaaaatactacaatggattcactgtatgaggcacctctgatgctccatgcgaatggtcttgatgacgttgtctgccgtgagcttgggcttgagaagaagaagccggatctcacagagtggcagaatctcgtaaagagaatccacaacctgaagaagacagtaaaggttggtatcgtaggaaaatatgtagcactccacgatgcctatctttcagtccgtgaggctttgtaccacggcggatatgagaatgactccactgtagatatcgagtggatcgactctgagaagatcacgaatgataatgttgccgatacgataggcggactcgatggaatcgtagttcctggtggctttggtgacagaggaatcgagggcatggttactgcctgcagatatgccagagagaacgatatcccgtactttggactctgccttggaatgcagatctcggttatagaatacgccagagatgtctgcggcatcgaagacgcgaacagccgtgagttcaatgagaacggacagcatctcgttatcgaccttatggaagagcagatgcgcatagtaagaaaaggtggcacgatgcgtctcggcgcatatccttgcaagatcgtcaaaggctcgatgctcgacaaggcctatggccttcgccaggtaaatgagcgccacagacacagattcgagttcaacaacgagtacaaggacgttctttcaaaggccggcctcaagatctcaggaacttcacctgacggttctatcgtagaagctgtcgaggagcctaagaaccgcttccacgtaggcgttcagttccatccggagtttaagagccgcccgaacaaggctcatcctctcttcagagaattcatcgcagcctgcgttgacaagcacgaagctaaaaattaacactactgattaagggtccgttgcaaatttgcaacggacccttttttactatagactgtcgcagagccggaaatcttttagaagtgaaatactatcttcttgatagcttcaatcggcatatcgagccctgtccattctttgaatgaggctgcgccctgatagaggagcatttcctcgccgtttttatatggacagccgacttccttcgcgtaggagagaagagtcgtctctgccgggtggtagatgatgtccgagacgaagaggtccggacgaagaaattcccttggaacgaggcttgtcttatcgtcctccatcccaacgttcgtggcattcgtcaggatgtcagatgagaggatagagtcgcgcatggcatcggagtcgtccattgggaaaacgaggatgtcgcagtctgtagaagcgtttatcttctcggcgaaggcttcagtctcctcgtaggtcttgttttttcttttaaaaatatcaatgcgctttacgcccgagagggcagctgatgcagcaatggatttggctgcgccgccggcaccaaggagcgtcattttcttaccgtggtagtcgaaacctgaatccagaagggaattcagatagccgatgccatctgtagtatcacctataagtacaccgtctttgtttacgacagtatttacggagccggacagctctgacgcctttgttatccggtcgataaacgggatgactgtgttcttgaaaggcatagtcagattgaatccgcctgccgcaagaagcctcagagcttcgactgctacagctatctcgtttggctcaatgtcaaaagcgagatagaccatatttacaccgagaagctttgcagctgtcgtgtgcatagcaggtgaaatactgtggcgggcaggatgccctaaaagacagtagagtgtagtgtggccatctataaaagaggccgatggtaatttttccatatcacgcctgatctgcaatatcgtaaagcagtttttctgtatcatcccagcctaagcatggatcagtgatagactgtccataggtctggtggtcggagatcttctgattaccttcgactaagtagctttctatcatgacgcccttgacaagattgtggatgtcaagtgagaagcggcggttgtgcatgacttcgtgcacgatacggatctgatgcttgaacttctttccggaattcgagtgatttacatcgattatcgaggcctggtttacgacgtccatctggtcgtacatgaccttaagcctcatcagatcctcgtagtggtagttctctgaattgttgccgtgtctcgatacggcgccgcgaagaatagtgtgtgccagaggattaccggtcgtctcaacctcgtaacctgcaaatgtgaaatggtgcggatgctgggctgcatagactgagttgagcatcactgaaaagtctccgctggtaggatttttcatgccgcttgcgacatcaaaacccgagacagtcagacggtggtgctggtcttcaacggaacgggccccgatggcaacgtatgagagcagatcgtctacatagacccagttctccgggtagagcatctcgtcggcggctgacattccgtactcctcgatggagcggatatgcatatgacgcatagctttaaggccggccaccatatcaggtgctcccatcggatcaggctgggtggcaatgcccttgtagccttctccagtggtcctcggcttattggtatagattctcgggacaacaagtaccttgtctttgatcttatctgcaaccttagcgagacggctgatatagtcgatgacagcgtcctcattgtcggctgaacacggtccgacgatgactaaaaatctgctgtcctttccagtgatgatatcggcgatctcctggtctcttttcttctttacagctgtgcctttctctgaaagagggagttcactctttatctcatcaggcgaaggcattggtcttagatatttaaagctcatctttttttcctttccttgctaaatcagccttcttatgataaagtataaacgttattttgtcaatcggaggaagagacgtgaaggtcagaggacttgagttaaataacaggattccggctgtctgtgtacctgttacagacactgcctgttcagatatcacagagcatattagagatctgtcttctcagactgatatgatagagtggaggatggatttttttgaagatattgcctcacttgaaaaattgccgcatatttttaaggaagtaagaactgctgcgggagatacgccgcttatctgtacgttaaggacacagaaggaaggcggcagatacagcgggaatgattacgaggatgtgcttaaggcgtgtgcagccagcggatgcgcagatatcgtagacattgaatacgatacgatctcgcacagcagaagcttcatttcggagatcagcggatctggcgtaaagaccatcctctcacaccacgattttaagatgacaccggatggaaagacgatgtttgactatctcgagggaatgagagatgccggggcagacattgtaaaacttgctgtaatgccgcaggatgcactcgatgtcgaaaggctgttaggagttaccgtcgattttcatctgaagtatccgaatacacctgaggtcactatgtcgatgggaaaaacaggcgttatcagccgtgtttcgggaggcacttccggttcgtgtatcacatttggcgcggacaaagaggcgagcgccccgggacagctcgattaccttgaactaaaagagattattagaattttggctgaagcaggcagggactgatgcagatatatttgattggatttatgggaactggaaagacttctaccggagaggctctctcgaagcttaccggaagagagctttttgacacagacgacctgatcgtctctcaggagagaaagtcgatcacagagatttttaaagagtcgggagaagagggctttcgggaaattgagaccggagtctttaagaaactgtctgaaaagcaaggcaattcaataatctcctgtggaggcggtgcgccgcttagagaaaagaacgtatcttatatgaagaaaaacggcacagtcgtgcggcttactgcgacggcagagactgtgtatgacagggtaaagggcgatactttaagaccgcttcttcaggcaaaagatccgctcgagcgcatcaagactctgatgaatcagcgggaggaggcctattctgcggcagctgatatcactgtagagacagatgataagacccctgaggaggtggccaccataatctgtgaatccttgacaaaatagtgacatcttggtatcatagctgtactgggcttttttacatgggcctttgtgtgtaggcgtagcgcagctggatagcgcgtcagactccgactctgaaggccgtgggttcgaatcccatcgtctacatttttttgaatattatgatttggtgatcaataggttggccactatatcatatgattgtgagggagggggatcatttttttaggagcgtaatatgaagtatttagatcccatcaagaaattttttaagaataaaaagcacattgaagcgatagtattagccgtcatttttataatcgtcatagctgtttctgccagcagggtaaggaagctgcggcagggagcggcctccggagatgcttcggcgaagaatgcgtttattctgactgatgcctccggcaacagcacgcagaagtccactgtctataagaaggagaagaggaactctaatctccacgatctcctgacagaatactataagtactacgcagacggaaacacttctaagatagaaagcgttgcttcgcctgtttctgatatggagaagagctacatcaaattcatgggtagtctcatcgattcctatgatatcaaggagatctataccaaggacggcgctgagaaaggcgccaggtttgtctctgtatacgagcagatccatttcaaggggcttaaatccgcagctccgggacttgactttttctatgtagagaaggacaagtcgggcggcctgcatatcaataacctttacagttcgttcaatcagacgaacaaagagaacgacatggatcctaaggtcgtatccgctatcgcttcttttgaggagcagaaggacgtagtaagccttcagacaaaggtccagaaggaatacaacgagatctctctttccgacaagaagttcgagagcttcatgagcaagactttccctgccaaggtaaaggcatggcagttaaagtacagaaaggaagcagagaaggcagaggcagcagccaggaagaaggcggctgagaaggctaagaagaaagcggcagaagataagaagaaagctgaagaggctaagaagaaagctgaggaggctaagaagaagtctgattccgataagaagagtaaagacacttctgagagcacgaagccaaagggtgaccagtacaagaccactacggagacgaatctcaggaagagcgattctgtcaagtcagatataataaagactctgaagaagggtacgactgttaccaagaagggtacgaagggcaagtggcttaaggtatcctacaagggtaagaccggctatatcagaaaggaatacgtaaagaaagtaaagtccgcgaagaagagcgactcatcttcctctgataagtcgaagaagaaatcatcttctgagaagaagtcatcttcagataaaaagaagtcttcagataagaagaagtcttcagataagaagaagtcgaaagccaaaggacctaaggcaggaaagaccatcatgctgatggatacctacaacatcagaaagagcccttcgagttccgcaaaacgaatccacctcgcatacaagggcgagaaggttactgtgatctcgaatcagagcgatggctggacaaaggtcgcttgcagtggcaagataggttacatcaagacagaatatttgaaataatacaaagggctgtgagttttcacagcctgtttttttaaggtgaatatggaagagataaggataaataaatatctttcagagtgcggatactgttcgagaagggcagcagataagctgctcgaggctggcagagtcacggctgacggcagaaagctgagaccgggagacaaggtcacagccgatatggatgtaagagttgatggaaagcctctgcacatcgaggacgagcgcgtggtactggcttttaacaagcctgttggcatagtctgcactgccgagaagagagaaaaaaataatatcatcgattccatcggctacccgatcaggatctatccggtcgggcgactcgacaaggattcacacggactcatatttctgacgaacgacggaaatttcatgaacaggatgacgagcgccagatttggtcacgagaaggagtatatcgtcactgtaaataaagaagtgactgctgacttcgtgaaaaaaatgtcagcaggcgtctatctcccggctctttaccagaagacaaggcgctgccgcgttcaaaagatccgctacaacgcatttatgatagtcttaaatcaggggctgaaccggcagatcagaaggatgtgcgaggccttaggatacaaggtcacagatctctacaggacgcgtatcggcggactaaagcttaaggaattagacctgccggatggtcaatacagggagcttaatcaggatgaattacgaaaattataaggcgctgtgtataaagataaattatcacatggacctctactacaataaaaatacgaacgagatcagcgactacgagtacgatcagctgatgcagcagctgaagcaggctgagagagaacatccggagtgggtgacgcctgactctccttcgcagaagatcggaggttctgcgaaacgtgaggccggagtgaaggtcacgcacagagtcccgatgctctctatcgaggatgtattcaataagaccgatgtcacagcctatgtgacgaaggttaagtcggtgcatccggacgcagttttttcagtcgagagaaaaatagacggactttctatgacgcttcgctaccagcacagtgatgcagacggctttcttcatctggcacttgctgagaccagaggagacggccatatcggagaggacgtgaccttaaacgccagagtgatccctgacgtaaaggaggtaatagagcttccgttcgaatatctggagctccgtggcgaagtctatatgagccacgatgacttctttaaatacaacgattcgatggaggagcaggggaaaaagcctgctgcaaatccgagaaacttagcagctggaacactccgccagctcgatccgcggattaccaaagagagagggcttcggatgtttatctttaacgtccaggatggaccagctgaatttatggcttctcagacgaaggccctcgacactctgcgtgaaaagggcgttccggtagtatttcacaaaaagtgcgctaccgcagatgaagtcctttcagtaatagatgagatcggatcgacccgcgatgggctcgacttcgatatcgacggagccgtcgtaaagatagatcaggtcgcataccgcgcagactttccggctggagccaaatacagcgccgggcatattgcttttaaatacccgccggaggaaaagcgcgtagtcatggacgagatagaagagacagtaggccgtaccggaaagatagggtttatcggacatatttcggatgaaaagaccagaaagccagtgcggcttaacggcacaaatgtctcgagagtcacactgcacaaccaggactatatcagggagaacaggatcggtattggaggagtctatcttctgaagaagtctggagacataatcccgaagatcagcgggacggtgaaggatccggaccatatatttacggtggaaagtgactgtcctgtctgccatcatccgctgataaaggaagaggatactgcagattactactgcgtgaatccttcctgcccgtcacagcttgtgcggactctcagctattttacaagcaggggatgcatggacatagcggggctcggcgaaaagcaggtcaaaaacctgatagatgcagggcttcttaagagcttttctgatatttacagactaaaagaccacagggatggactcatcgctgccgggatcatcggcagagaaaaaaataccgacaagatactcgcggcaatcgaagcttcgaagcaacagggaccggtcagactcttaacggcacttggaatcaggaatgtcggcggcaggactgcccagacattgatcgatcactttcattcgatagacgctgtcatgaacgcctcgaaagaggaactcgtcgaaatccctgatgtcggagagactatagcagatgatatcgtctcatttttcgcagaggatgatactaaggagcttgtaaaggaacttaaggacgaggggcttttaatggaagaggccattgaagagaagggcgcttcgctcgaggggcttacgatagtagttaccggaactctccctacactttcgagaaatgaggcaaaggagcttatcgagaaaaacggaggcaggtgcaccggttcagtcagcaaaaagacagattacctcgttgcaggtgaggcagcgggaagcaagctgactaaggcaaggcagcttggaatccctgtgatttctgaagcagaccttattgcgatggcaggcagataaaacacttttatgtttttgaatattgaaataaatgcagtttagtgtgaaaataattcttgactgatttttctgaaaggagaagagttatatgccaatcagaactcaggcaaatatgcctgtaaacgatattctagagaaagaaaatattttcctgatggatgagaacagggccatgcatcaggacataagacctattgagataggaatactgaatcttatgcctctgaaagaggacacggagcttgcccttttgagatcgctgtcgaataccccgctgcagatcgacgtcaccttcctctgcacgaagtctcatatggcgactcacacttcgatgagccatctgaacaaattttacgagacatacgacgatataaaggaaaagactctcgacggccttatagtcacaggcgctccggtagagcttctgccgtttgaggatgtggactactgggatgagctcacgaagatatttgactgggctaaggagaacgttacgagcacacttttcctgtgctggggcgctcaggcggctctgtactattactacggcatcagaaagatcactctgccgaagaagctcttcggtgtctatccgcatcgggtatcacacagaaaagtgcctcttgtcaggggattcgacgacatattctgggcgcctcattcgagaaatacgagggccgatgatgacgcgataagaaaggacgacaggttcataatcctcgcagaatcgcgggaggcaggtatcttccttgctatgacaaaggatggcagcgagatatacgtcatgggtcaccctgagtacgaccgcatgactcttgacaaggagtacaagagagacaaggccaagggcattaagatcgatctcccggtaaactactatccgaacaacgacgtaaaccagaagccgctcctccagtggagaggccacgcgaacactctctacacgaactggctcaactactatgtataccagaacacaccgtatgagatgaatcatataaaaaagaatctgagatgacagaaaggggcagctgcaaaaatttgcagctgccccgattttttttaatgagcgtgtcactggttattcgatttctcgttctcctcgacttctctcatcttcatagcccttaccttcatcggaagaccgaagagggtgatgaagccctgtgcgtcgtggtgatcgtagaggtcgcctgtagtgaagcttgcgagggactcgttgtagagtgagtatggtgaagtcgtgccggctttgatgatgttgcccttgtagagctcaaaacgaactgttccggtaactggcttctggactgtctttgtgaaagcgatgagtccgtccatggtaggggtgtaccacttgccttcatagacgagctgtgccatgcggttggctacgtccttcttgaagtccatcgtgtctctgtcgagtgtcagctcctcgagctgtttgtgagcctcgcagaggatagttccgccaggagtctcatagacgccacggctcttcatacctacaacacggttctcaacgatatcgatgattccgattccgtgctttccgccgagacggttcagctccctgatgatgtctgcgaccttcatcttcttgccgtttacagatgtaggaacacctgactcgaaggtcatcgtcacatattcgccctcgtccggagcctcctgtggaggagtcgtgagtacgagcagatgatcgtagttcggctcggccgaaggatcctcgagctcgagaccttcgtggcttatatgccagaggtttctgtctctcgaatatgactggtctactgagaatggaaggttgatgccgtgagccttgcagtagtcgatctcgtcctgtctggactgaagtttccacttgctgtcacgccatggagcgatgatctttatatcaggagcaagtgccttgatagagagctcgaatctgatctgatcgtttcccttgcctgtagcaccgtggcagatggcaacggcgttctcctttctggctacttctacgagcttctttgaaatatcagggcgtgccattgatgtaccgaggaggtacttatcctcataaactgcatcagccataacacatggcataatgtaattctcagcgaaatcatctgtgatatcctcgatatagagtttgctggctcctgagagctttgccctctcttctagtccgtcgagttcctcttcctgtccacagtcaacgcagcagcagatgacatcgtatccgtaattctccttgagccacggaatgatgctcgtggtatcaagtccgcctgaataggcgagaacaactttctcttttgtcataataagatcctttcaaaaaaatttaaccaacgacaatatattacactatgacgggacagagttcaagcgtaaatttatacatttttatccgaaatttatgtatttttaatcaaaacaattcttgatttttcaaaatgattgttgtattattatgcacatgcgaaaaatctaccacatttaaaggcggttgtgatatgatatacatcgtgaggtttttatgtataaacttagagctatgacaatagaagattttgaaaaggtccatgcgctctggatgtcgatccacggcttcgggatcaggtctatagatgattcgaaggaaggcgtggaatcttttcttaagagaaatccgggcttttctgttgtcgccgaggatgatggcgagatcatcggaagtatcctctgcggacacgacagcaggactgcctgtttttaccatgtctgcgtcagagaggacagacgacgacagggcatcggaaaggctatgactgtctggtgcatgaagaagctacacagtgcaaatgtgaataaaatttcactcgtggcttttaaggacaattcagtcgggaacagtttctggcaggctgatggctggaaagagcgggtagattttaacgtgtacgatttttacctgaatgagaaaaatatcacgaactttaataaatagagtttcgaaaggagtaatatgaaggttatttcgggcggagttacggctccaaagggtttcaaggcggcgaatactgctgccgggataaaatacaccggaagggatgacatggcgatgatcgtaagtgcatctccgtgtgtggccgcgggcacttttacaaagaatgtagtcaaggcagctcctgtcctctacgataagaaggttatcgcagagtcagatgagatccatacggtagtcgtaaatgccggtatcgcgaacgcctgcaccggcgatgagggttatttttactgcagcgagacaagcagggctgccgaagaggctcttcacttcggagagaattcgacgatcgtagcctctaccggagttatcggtatgcagcttcctattgataaggtaaaaaatggtgtcaaggctctctcgggaaagctcgacgatactgaagaggctggacttaaggccgccaaagccattatgacgacagatacgaagccaaagcagtgtgctgtagagattccgatgagcgacggaacgactgttactatcggtgcgatggcgaagggaagcggaatgatccacccgaatatgggaacgatgctctgctttattatgactgatgcgaagataaagaagcagcttttacaggaggctctctcatcggtagtctgtgacacttttaatatgatttcagtcgacggtgacacatctactaacgatacctgcgtagtgctttcaaatggggaggctggaaacaaagagatcgacgcggaaggtgacgatttcaagaatttcaaggacggacttttctatgtcgcccgcgatatcgctatgaagatggcaggagacggagagggcgccacggctctgtttgaagtgaaggccatccactgcagggacaaggctgaggcgaaagtttttgcaaaatctgtcatcacttcaaacctgacgaaggcggctatttacggacacgatgccaactggggcagaatcctctgcgcactcggttattccggcgccgaatttgatcctgacaaggtcgatatcactgtctcaagtgagaatggagagattgtcctcgtaaaggacggcgttgcagacgactacagcgaagacgaggccacaaaggtcctgtcttccgagaaagtcacctgcatctgcgatatgaagcagggcactgaagaggccacggcctggggctgcgacctgacatatgactatgtaaagattaacgcggactacaggtcatgacattcacttcattattggaaaaaggagaagaataaaaatgataatgcgacaggacgagatgcagacagtcatgaaaaaggccgaggtccttatcgaagcactgccttacatccagagattcaacaggaagataattgtcataaagtacggcggttcagccatgctcgacgagaatttaaagcaggaggtcataaaggacgtcaccctgttaaagctcgtcggattcaagcctatcatcgtccacggtggcggcagggagatttccggctgggtcaaaaaagccgggatggagcctaaatttataaatggtctccgtgtcacagataagcctacgatggatatcgccgaaatggtcctaaacaaagtgaataaatcgctcgttaccatggtcgagcgcctcggagtaaaggcctgcggcatcagcggaaaggatggaaatcttttaaatgtcgagaaaaaatactcagatggaaaggacataggcttcgtcggcaatgtaaaaaatgtcgacacgaagatccttcacgacctactcgacaaggactatctccctatcgtctgccctatcggaatggacgacgactacaacacttacaatatcaatgcggatgacgcggctactgccattgcagaggcccttgaagccgacaagctcgcatttctttcggatacaccgggtgtgcttaaagacaaggacgaccctgcgtcacttatctctgagctctctgtctcagaggcgaagagcctgatagaagacggcactatcgagggcggaatgctccctaaggtaaagagctgcatcagcgccattgacaacggcgtccacagagtccatatcttagatggccggatcgagcactgcctgctgcttgaaatttttaccaataaaggtattggaacagctattttatcagataacgaggaacgctacgatgaacaaagataaatttataaaaaaagccgacaagcacttgatacatgtgtacaatcgcttcccggtgatctttaaaaagggaaaaggggtctatctctacgataccgagggaaagcagtacctcgatttcggaagcggaatcggagtcatggccttcggctacggtgacaaagagtacacaaaggctctgaaaaaacagatcaaaaagatcactcacacttcaaacctcttttacagtgagccgcttcttggcgctgttgaaaaactctgcaaagtcagcggcatggacagggcattttttacaaattcaggtgccgaggcgatcgagggagccttaaagaccgcaaaaaagtacgcgcataaaaaatatggcaaagagagataccatatcatagccatgaatcacagctttcacggaaggacagttggtgctgtgtccgtcacgggaacggaaggctacaggacaccgttctatccgctgatggatggcgttgatttcgctgaatttaacgacctcgggagcgtagaaaagcttgtaaatgacgacacctgcgctattatcacagagactgtccagggcgagggcggcgttatgccggctgctcctgaattcatgcaggggcttcgcaagatctgcgacgagcgcaatattttactaataatcgatgagatccagtgcggactcggccgtaccggaagcacttacgcattcgagcagtacggcataaggccggatattttaacgactgcaaaggcacttggcggcggtgttccggtcggagctttcctcgttacagaagaagtcgctggaaattcgctcgagccgggcgaccacggaagcacatacggcggaaacccgttcgtcctcgcagcagtaagcaagtcgcttgatatcatcgaagacaggaacctcccacagcatgtaaaggagatgagcccttactttgaaagcatactggacatgtttactgagaaatatccatttgtcgagggccacagaggtctcggcttcatgcagggacttatcatcgacaagagcattccggtcggagagattctgaacaaatcccttgacgaagggctcgtcctgctctcagccgagggcaatctgatccgcttccttccgccgcttatcatggaaaaagacggatttgacgagatggaagagaagcttaccagggtgctggatacttttctgtaaatgccgatatttaaaaaggccgctgcatttcacctggaaaggaaattgcagcagcctcttttttatgtcataaaaaaatccacttgataataacagcattttcctctaaaatagaagttgcagtgcggatatctccttatattttttgaggagatacatatgaagagaatattttttctgctggtgcttgttatgagcctcattttaggaggctgcgctgattcgtcttatttagagaagaacggcactgcaagcgggagtgatcagaagtcggagagcaaatcaaagggcggggagactgctttaaagtcggtcagtaagtcggagaacagctcgaagatttacgtccagatagacggagctgtaaagaagccaggcgtctatgctctcccagccgactcgagagtttttgtgctgattgaaaaggcaggaggcctaaggaaggacgctgcgtcttctgcgctgaatcaggcggagaagctgactgacggccagaagcttactattcttacgaagtcggagtataaaaagaaccagtcgggcgaagggacagctgtaaatcctggcactgcttcttcaggaagcgctgtcagcgggtcagagggctcttctggtcttatagacatcaacagggctgacaaaaatacactgactacgatcagtggcatcggcccgacgagggcggatgcgatcattgaataccgcacgaagaacggcccgtttaaaaatactaaagatattacaaatgtcagcggcatcggagatgccacatttcaaaagattaaggataagataacggtttaaaggaagactatggcacggattcttgtagttgacgacgagaagatcattgtaaagggtatcaagttcgctttagagcaggacggaaatgaagtagacactgcctacgatggcgaagaggctgtcgggaaagctctatcgagtgagtatgacattatacttttagacctgatgctcccgaagctggacggttacgaagtctgtcagcgcatcagagagaaatccaacgtgcctatcataatgcttacggccaagggcgatgatatggacaagatcatgggactcgagtacggtgcagacgactacatcacgaagcctttcaatatcctcgaagtcaaggccaggatcaaggccattctccgcaggtcgaagcctgaggagaagaaggacagcgatgtgatagagagcggggacatccgcatagataccgcgagccgccgcatttttatcaaggaaaaggagtacaacctgacttcgaaggaattcgagatgatgctgctcctcgtaaatcatcctggaaaagtctacagccgcgacagccttctgaaagaagtctggggagtcgactacccgggcgacgcgaggaccgtcgatgtccatatcagacgtctccgtgaaaaaattgagccaaaccctagtgagccgcgctatatccatacgaaatggggaatgggctactattatcagaagtgacggatagaggcagatgaagcaccggttttctttttttaaaaaactgcatagtttaaaaacgctgcttgtagtagcttttattcttataggatttgtccctggttgtgcgatcgggggcattttcttgtatttttatcagcagagggctttaaataatgacactgtctctatgacgtcgcaggcccagcttttaaacgatcagatcatttccacaggttatctgcaggatacagatattgatgtcataaatacccagcttaaggcgctcgggaatatttactcggggcgaatcattgtaatagataagactcttcgcgttgtaaaggatacctacgacttaagtgacgggaagacgttcgtctgggagaatgcgattctcggactcaagggcgagaggaccagcgtctatgacaatgtaagccactgccttattcttactgtccctatcacagcttcagacagttccaacaatatcgaaggtgttatacttatcacgaaatcgacagactcgattgagcagaatatcacattctaccgcaatctctatacatatctgctgctcgtgcttgttgtaataatggcgatcttgtcggtatttttgtcagaccgcttcagtggcccgttcgaaaaactcgccgaccttatcctgcattcgcagaattctcacgataaagtcaaagtcgacagctttatggagactgaaaaaatttccgagaattttaacgaagtcatgcagaagatgcgcgacatcgacgagtcgaggcaggaattcgtatcaaatgtgtcgcatgagttaaagacgccgctgacttctatgaaggtgcttgcggattccttaaactctatggaagatggagccccgctcgagatatatcaggatttcatgcacgatatcacgaatgagatcgacagggagacaaagatcataaacgatctcttatctcttgtcagaatggacaaatccggtgccactatgaatatcgagtcgaaaaatatcaatgagatgctcgaatcccttctgaagcggctcggacctattgccgagaagcagaaagtcgaactcgtgcttgaaagtttcaggcctgtaaatgcggaggtcgatgaggtcaagctttcgcttggcattatgaatctgattgaaaacggtatcaaatacaacaaggagggcggatatgtccacgtgtcattaaacgccgaccaccagtatttttacatcactgtcgaggacaacggcatgggaatcccgaaggaatccttagacaggatcttcgagagattctaccgtgtagacaaatcgcactcgagagagattggcggaacaggccttggcctcgcaatcacaaagaacgcgatagacatgcatcacggcgatatcaaagttcactcgactcttggcgagggcactacctttgatgttaggatcccgcttatttatattaaggagcagtcatgaagaattttttaaaaaaatcagcatacattctgctctgcatgacactcgctctgtctcttttttcgtgcggacagaaaaataaaacaaaactgaataagggcttcataaaggtatattatctgaaccagatgaaaaccgcactctatcctgtcactgagaaaccgaagggaaacagcgccagaaagaggatcagcaatctccttgaggagctgtcttcgccgaagtctgacaaagactatacgaactctatccctgatcaggttatcatcagaaatttcaccttgaagaaaaaacagcttgtgatatcgttttcacacgactacgagactcttacaaaagtagaggaggtgcttctccgcgcatcagtcgtaaagacactcgttcagcttccggaggtagactctgtgacttttcgtatagtagatgagtcacttctcgacagcgcgggaaacgctatcggcgcaatgacagacgagtcatttgtagacgacttcgactttgaacaggatgccactaaggctgtaacacttactctctactgtccggcatccgatggcagcggactgatcaaggagtcgagagaagcgcacatcaatgaaaatgtgccgatcgcacaggcggttttaagtcagctctccaagaaaccggattcgaagaatgccgatgtgacactgcctgcctctgtcaaggtgctctccgtaaatgtaaatgacggtatctgctatgtcgacctcgattcctcacttgagaatgccggcggcaatgtccctgaaaatatgaggatatattcgatcgtcgattcactctgccagctcgatcagataaacagagtacagatcataataggctccggagacgacgctaaggtcgtaaatgacagcaaaaacaacagcacctacagcccgaactataaccttgtagtttcaaaatagcagcacaagtgcataaagccggtcaattcgctatagtctttttgatgcggccgttttgtatccgaacctgtcctgtgtctatcgtgcaaaatgacttaagacccagtgtatttatcctctccatcgtctgctttcccgggtgaccgtagcggttgccctttccggctgagatcacgataaggtcaggatttatctcagaaagccacctttgacagtttgaatagttacttccgtggtgtgcggattttaaaataagagtttcctctgcggagctcttttttaatttgtctttcgcatgctctagtatgtaaagttcctgctccccgccgatgtcaccggtctctattatctttatgctctgatcagagccgggcgagagcgtgaaaaggtttacaaggctgttctcgttggctccttcgaactcagactctctgtcggggtagatagtctcggctttaaaatatctgcagccaagtgagtcgcccccttcaagacccgagatctttatcccgtgggaagcgcagaggcttttcagcctgctcagccgctcgtcctcttcaatatgttctgagataaagactgtattgaccgggtagtttttatttataagctcagtcaggccgttcacatggtcctcgtccatatgcgttacgaaccatccctcgacgcctgtgatacctcggtatttaagcgagggtaggatcacattttttccaatctctttctcggtggtgcttcctccgtcgatcataaaggccttcccgtctgcggtcgtgatcataagcccgtcaccttgtccgacgtctaagaacgcaaattcgtctctatgattcggaaatgacagtattattattacagtaaacgacagcagcgtaactttaagagctgtcgctttatctccgaacagaggaaagacggaagttttctgccagtggattctcgtaaaacgcctcttgaacatcttaaatgtcatatttttaaagatgtaagagagcatcagcacaacggcgaggcagattacggtctttaagacagagatgtctcctgtgactatatttgtaaacggcagtttattgaacagatcagacgccatttcgtaccagtacattatcagatggcaggggaacagcagtatttttgcaagcggaagggaaaaaagtcccaaaactcctccgagcaggccgaggacaagcacgcacggcagaagcggaaggatcactatatttaaaataaaagagagcagcgggaagctgtagaaaaatttcgcgtttaccgccgccattgaaagctggataaaaaatgagaagataagagacgaagtcaggccgtccagggcggtcggcttgtagcggtttcccttgatctccttgtgagtgttttcccagcgcagaatgcagaaagccctgtagcagtccgcggcaggaatcgaagtctgcgccagcagaaagaccgccgcaaaggacagcgaaaaggctgtctgtgtcacggcgagaggatcggtaaggcatattaatatcgagacggctgcaagtgagtttacaatatcaatcttgtctccgatgacttttgaaagcatcattaaaagatacatcacaagggctcttctgcacgagacagaacctgagatggacgctgcaaagaaaaatacaaataccgaggatattatggcggagatttttgtcctgataccgaggcgttttaagagtttaaaaattaaggagcctgttatagagatgtgaaggcctgagatcgccaggatatggcttaaccctgcgctctgaaacatctcttttacataagagtcaagaaggctctttgtgccgatcgtaagggaggccagaagtggaccctcttcgttcggaagcgctgcagtaaagacagagtatatcatgtacttaagctgccagagagcttccattatcatgtaatagagctgtactatcggaaaatttgtcccgcctgacggagtaatatctgcgtcctttatctggcaggcgacggacagtcccttgtagtacgaggcctgatcgaagcagcctgggttccttacaggggaaaaagactctggtgtacctgtgacgcggactttagttcctaagggaagggaggtgtcatggactgccatgacctttgtctgctgggatctgagggttatcgtcatctttgtcccgtaatctgtgatctcttttccggtgatctgtccgtataaggcggacgatgttgtactggtgagttctttctcgattttttcataggaagacagacggatatgggcggataagagtcctgccgcaaacgacgctgccacaacggcgcagagggctatggcgctcctggtctttcttctgtaaaaaataaatggcagcaggcagaacggaactgcaaaaagaatcggctttctgatgagaacgatacagactgctgaaagcatcgatacggctgtgatgagcacaggacgtttgtacatatgactctcccccttcatcggtgcggccccttaccgcagaaaaaatgttgtgtttattatgcactctttttttagaaaatgcaatagaacatatggcgtatcagaaaattgcgtgatataatatttcactgaacgggaggaattttatcaatggattattcggtagatttcaggctggtcaggttgtttaaagctttgggagagaaagacagggattacaagaccatagaagagtatggaaaggatatcctgggatctaaggactttcgaaagatagttggacagaagcatcatattttttctacagtcggatatcacagcgtgcatgtggcacagatcatgctccttatgtcgcgcttttttgatatggacgagaaggatattgtaagaggaagtctctggcacgatgtcggcatctatgacagggattcgtttgttgacagtatggatacggctatcgagcatccgaagcgttcgcttgaggcggcttttgagaccggaactctcgatgacactcagtcggatatgattgagcaccacatgtggccggtaactcacgagaggcctgttacaaaggagggcttctttatcacgatcgcagacaaagttgccgcagtcacagaatttttgaagttccatgacgacaggatagatgccgttttagacagcggtgccggagaagaaaatgcgctcgattgacagcgagatctcgcagggaaatttcaagagggtctaccttctctttggaaaggaacactaccttttaaaggagaacagggagaagctgcttgcggctttaggcgttactgacaggaaggatatgaatttcaccctgcttaccgagaaggatttttcagttccggcccttatttcggatagtgatacactgccgttttttgcggaccgaagggtgatcctcgttgaggagagcggctacttcaaaggaaagaagagcgagaaagaaaagctcgtgtcatatattccggatattccggatacgacggtaattatctttgtcgaaagcgatgttgacaagcgggataagctctacaaggcagtatctaagaacgggactgccgaggagtttcttatcggagatcagaacgagctttcggcatggatcggtgggcggcttaaggcagacggcctccagatgagacgtgatgcctggaatgaattctacatccgttgcggctcgtcgatggatctgatggacgctgagtaccagaagctctcggcttactgctgggataagaagcagatcgagaaggccgatgtcgaggcggtctgtgcgaatgcttccgagacgaagatttttgtgctgagcgatgcgctttcagaacggaacgcggcaaaggtctttgcggtatatcaggacatgctaaggcagaatgagaaggctccgggaatactggctcttattgagagacagcttaagcagctctatcagcttaaagttatggacagggacggcgtgtcctttaatgacaagaagaaaaaactcgggatctcgtacgattttataataagaaagcttgagacttacagcaggagattcaaagagagtgagctgcgggaacttttaagatccgcggccgactacgaagaggcatttaagagcggcaggatcgacgacagtattgccgtggagctgcttttaaatcagacattacagtaaaaaaataaaacctgtccggctgacggtaccggacaggcttttataataattagttcatagcgttaacagcttttgtaaggcgtgaaacctttctggctgcattgttcttgtgaaggatgcccttagactctgccttcgggagtgctgactgtgcagtcttgagtgctgcctcagctgctgccttgtctccgctggctactgccttctcgacgttagtaactactgtcttgacgttactcttgatagccttgtttctggctgccttcttagcgcttactaaaactctcttcttagctgacttgatgtttgccaattctgttcacctccgttgcattgatattcacgtgaatatgatgctgaggattgacacggttctcccaagcaatcatacttttctatcatacagtttgaataagtatttgtcaagtaaaatattctctggtataatagttcgtaaatgttaggagaaaatatggatcagtcacatatcagaaatttctgtattattgcacatatagaccacggcaaatcgactcttgcggacaggatgatcgagatgactcacaccctcaccaagcgtgagatgcaggatcaggtcctcgacaatatggacctcgagagggagaggggcatcacgataaagtcccaggctgtaaggcttatctaccatgcgaaggatggcggggagtatattttaaatcttatcgatactccgggacacgtggattttaactacgaggtgtcgagatcactcgctgcctgcgacggagccattctcgtagtggacgcgacccagggcatagaggcgcagactctcgcgaattgctatctggccatagaccacgatctcgaggtgctcccggtcatcaataagatagacctgccttcggcccagccagacgaggtcgcgaaggagattgaggatgtcataggcttggactgcgaggacgcgccgcgtatttctgcaaagacaggagaaaacgtaggagaggtcttagagcaggtcattacgaagcttccggcgccagaaggcgatgcgaaggctccgcttcaggccttgatctttgactcactctatgatgcctacagaggtgtcatagtctttgtccgtatcaaaaatggcacagtccgtcccaaggacaggataaaaatgatggcgacaggcgcagaattcgactgcgtagaggtcggatactttggagcgggacagtttattccttgtgatgagctttccgccggtatggtcggatatatcacagcatctattaaggatgtaagagagacaagagtaggagacactgtgactctagcagacagacctgcggaggaagagctcccgggataccgccctgtcaagcctatggtcttctgcggcatctatccggctgattccgctaaatacccggaacttaaggacgcgcttgagaagcttcagttaaacgacgcttcccttacatttgaaccggagacatcacaggcgctgggattcggcttcaggtgcggattccttggacttctgcaccttgatgtcattcaggagaggctcgagagagaatacgaccttgacctcgtgactacggctccgggcgttgtctacaaggtgcataagactgacggtacagttatagatcttacaaatccgtcgaaccttccggacccttcggagatagaatatatggaagagcctgtagtcgatgccgagatcatggtgacaagcgactttatagggcctatcatggatctctgccaggagaggcgcggagagtatatttctcttgagtatatcgagaagacccgtgcggtgcttaaatacgtgctgcctcttaacgagattatctatgatttcttcgatgtcctgaaatcgagatccagaggctacgcctcatttgactatgagctgaaaggctaccagagatcggagctcgtaaagctcgatatccttgtaaataaagagaaagtggatgcgctgtcatttatcgtatttaaggatactgcctatgacagagctaagaagatgtgtgaaaagctgaaggaaaatatcccgaggcatctgttcgagatacctatccaggcggctgtcggcggcaagattatagccagagagacagtaaaggccatgagaaaggatgtcctggcaaagtgctatggcggcgatatttcaagaaagagaaagcttctcgagaagcagaaggaaggcaagaagaagatgaggcagatcggcaatgtcgagatacctcaggaagcatttatgagtgttctgaaactcgacgatgatcagtgacgatggaagattacaggagatttgaactttatattcatatacctttttgcgcaaaaaaatgcctctactgcgacttcctgtccggagtttttgacacagacactcagagagattatgtaaatgcactctgcaatgaactgaaattttattccgagaaggtttttggcacggtctcctctatttatataggaggggggacgccatcctggataaaccctgatctcattgttttgatcatgcagacagtaaaggaaaatttcaaggtagacccgctcgccgagatttctatcgaggcaaatcccggaacagttgtagcagaggccgcaaacacctatctctcagtcggaattaacaggatatccttaggccttcagtcggcaaatgacgacgagcttgaagagcttggaaggattcacacttttaagagattcctgtcgacctatgaaatccttagaaaagccggctttaaaaatataaatgtagacttgatgagtgcccttccgggacagactccggagaagcttctctacaccttaaataaagtcacatcgtttcggcctgagcatatttcatgttactcacttatcattgagccgggcacccctttctacgaaaaataccacgaggatgccgtaaggcaggagaggggcgaggagacaaagtttctcccgaatgaagaccaggcctatgagctgatgaagagatcacagatgtaccttgagaagaaaggatatcacagatacgagatctcaaattacgccagagagggaaaggagtgtgtccacaatctgggttactggaacagggttccataccttggcgtgggcattggcgccgcgtccctcatccctccgggatatctggtcagggagccggaggatccggaagagaccggtggaatgggcctcgaatggcgtactacgaatatcagggatatttacacatatatcgaagagtgcagccacctcccgatagttcccgaacgggtcggctacgaggatatggcaacgataggatctattaagcagatcacgaggaaagccgcgatggaagagtttatgttcctcgggatgaggcagatcgcaggcataaagaagtcatattttaaaaagtcattcggcgttgctatagagaagatctacgggcacgagatgacagaacttgagagagaggggcttctgactgaaaagggagatacagtcgctcttaccgatacgggacttgatatatcaaattacgccctggccaaatttataaaatgatttttgtacaaaagaagagacaatgattcgctggcatatttgccggcgatttttttcgagtaaaatacaaaaagttgttgacaaacatgtcgaacaagcgtatattatgtgttagatgatattagcactctaatgatttgagtgctaacaagaaaaagcgacaggaggtgaggcatagtgagtgaagaggatgagcttacagtcaggcagaagaagatcctggatgttatcatcaagaactacctggagaccggtgaaccggtcggatcgaggacgatctcgaagagctctgatttgaacttaagctctgccacgatcagaaatgagatgagcgatctggaggatatgggatatatacttcagcctcacacctccgccggaaggatcccttcagataagggatacaggttctatgtcggtgagctgatgaacagccagaaggacacttcgcctccggattcgacgagccagatgctcgtgcagaggacggacagactggagaagatgttaaagcaggttgtagatgtgctcgctgcgaacacgaattacacctcgatgatctcggcacctgctatcaccggagtccgggtcaagttcgtacagctctcagcggtgaatgagcaccagcttctctcagtcgtcgtgatggacggcaatgcagtccggaacaggcttatcaatatcgacgagcctcttaacaatgaggacctcctgaagctgaacatgctccttaatacgaacctctccggacttacagttaatgatattaacctcgcattgataaagaagcttaagtcccaggccggtgagtatgcacctattattgagaatgtcctcgagaatgttgcaggaactatcgagcaggacgagggcaggacgatatacaccagtggtacgacgaatattttcaagtatccggagctttccgatgcgaacagggcgagccatttgatctcgactttcgagaacaaggaggagctcgagaatctggtaaatgagatagagaccgacgatgagggcaatccgaatggtatttcggtattcatcggagacgatatcccgaatatgccggatgtatcggtcgttaccgcgaagtacgacctaggagaaggctttaagggcacgatcggaatcttaggcccgaagcgaatggactatgagaacgttatgaagaatctcaagtccttaaagaagcagctttcagacatcgtcgattcttcgaggatcggtgcaaagaaggagcctaagaggatagaggcgaagaaggatattaaggaaaaaaaggaatagaggtattcgaatttgagcaaagagaaagaaaagaaggacgaagagcttaagactgataaggctgaggacaagaaagccgatcaggccaaagaagagaaagcagataaatcaaaggacacagaagaaaagaagtcttcggataaggctgatacaaaggaagccgccaaagacaagacttccgaggataaagagaagtccaaagacaagaaatcagataaagacgacaagaaaaaagaagatccccgcgatgcgaagatcaagtcgcttcaggatcagctcctccgccagatggcagagttcgacaatttcagaaaacgtactgagaaggagaagtcgaacatgtacagcgctggtgccggcgatgtgataaaaaagttcattgaagtccttgacaatttcgagagaggacttaaggatgtaccggaagatacggacgacgccttccagaagggaatgcttgcgatctacaagcagttcaagagcacgatagatggccttggagtaaaggagatcgacgctttaggcaagaccttcgatccgaattaccacaatgcagtgatgcacgaggacaacccggacaagggtgagcaggagatagtacaggtccttcagaagggctatacgtacaacgacaaggtacttcggtacgctatggtaaaagttgctaattgatttaatcagatatatagagtgtgatttattcacagttaaggaggaattaatatgggtaagataattggtatcgatcttggaaccaccaacagctgcgttgctgttatggaaggtggacagccgacagtcattgagaatagcgaaggtatgagaaccacaccttctatcgtagcatttacaaaggacggtcagaggcttgtcggtgagccggctaagcgtcaggcagttactaatgccgagaacactatttcttctatcaagagaaagatgggcactaacgatggccctgttattgacggcaagaaatattcaccacagcagatctcagctatgattcttcagaagcttaagagcgatgctgaggctcatctcggtgagaaggttacagaggctgtaatcacagttcctgcatatttcaacgatgcacagcgtcaggctacaaaggacgccggaaagatcgccggactcgatgtaaagcgtatcatcaacgagcctacagccgcagctttagcttatggtcttgacaacgagcaggagcagaagatcatggtttacgatcttggcggtggtacattcgatgtatcagtcatcgagatcggtgacggcgttatcgaagttctttctacgaacggtgatacacatctcggcggagatgatttcgataaccgtgtaatgcagtggatgatcgatgagttcaagaacaaggagggcgtcgatctctctggtgataagatggctatgcagcgtatcaaagaggctgcagagaaggctaagaaagagctttcaaacgctacttctacgaacatcaaccttccgttcatcacagctacagcagatggtcctaagcatatggacttaactcttacgagagccaagtttgatgagatcacatcagacctcgttgacaagactgccatccctgtacagaacgcattaagagatgcaggacttacagcagcagacctttcaaaggttctccttgtcggtggttctacacgtatcccggctgttcaggagaaggttaagcagctgaccggcaaagagccatcaaagaaccttaacccggatgagtgcgtagcacttggtgcctgcattcagggtggtaagctcgcaggagataagggagcaggagaagtccttcttctcgatgtaacacctcttacactttctatcgagactatgggaggcgttgctacacaccttatcgagagaaatacaactatccctacgaagaagagccaggtattctctacagcagaggataaccagacagccgtagatatcaacgtagtacagggtgagagacagttcgcccgtgataacaagtcactcggacagttccgtctcgacggaatcgctccagcaccaagaggagtaccgcagatcgaggttactttcgatatcgatgccaacggtatcgttactgtaagcgctaaggaccttggcactggcaaagagcagcacatcactatcaccggaggaagcaacatgtccgatgaggagatcgacaaggctgtcaaggaagcagctgagtacgaggctcaggataagaagcgtaaggaggctgtcgacacgaagaatgacgcagatgctttcgcagttcagaccaagaaagccctcgacgaagttggtgacaagctcgatccgaacgacagaagcacagttgaggctgatctgaagagggttcaggaccttgtaagcaaattccctaaccctgagacaatgactgacgccgatgtttcagagatgaagaatgccaaggagcagcttgagaagtcagctcagaaggtatttacaaagatgtatgagaatgcccaggcacagggcgcagcacagggcggcccacaggccggtccgcaggcaggcccgaaccctggagcaggtgcaaacaacgctggcagcaatgcaggcgcaaacaacgatgacaatgtcgttgatggagattacaaagaggtctgatacctgaggcgcaggctcagattcgtgaaaggataatcaaatggcagaacagaagagagactattatgaggttctcggggttgataagaatgccgatgaggagaccataaaaagggcctaccgtaagctagccaagaaatatcaccctgatatgaaccccggtgataagaatgcagaggagaaattcaaagaggcctcagaagcttatgccgttctgtctgatcctaagaaacgtcagcagtatgaccagtttggccatgctgcctttgacggaggagccggtggcggcggctttgacttcaacaatatggatttcggtgatattttcggtgatttcggagatatcttcggagactttttcggtacaggatcaagaggcggcagagcatcgaatggtccaatgcagggtgcgaatgtcagagcttccgtgcgtgtctcatttactgaggctgcatttggctgcaacaaggagctcgaacttgtactcaaagatccgtgtcctacctgtggtggcagcggctgcaagccgggcaccagcaaggtaaagtgtactaagtgcggaggcacgggacgtgtcgttacgacgcagagatcgctttttggaatggtacagcagcagagcgtatgccctgaatgtcatggaaccggccaggtaatccctgatccgtgtcctgactgccatggtagtggatacaaagctcagaaaaagaagatagtcatcgctgtaccagctggtatagacgatggacagagcataaggatccgtggcaagggtgaccctggtatcaacggcggtccgagaggagaccttcttgtacaggtaagcgttgcgaaaagcaacgaatttacaaggaatggctacgatatatactctgaagttcctatatcgtatgcgcaggcagcacttggctcgagcatcatcatagacactatcgacggaaaggtcgagtacaatgtcaaggctggaactcagccggggaccagagtcagactccgtggcaaaggcgttcctacccttagaaataaaaatgtccgcggcgaccactatgtgacactcaatgttgtagttccacgtactttaaattctgcacagaaggcagcgcttcgctcatacgacgaagcctgcggcggaactttgtcaaatacaaagaaggcacacagcccgttcggacgtaagaaataactgaatttcaggcagaggaaactttttcctctgccatttttttttaagattttttatttcaataattttgaactttttaacgtggaacgcccgattttttttgattattacagataaatattgtataataatttttcggaacaggtagtttattattttttatgtgacaatatgtcatgccacaagacaggctaagaatcctgcgagagagttaggcttcgaggtaaaaatggacaggagacagcagaagaccagaaaagctgtttttgacgcttttgaaaaacttattgcggaaaagaagtacgcggatatcacggtaaaggatatcattgaagctgccgacatagggcggactactttttatgcccattttgacacgaaggacagtgtactcgaagaactctgtgcggaactgtttgaccatatttttgacgagcatttgacagaagaggatacgcacgatttttcaaactcagagcacagcgaaaagcacatgctgacgcacatcctgtatcatcttaaagaggataaggacaggttcagcaggctctttcagggtgagagcggtgatattttctggaacaggttcgctcttctgttcagagggcatttgagaaaacagctggacagcggagcctggaaggtaaggggaaagcttccggaagatctgtatgtaaatgtctatataagcagttacatagagacagcgaagtggtggtttacacattcctgcagtgagagacctgagaaagtcgagtcgtattttgaagagatgatgtgtacagcctctgacgatacgaacgaggaacttcgtctggcaaggcagcagattgcgctgggaaatgaatcggttctcgcgatggcgaaggctcttttccttaaggacagaaataccggcgagcactgccacagggtggcctactactctgcgaagcttgcgagggcgtacggcttttcgcaaaaagagactgacaatataaaaaaggccgctcttctccacgatattggaaagatcgcgatcccggattcgattttaaaaaagcccgacagactgacacctgaagagtatgagcttatgaaaacacacactacgtccggagctgaacttcttcagggttttacgatggtagaacatgtttcggagggggcactataccaccacgagagatacgacggaaaaggatatccgaagggactttcaggaaaggctatcccgctgtacggcaggatcatagctgtagctgatactttcgatgcgatgactgctgacagggtctaccgcaacgctttagacatggagcaggtcgtgagtgagataaaaaatggccgcgggacgcagtttgacccggaactcgatgatatttttttaagtcttataggaagcggctatatcaatccgaagaagacatttgagatgttcaggcacagagacctgacagaggatattaattgatgagaagccttgaacttactgacgtactaaaagaaaagcgactggactttgctgcttttatcgacgaggaccagaaaaaggagctctacgatttctggcagcagctccgcgatgagaaaaaggacaatatcagcggtgcagacatcgatgcggtgctcgaaagttacataaagcttgggctcctcgtaaaaaccaaatccccatcttcatctgatagtattgatgatgatctggtaaggattcctcctgtggataataccgatactctgatgattgtgtctcttcccgaacagagggataagactgagatcacaggcggtttttcaaagactggaaagtcatacgcttttgaatataagaccggcgggaagcttttttcactaaaagttaaagccttagatgtcagatatgaaaagcttgttgactatctttcaaagaaccacttcgctgtaagaatttccggagatttcctgacagctggctttcgcatcagaaaaataagagcgggccagtcaatggagagtgactccttaaagccggtatcgggcgatctgataaaatccatggtcgagcgcttgaggacttcgcagatcgtcataagagacaatgaaaataaaaaggcctctgccatcacaagaatcccggaacttcgggactatgtctggtgcatggaggatactcttccggataatatcagggactgggcctattctacgcttcggctcttagatgacgatacgatcggggcagacgagaagagacacgcccagcacgctctgtcactaatgatgagcgtacagtggaagacctcgttttttgagccgatagatccgcacgaggcgagacagattttagacgacgagctgtatggcctcgaagaagtaaagcagagagtgatcgaaactataattcagataaacaggacgcatacgctcccgttctacggactgctcctagtgggccctgccgggactggaaagtcgcagatagcttacgcggtcgcaaagattttaaaaatgccgtgggcagtcctcgatatgagtacagtgcgtgatccgagtgccctgaccggaagctcgagaatctatgtgaacgcgagaacgggacgcataatggatgctttcgtaaaggctggatcgtcaaacgtcgtattcgttataaacgagctcgacaaggctgactcgaatacttcaaacggaaattcagccgattcgcttcttacgcttttcgacaatttaggctttacggacaactacatggagtgtgctatccctacgaacggagtctatccaatagcgacagccaacgatatttcaaaaatcagcggaccgcttcggtcgagatttgccgtgatagagataccggactatacgccgaaggagaaaaagataattttccgggactattcgcttccgaagatcttaaagcacctggggatgaagccggaggagtgctcgcttacagaatcagctgtaaacagaattatagagcatttccacgatactccggggtgccgtgacctcgagcaggctgcggagcatctggcatcgcatgcgctttatgagatagaagccaccgggaagaagtccatcaggttcaatgagggacaggtgaacaggatactcggatttgattgatttttttaaacaggatcggagaatgtatgggtatatttgacagattgggccaggccgccaacgacatggtcggaaggatcaaccattctatagagaccggagatttttcgtatctgagctatgatctgggacaggagctttcggatatggagcgtgaccttgcagatcaggcattagacgctggcagaagggcagcagatgccggcaggagaacagctgacgccgctaaaaggacagctgatgcagcgaaaaattcattcaggtcgaaatttcatgtacaggacaaagagacagagacggcctttacaaaaaaagacacgatagcttctgaaaactcaggcagagaggccttctatctgcttattatggtgatgtgcatcatgtttgcgctgggatttgctggtgccgcatttggaaagaatcttttatatcttataggaacggcagtctcggcagcggttttctttgcatttgtaaaaccgctgaaaaaggccgtaaatattacaaggcttcacaaggtatttttaaagtacaaagatatcgtaggcagggacgaatatattacgatagatgagcttatgataaggaccagggagtcgcgggagcaggtactttccgatatcagggatctgatgtctaacggattccttccgggagcagtgctcgatgaagatgagacagtccttatcctatctgaaaacgcctaccgctactatgtaaactatgagagggagcacgcttcagagaaggcggcaaagaaggccgaagaagctgaagaggccgcagccagcgagaacctttcagaggaagcgaagaaggttatcgaacagggtgagcagtatatagaggactttcaccatttaaacgagataatcccggaccagagtatgtcggaaaagctcgataagcttgaaaacattacgaagcggatattttcagcagtaaaaaagaaacctgagacagcgccgcatctcaggaaacttttggactattaccttcctactaccaaaaaactggtgcagacttatgcctctgcgcagaatcagcctgacaccgaaaatataagccagatgaagagcgagatcgaaagctctcttgaccttataaatgcagcttgtgagaagatactggatcagatgtttatggacgacgcatgggacgtttcgtcggatgtggatgtaatgaagcagatgatgaagcaggacggccttgtggacgacgacaaatgaaagggaggacaaaaatggcagacacaaagacagacacagggataaagcttgaatttgacacaccggacgaaaatattccggctgctccggaggttagcgcagcagaagaagagaaaaaactcgaagaggatgtcaagaaggaggcagagcttactcccgaagagcgggcacaggtcgactcctttgtagaaaagatcgacctcaacaattctgctgcgatcatgaactacggagtcagcacccagaagcacctcgccgatttttcgcagaagacgatcgataagattcagaccagggagatgggcgagaccggcgacatgcttacgaatctcgtaaccgaacttaaaaatttcgatgtcgaccagaatgagcacgggctgagggcactttttaaaaagagtgcaaacaaggttgagaccctgaaggctaagtattcttcaatcgaagcaaatgtaaatacgatcacaagagagctcgagaagcatcaggtcacgctgatgaaggacatcgatgtctttgacaagatgtaccagctgaacctgaactatttcaaggaactttctatgtacatcctggccggaaaaaagaagctcgattcagttaaaaacacggagcttaaggagcttcaggagaaggcagaagccagcggtcttccagaggatgcagagaaggcaaaagaccttgcggacaagtgcaaccggttcgaaaagaagatatatgacttagaactcagtagaaatatcgcccttcagacaggccctcagataaggctcgttcaggctgccgataccgagatggctgaaaagatccagtcgactatcgtaaatacaatccctctctggaaaaaccagatggtaattgcccttggagtcgagcattccaaccaggcggcaaaatcagagagagaagtcaatgatatgacaaaccagctcctcaagaaaaattctgaaaagctccatcaggcagtcacagagtccgcgaaggagtcggaacgcggaatcgttgatatcgagaccttaaaacagacgaatgagtcccttatctcgacgatagatgaggtcatttcaattcataaaaacggcactgagagaagacatgaggcagagaaggaacttgctgatctcgagggccagctgaaacaaaaactaatggaggcatccagaggctgatcatggtagataaaaagagaatcgtagtaaaagtcgggacttctacacttacaaatgaacttggaaacccgaatctcagagaatttgacaaactttcactggttttaagtgatgtgcacaacatgggatatgacattattctggtctcgtcgggagccatcgccgtaggcgcaagtgacctccacctgaaggaaaagccgacagagcttcgctacaagcaggcctgcgcagcagtgggacagtgctctaatatgttctactatgacaaatttttcggggagtacgggcagcaggtggcccagatccttttcaactcggaagatgtggagaacgagctcaagaaggagaacctgaccaatactataaacactctccttgagatgggcatcatcccgatcgtaaatgagaacgattcggtcagctacactgagatagattcagaggaccacctcttcagtgacaacgacaagctttcagcagtgatcgccattctctgcaatgctggaaaactcgtgattttctcagatatcgacggattttttgacaaggatccgaggctgtatgcggatgcgaagcttatagacaggatagacgacattacagaggatacattcaacctcgcggggggcgccggaagcaggagaggaacaggcggaatgcagacgaagctcgaggcagcacagcttgcgacggctcagggaatcagtgtgatagttacgaatggagcccacccggataccctctacaagattgtcgagggcagaaaagccgggacacttttcaagggaaaaaaagtattttaaattttgtttaaacatttttttacaatgcacatcttcgtatgtgcattttttatttatatagtatgtgaaattgtacaaaaattttgttatattctaatacttttagtgcaaaagtgatataataatctagtgtgaaaggtattctttatagaatatttaacttttggaaagaagaaagtggggtaattgaatgagccttagaacatttaaaggcggagtccatccctttgaaggcaaagagctttcaaagtcaaaacctatcaaggaactccttccaaagggcgagctcgtatttccggtatcacagcatatcggagcaccggccaggcctttggtagcgaagggcgatacggttttgcgcggccagaagatcgccgaggctggtggcttcgtatcatcacctatctactcttcagtttccggaacggtcacaggtattgagaagagacgtaccgctaccggggacatggtggattccatcatcatcgaaagtgatggaaatttcatggaagcaggttttacggaatgtgacgatgtcactaagctctcgaaggacgagatcataaagaagatccaggacgccggagttgtcggcatgggcggcgcaggattcccgactcatgtgaagctgtcgccgaaggagcctgacaagatcgactacatcattgcgaactgctccgagtgcgagccgtatctcacgagcgactaccgtgagatggtagaggaaccggagaagcttatcggcggcatgaagatcgtcctccagcttttcccgaacgcgaagggcgttttcgctattgagaacaacaagcaggactgcattgacaagatttccgagatgataaaggatgaggacagactctatgtacagcctcttcttacaaagtatccggagggcggcgagagacagcttatccacgccgttacaggcagggatatctattcgaagatgctcccggcagatgcgggctgcattgtagataacgtcgcaacgcttatggccatctatgacgctgtaaagcttgggatcccggttatgaacagggtatttacagtcacaggagacgctgtctgtgagccgagaaacttccgtatctgtatcggtacgagctatcaggagcttctcgatgcagcaggcggacttattcacgaccctaagaagatgataagtggtggtccaatgatgggattcgccctatacgggctcgatgttcctacgactaagaccacatcggctcttctctgtatgactgaagatgcagcgagcgagtatgagactacagcctgcatcaactgcggacgctgtgttgaggcctgccctgagaggctggtaccttcgagacttgcagattttgctatgcacgatgagacagaggaatttgagaagtggtacggcctcgagtgcattgagtgcggcagctgcagctatgtctgccctgcaaggcgccctctggctcagtatgtgaagactatgaagaaacaggttttagctgcaaagaagaaagctgcagcggcagcaaaggctaagaagtgaggtgagtaaattggaagaaaagaaagtgcttaatgtaactgcctcacctcatgtgagggcaaacgtagacacccagaagatcatggcttgcgtgatcatagcccttctgccggccacggtctttggtatcttcaatttcgggatcagagcgcttataattatcgtagcgtcggtcgcagcggctgttctctcagagtatatctactgcaagatcgtacacagaaagaatacgacgagagatctctctgctgtagtcaccggactgctcttagcgcttaacctcccgagttcagttccaatctggcttcctatacttggaagcgcttttgcaatcatcatcgtaaaagagctgttcggaggacttggacagaactttatgaatccggcactcggtgccagatgtttcctgcttatttcgtttgcaggtctgatgacagattactcgaactatccaggatttaatgataagaatgcattcagcggcgctacaccgcttgcttcacttaaggctggcaggactgtcgatacgatgcgtatgatccttggaaatattcctggaaccatcggcgagacttcaatgatcgcaatcgttatcggagctattttccttatcctgatgggagtcatcagtttgaggataccgggtacctacatcctgacattcgccatttttacgatcatcttcggtggacacggtttcgatatgaacttcctcgtaggcgagcttgcaggcggcggacttatgctcggtgcatttttcatggctacagattatgtcacaagcccgatcactccgaccggacagatcatctacggcatacttctcggtgttatgactggtatattcagattctttggatcatcggcagaaggtgtttcatatgcgatcatcttctcgaacctctttgtacctcttatcgagaaggctacgattcctagagcttttggtatcagaaagccaaagaaagctaaaaaggaggcagcatgagtgataagaaatctattatcagagacactctgaggctaactattatcactgtagtctcaggccttttgctgggactggtctatgagatcacattgaagccaagggaagcagctgcggcaaaggctacaaacgatgcctacaaggctgtatttgaagaggctgcttcatttacaccttacaaggactttgatgctgacaaggccaaagctctgatcgagaaagcaggatataaggatatttcaatatcagcctgcgttacggcagaggacaagagcaacaaggcacttggatatgtccttacagtagttacgaagagctacggcggaaatgtcaccttctctatgggtgtaacgaacaagggcaagatgaacggatacaagatcaccgatacatctgatactccgggtcttggccttaaggcccgcgacgatccatcttttggaaatcagtttaagggcatttcagccggcaagtactctgttataaaaggcaaggcttcgaagaaccagatacaggctatcagtggtgcgacaatcacatcccgcgccattacaaatggtgtcaacgccggatttgagtactacaagagtatagcaggaggtgagaaataatggatagtccaaaggaaagactttataatggtatcgtaaaggaaaatcctatattcgtcctcgtgcttggtatctgcccgactctcgcagtcacgacatccgcgatgaacggacttggaatgggactttccacaacactcgttcttgcgctttcaaacgcacttatttcagcccttcgtaaaatgattccggaccgtgttcgtatgccggctttcatcgtagttgtggcttcattcgttactatagtacagttcctgattcagggttatctgccaagtctgtatgattcacttggtatctatatccctcttatagttgttaactgtatcatccttggacgtgcagagagctacgcatcaaagaaccctgttatcccgtctctgtttgatggtcttggcatgggacttggatttacactttcacttattttcattggatctgtccgtgagcttttaggatcgggaagcatttttggagcacagattctgccattggctgacaaggctgccggaaaggccggatacacgccaatctcaatcttcgttcttgctccgggtgcattctttatcctcgctcttctcgttgtcatcatgaacatcgtaagagagaagcaggcagcaaagggcaaaccgctggctcctgtagcaaactcctgcttgtgcaacgacgaggacgctttggaggatgctgtgaagtccgataacccgaacgtcaaggaagccatagacaacctcaaggaaaaacaaaaggaggcggaaggtaaatgaaagaattagcgataattttcattggttcgtttatcgtaaacaacgtacttttaagtcagttccttggattgtgttcattccttggagtttctaaaaaaacctctacagctgtaggaatgggtggcgctgttacctttgttatcacgatcgcctctattgtagcaggacttctctacagatacattcttgtccctactggatttgagtatctcgataccatcgtttttatcctggttatcgcagctcttgttcagatagttgagatgttccttaagaaaaatgcccacgccctctattcggctctcggcgtttatcttccgctgataacaacaaactgcgccgtactcggagttgcattaaagaacgttacaaacaactacaacattctccagggcgttatctatggccttggaactggtcttggatatttcctggcgattgtaatcctcgcaggtatccgcgagaagtacaagtacaatgactacccgaagtatttcaaaggaacagctatgacactgatcactgcaggtcttatgtcgatagcgttcttcggattctcgggaatgatttgaggaggggataagtatggcttatggagtagtgatggcgactgttatagtcggccttgttggtttaatcattggaattcttctctgcctcgcatctgagaaatttaagatcgaagtagatccgagggaggagcagatcttaaatgtcctccctggaaataactgcggcggctgcggctaccctggctgtcctggctgtgcacacgctatcgccagtggcgaggctccggtaaaccagtgtcctgtaggtggtgccccggtagcagccaaggtcggcgctataatgggtgttgatgcaggagacagcaagaggatggtcgcacacgtcagatgtatcggagactgcgatcaggcctctaccaagtacaattacagcggtgtagagacatgtgccgctatgtcgtttgtacctggcggcggtccgaaggactgcaaatacggctgcatgggatttggagactgcgttgcttcctgccagttcgatgctatccatatcgtaaacggcattgcatttgtagacaaggaagcctgcaaggcctgcggcaagtgcgtaaaggcctgccctcgcggcattatcgagcttattccttatgatgcttcagaagttgtagactgcaggaataaggacaagggcagagatgttatgtctgtctgcaagaccggatgtatcgcctgccacctttgcgagaagacctgtaagcacgatgctgtacatgtagtcgacaatatcgcctacatcgatcaggacaagtgtgttggctgcggcgagtgtgctgcaaagtgcccgaagaaggttattacagttcttaaaaaagacgcagcacagaagactgcctgagcttatgtgttagaattatttgtggtttttattgactgttttatagcgaaataaagttggaaaaagaaaggatacagattttaacacatgagtgaacagcaaccaaatagagagaagttcgcgtcaagactcggatttatccttgtatcggcaggatgtgcgataggtattggaaacgtctggaaatttccatatctgtgtgggcagtacggtggtgcagcttttatactgatatacctggtattccttgttatcatgggaatcccggttatgatctttgagtttgcagtgggccgggcctcacagcacagtgcggccctggctttcgatacgcttgaacctgaaggcacccattggcacatcatgaagatattctgcatggtcggcaactatcttctgatgatgtactatacgacagtctgtggctggatgtttgactattttgtaaggcagtgttcaggcgaattcgtcggagcgacgccgaaacaggtgcagaccggctttaatgagatgcttggcaatacaggtgagctggctctatgcaccattgtagtatgtcttataggatttcttatctgtttcttcggagtccagaatggagtcgaaaggattacgaagtggatgatggccgcgcttttcatcctgatgataatacttactatccactcagttttcctcgagggagcaggagccggaatcaggttctaccttgtgcctgactttaagaagatggcagagatcgggataggaaatgtagtctaccaggcgatgggacagtcgttctttacgctgtcgatcggcatgggctcgatgctcatcttcggaagctatctggacaaagagagaagtcttactggagaggccacgacagttacgtcactcgatacagcagttgctcttatggctggatttatcataatcccggcctgtttcgcgtttggtatacagccggatgcaggaccaagccttatatttataacgatcccgaacctttttgcaaagatgccgggagggcagttctggggagcacttttcttcgtattcctctcatttgcagccttatcgactgtaattgccgtatttgagaacatcattgcattcgatatggacctgttcaagtggagcagaaaaaagagcgtgcttatctgtgcgccaatccttatagctctgtcgctgccctgcgtactgggatttaatgtatggtcaggatttcagccgctgggaaagggttctacaatcttagacctggaggacttcatagtatcaaacaacgtccttccactcggaagcttcgtctttgttctcttctgcaccagaaaaaatggctggggctgggacaacttccttaaagaagcagatacaggaaaaggagtgaagtttcctagaagcatcagatggtatgtgacgtgggtacttcctgtcataatacttgtcattttctttaaaggttattacgacaagtttgcaccgatggggaggggcccgttagtcggctggatgatcttcgctgtcgcacttgtcggcttccttttgtactgcgcatcaagtaaaccgcgtaaatccaaataaaaaaagacttaaccagatcacatggatctggttaagtcaagatacatatcttagtctttccaaagaccgacctgatcgatcaggtaattttcaaagacactcattcccgctcctgttttagccgacagcgggaatatttgtatattcgggttgattctcgtggctctctcggcgcacttgtcgagattgaaatcaaagtagtcgagtgtgtccatttttgtgatgacgagggcatctgactggtcgaacatcagagggtatttaagcggcttgtcgtctccttctggaacagagaggatcatgatctttaagccggctccggtatcgaattcggccgggcagatcaggtttcctacgttttcaaggaagatcagatccttcccctcgtatcccatcgaatcgagagcgcgcttcgtcataccggcgtccatgtgacacatgccgtctgtgtgagcctggatagaagtggcacctaagttctcaatctttacggcatctacatcggaagcgatgtcagcttccataactgcaatatttaacctgttcttaaggtctgtgatcactcgtgagagaagagtggtcttgcctgagccaggggaggacataaggtttacgagaagagttcccttctccttcatttcttttcttatctggtcagcatctctgtcatttgattctgtgaccgatgcgtttaattctataactttcacttgtctgcctcctttgcaagggctgcctgtcttttaagccagctgatccactcgtcgaaaccgtcacctgtcttcgcggatatcgggatgacttttagtgccgggttagcgaaattcaagctgtcgcagagcttgttgatactgaaatcgaagacggctctggtatcgaacttgttcacaagtaaaatatcagcgaccttaaacatcagagggtatttaagcggcttgtcgtctccctctggaacagagaggattacgacttctttattctgtccgacgtcgaattcggccgggcagacgaggtttccgacgttttcaaggaagacaatgtcgaggtcgtctaatccgagtccctcaagcccacgcttagtcatatcggcgtccatatggcaggagcctccggtgtgaagctgtatgaccttggctccggcgtctgcaactgtcttcgcatcgacatcgctgtcgacatcggcttccataactccgatacggtattcgtctttcagtgcttttatagtgcggacaagggtagtggtcttgcctgcgcccggagaagacataagatttacaaaaaatatgcccttagacttcatagagcttctgacttcagcggcaactttgtcgttgtcttctatgactctctcctttgtttcaagaatttcaaaatctctgttactcatttcgttcttcctgctgtaattgatttaggttgaatagataccctactattatacattattttaaaaaagatacaaattttatgaatttctgcttgacatataaaacatatttgatacaatcaaattgtacaaaatcaataataaaaattgccggtaaaattttttcaaggaggttttggttatgggattttacgattattcagtaaagaacgctaagggtgaagatgttcctatgtctgacttcaagggcagggttgtcctcgttgtaaacacggctacaggctgcggctttactccacagtacaaggacttggagagcatgtacgagaagtaccacgatcagggatttgagatcttagatatcccctgcaatcagtttgcaggacagactcccggaacagacgaggagatccacgagttctgtaccttaaagtacaacaccaagttccctcagatgaagaaatcagatgtcaatggttctaacgagcttcctctctacacatatttgaagtcccagcagggattcaggggcttcggcaagggcgcgaaggcactcgctatgtcagctcttctgcacaaggtagacaaggactataagaataacccgaagatcaagtggaacttcactaagttccttgtagaccgcgagggaaacgtcgttgagcgtttcgagcctacagaggatatgaaggtagttgagtcagctgttaaagctaagctttgatatatatttttagtctgttttatggcccatgcattcgctgcatgggctttttttaataaaattttgctaagacagctgatctaatgtataatcaacttatgaaaaaaatacgcattcttttaacagcgataataatttatactctgtcggtccctctgatgtcatgtactggtgggccgatagcgatgactccacacagcaggtcaggcatctatttcgatactgtgatatcgatcacattatatggggatggggcggtcgcggataagcggctggatgagatgtttaagatggcggaccgttacgagaacctgctctcggacaagaaaagcggcagcgacatctcaaagataaacactgccagtgggaaatgggttaagatccattctgatacggttgaggcgataaagcaggcatacagctactcgaagagctccggcggagtcttcgacctgaccgtggggacactctcgagcctctgggattttaagaataacaccgggacaattcctgataaagcagctatagaagaggccagaaagcatatagattatagaaatgttgaaatcgacgggaataaggtaaggcttaaggacccgaaggcccgtatcgatctgggcggcattgcgaagggctttatcgccgataagatgaaggcccgtctagagaagcttggcgcaaaaagcggcattataaatcttggcggaaatgtgctccttatcgggaaacgtccgaacaacgagtcctacacggttggtgtccagaaaccgttttcagaaaacggagaggcactttttactgtaaaggcaaaagatatttcggtagtcacaagtggaacctatcagaggtattttaagaaaaatggcaggatataccaccatatcttagatataaagaacggctatccgtatgacaacggactcgattcggtcactatctttacgaaacagtctacaaaggcagacgccctctctacaacagtatttgccatgggacttaaaaaaggacttgaattcgtaaataagacagagggcgtcgaagccgtctttgtaagtactgacggaaaaattacgaagtcagataatgttgacaggctctatgattacgagaaggcacaataacaaaaatatatacaaaattccacgatattgtggtattattattcttaataaacaaacaggaggtttgaagtgttcggctatgtccgcgtccgaaaaccagagcttaagataaaagaatacgatctttacaggcgctattactgcgggctctgcaggagccttaagaaaaattacggtgtaagttctgaactgctcttatcatacgacctgactttcttaaagctgcttcttacctctgtatatgacttaaagactacagactatcgttcgaggtgcatagcacacccgcttagaaagcagaggaggactgaatcagaggccgatgagtatgcagcttctatgagcattctgcttgggtatcttcactttgaggatgacaaggcagattcaggaaaagctggtgcttcggcgatgagctttgtgtacaggaagagagcgaaagctgcgatggaagcctatccgagacaggcggggaccctttcagctgagcttaaagcgcttcacgaactggaacaggaaaagagctgtgatattgaatccttaagtgagcacttcggaaatgccttaggcgagatatttgtctggaaggacgatatttttgcgcaggatttaagacagatgggatttttcctggggaagtttatctatgtgatggacgcggtcgacgattgggagaaggacagaaaacacggcgaattcaacccattttccaatgagtcgtcaaagaaggcggttttagagaaggcaaagcctgttctctatgaaaatatttcagcttcagcagaagcttttgagatgcttccggcggtagacaatgtcggaatcttaagaaatattatatatgcaggtgtttggaacagatttgacaaattgacggaggaattaaatgaatccatatgatgtactcggggtttccccgaatgcgactgacgaagagataaagcacgcatacagagaattaagcagaaagtaccatcccgatgcgaatgcgaataacccgcttaaggacctggctgaagagaagttcaagcaggttcaggaagcttatgaagagatcatgaaggagcgcaggagcggacagcgcggctactatgggagtggacagtcaaactctaatggcggctacaatggcagttataacaacggaaactacaacaacggcaattacaacggcggcggatacagcaatccgaattaccaggatcgtggttacgcctactatggacagagaaacggcagagatccgtacaggggcagcagcgactgcgacatgtgcgatgcctgctgcacactctggtgctctgacaaatgctgtgaggcaatgggaggtgatctctgcacatgcatgtaagctcgacatctgtagcaagaggaggagtgttcacagcgcttgcagtcatctgtattcttttgactaacgttttttccacatctacactgttcctcctgataatagcggcctgctttacggcatttgcatacagcttttcgggacttaagttcgggatagcggcccttgcggctggtgctatcctgggacttttcctgtcgccacggaagggcattatttttacctatgttggtatagcactctacctgatactggcgcaggtcatagagaggcatttctatgataagggaatgctcaaatactgggggcttaagtgccttgttttcaatgctcttttttgggggcttttttttatagcaatatccgtggcaggcgtgaccggtattttttccgcgaaagctatcgcaaatttcaagaaaatggattacaaatgggcgcttatcctgctctttgtcgtggcagtcgaattctgtttcgcagttatagacagggtgttttttatggcgagaaacaggctcgaacctatccttatgaaatcagaacgataaaagattttacataaatttaaaggaaaaagaatggaagatttaacaaagataagagaagatattgacggcgttgacgaacagcttctcaatctgttcaaaaaaaggctcagactcgcgtgtgaggtggctgattacaagatagcccatcacagaccggttctcgacaaaggcagagaggaagcgaagctttcacatctgacagagggcgtgaaggacgagttcttagaacttggaattcgtgaatttttttcactgataatgtctatcagcagaaaaaagcagtaccagatgctcgctgaaaacggaatcggagaggacagcggatttacctgtgtaaattcgtttaacctgacgaatgcgaaagtcgtatatcagggtgtcgagggcgcttacagccaggctgcgacaaacgatgtctttggaaaagacgtcgattcgttccatgtggctacctggagagaagccatggatgccttgagggagaacagggcggatttcgcggtgcttccgatcgaaaactcgacagccgggacagtcagtcagaatcttgatcttttaaatgaatacgactgcgcgataatcggagagaaggtcataaagatcgatcacgctctccttagtacaaaggatgcgacgatcgatacgataaagagagtctactcgcacccgcaggccctgatgcagtgcgctgactatctgaggcagcacgagcagttcacttcggtcagtaccacaaataccgcggtcgccgcgaagaaggtaaaggatgacaacgatccgtctgaggcagcgatagcgggaagcattaacgctgatctctatggacttaaagtcattgattctgccattcaggatgtaaaagacaatgagaccagattccttatagtctcggccaagaagatattccgccgcgatgcgaaaaatatttcaatctgttttacccttccgaacgaagagggaagcctgtatcagatacttacacatttcgcattcaatgggctcaatatgagccggatcgagtcgaggccgctaaagggaaggccgtgggagtaccggttctttgtggattttgaaggcaatcttttagacgagggcgttgtcaatgcactgttgggactcagatgcgagaccaatgatctgaagattttgggcaactattgattcactaaaaaatggggtatatatgaaggtaaaaaagtacggatcaatttacatcggaacatacgagatttcacttcgcatttatgaggtgaagaacggcacactcaaggaactcgatgagatgaggatgccggtccaggtatcacacgatatctataattttaaaaagataacggcagatacctttgatgccattataaaggctctgacggacatgaagcgcgcgctggaagaatttaaagtggatttctaccaggcttttgcggtgtccgctctgacggaggcttcgaactatctgatactttttgaccgtattaaaatacactgcggcatttttgtaaagctccttacgaattcacagcagcgtttctacagctaccaggcactggccgcccgtcctgatttttcaaaaatgatagaaaaatcggctctgatggctgatatcggaggctcttcaattcagcttacactctttaaagagggaaagcttctgactacgcagcatattatgtttggcgctggtgaggtcagagaaaaccttatcgcgctgtcgcagaaggctgatggcagacagcaggtcctcgagatgataatcaaagagaccgataactttttccatatgtacctgccggataagggaacggaatatcttattcttttaaacgacaatttttcaaatatcgtaaacctctttggtgagaaggatttcctgaataagcctgtggaaagggctaaggctgtctcatttatgaaagaactcggtgacgagaactatttcaaggatacgttcaagagatttaatataaacgaccctgacgatatggtcatccctttcctgcttttatacgatgctatgatcatacagacagagtgcaaaatgatcacggctccgggtatttcaattcacgacggaattaccttaaacagcctttaccgtgtcgggaccatgaagcctgatcacgactttgaggccgatgtgataagtgcagcctattttatcgcgggaaggtgtggaagctataaaccgcatatcaaaatgatggaccgtatgacagcagctctttttgacgcggtctataagaggagcgggcttgagaagagggacaggcttttagtcagagtcgctgccatccttcacgactgtggcaaacacttaagcctctcagttgcggctttgaattcctattctgtcataatgtcgtcagagatcttaggcatcactcacgacgagagaaagctcatcgcgttgatctcaaggtatcaccatgagaaggacttgaggtattcgagatttgaaaatgaacttactgaagacgaatatatagtatttttaaaacttatggcaatacttcgcgtctgcaatgcgatggattcgagccacaagcagaagttcaaggatttaaagatcagaatgcgcggagacaggctctttatctcggtttcctcgaagcttccactgaatctcgagaagagctactttgaagataaggcagcattcttcactgaagtatttggaataagacctgagataagggacaagaaggagatatgatatggcagtagattttaaagatccagaatactacgaaaacagagagctttcgtggatgatgttcaacgagagaatcttaaacgaggccagggacccgaaacttcctcttctggaccgcttcaaattcctaagcatcacggcttcaaacctcgacgagttttttatggtccgtgtcgcttcgctcgtcgatatggtccatgccggctacaagaaaaaagacctcgcaggaatgacggctaaggaacagctcgacgcgctccgcactgtaacccacgagtttattgacaggcagtataccacattaaaccgtgcgctgcttccggctctcgagaaaaatggtgtaaagcttgttgattcatacgaagacttaaatgacgagcagtccaaatatgttgacacatacttcaaagagaatgtgttcccggtacttacgcctctggctgtagattcgtcccgtcctttcccacatataccaaacaagtcgttaaacatagcagcccttatcactactggtaaaaatggctcgaggcttttaaaggatgcggagaaggaaggagacatctcctttgccactgttgcagtgccgtctgttctcccgagacttatcgcccttccttcagattcagataaggaatcagatttcattctgcttgaccagatcatcgagaagaacatgtcgaagctcttcctcaattacaatgtgctctgtgcttttccttacagagtcatgagaaatgccgactttgaactcgacgaggaagagacgtcggatctgatgaaggagatggaaaagcagcttaaaaagcgtgcctggggcgaagttataaggctcgacgtcgaagaaaatatggacaagaggctccttaacactttaaagaaaaatttccatgtgtcacaggaggccatctatccgatccacggaccaatggatcttacggtatgcatggatatctacggacttgacggatacgacgatctccgtgagaaggagtttacgccgcaggtacagccgagacttatagactgcgacgacctgttcgcagagataagaaagaaggacatcttcttccagcacccttacgattcgttcgagtcgatcgtagactttataaaacaggcggcagttgacccgaaggtccttgcgataaagcagactctataccgtgtaagccgccactcacctattatcgcagctctggcaaaggcagctgagctcggcaaacaggttactgtcctggtagagctgaaagcccgtttcgatgaggaaaacaacatcggctgggcgaagatgcttgagaaggccggatgccatgtgctctatggtctcgtcggcttaaagacacactcaaagatcactttagtcgtaagggacgatgaggacgggatcagaagatacgtacatctcggtaccggaaactacaacgataagactgcgaagatatacacagactgtggtatcctgacctgcaatgagcttatcggagaggacgccacggcactctttaatatgctttccggttactctgagccggcttactggaacaaactccttgtctcaccgatctggctcagggacggcttctacaagcttatagaccgcgagatcgagcacgcaaaggccggaagaaagggacgtatcgtcgcaaagatgaactcgctctgcgacaaagacatgatcgcccgcctctatgaggcttctgcggcaggtgtaaagataaaccttatcgtcaggggaatctgctgcctcaaggtcggaatcccgggagtcagcgaaaatataacagtttcatctatcgtgggaactttcctcgaacacagcaggatattctatttttacaacgatggagacgaagaggtctacatgggttcggccgactggatgcctagaaatcttgaccgccgcgtcgaagttgtattccctgtcgaagatccggacctaaaggagtgtgcaaagcatattttagaggtagaagaggccgacaatctgaaggcttactatctgcagcctgatcagacctaccagagaaaagaccgcagagggcagaagaccgtaggaagccagatgacattctgcgaagaggccattcagaggacgaacgaatatctcgagagcaaagacaacgagacatatacctcaagactcttcaaaccggctcttcctcctgaagaataattttcagaaatctttgctgttttttaaaaaaaagtgtaaactttcaaacaagactgtcgatataaataatgaaaggatagtaactattcattttgtctgtctgagaaaggaggcgggcattatgtctatctacagagttgtgaaagtttcaccggtttctgaaggtcatggagacggcggtggcataggctatgagggaaagaggaagaaggcgaaggtttctgctcccaagaggggatttggccgcgtattcgattcctctatacgcgccgattctctgaacagccagaaagctgtaaacgtctacaatggtattttgaaactttgaccatttttttgaaaaataccttgacattgtagtgtcgaagtgatattctaattgagttgtatgaagcagagtattccactctcacctgagcacctggcgtatgcagagtgtgtgactcagagttacatagttaggatcgatcagattttttattatgtatttttgtggatagtctgcctatccactttttttatgtccgtatggaggtgtaccattagcgaattactggtaaatgaaaagatccgtgcgaaggaagtccgtcttatcggtgtgcacggagagcaggtaggaattatgtctgctcgtgaggctcagatcaaggcacgtgaggctgatctggatctggttatggtttctcctaatgcccatccacctgtgtgcaagatcattgattacggaaagtaccgctatgagcttgcccgcaaagagaaggaagctaagaagaaacagaaggttatcgaggttaaagagattcgtttctcaccgaatatcgacgggaacgacatgaataccaagctgaataacgccaggaaattcctcgctaagggcaataaagtcaagcttacgcttcgtttccgtggacgtgaaatggctcacatctcatccagccgccatatcataaacgatattgccgacaagctttcagatgtagctacagtggataagccttcgaagcaggaaggcagaagcatcagcatggtgcttacaccgatcaaggacaagtaatcggtgtaaaggcagtacaaagacaaggaggatatctatcatgccaaagatgaagaccaagagagcagctgcaaagcgctttaaagcaactggaacaggaaagcttaagagaaacaaggctttcaagagccatattctgacaaagaagaccacaaagagaaagagaaatctccgcaaggccactatgacagacccaacgaacgagaagaacatgaagaagatcttaccatatctttgatggtaagcgcagtcaggaggtaaattatggcaagagttaaaggcgcattaaacgcaaagaagagacataatagagtattaaaggcagctaagggatacagaggagcccgttcaaagcagtaccgtgttgccaagcagacggtcatgaaggcactttccactgcatatgcaggaagaaagcagaagaagagacagtacagacagctttggatcgctcgtatcaatgctgcagcccgtcttaacggactttcatacagcaagcttatgcacggtctcaaacttgcaaatatcgagatgaacagaaagatgcttgcagatctcgctgtatcagatgcagatggttttgcaaagctctgtgagcttgcaaagagccaggtagcttaaaatctatcaaacctcatagcgcgacttctgcgttatgaggattttttttacgcgcgaatctgcttaataagctgtcaatagttatggcagcttgaactatttgaaagcttttattattgcgtcgcggaacttttataaagctcgttttcggttataagtgctcccgctcgcgggcatctgatttcttttttcgaggattcctccttcctggctgtatctgggagtgattaacacatgcgccttcaaatatgtcatccaacaacgagagctcacatgcttttgcataaatcgggctatgaccacttcatccggcctaatacattgccctgttggcctgatagcgatatctgtttccttcttttctctgggaatcgatcttatcgtcagcagcgctttttaccatggcagacaggtttgagagcacagattgatataaaatcctgctcgattgaagtgcttgttgcacctgagattcctcaagcaggcactgatgcttcaattcgccgtattttgactctatcggccagcgcataaaatacagttctttgaagtcatcactgtcagatcctcattgatgttgtagccaggtactctgtaacaccgccgtcaagcgatcttgatgacacgaagttcaatgtcttctgtacccttcttcttgtttccagcaaggtggaatacagtcgccggtgcactgcttcgcaatcttaaaactgtctctgatgcgcatcacgcagagataacctctgtcgtgagaaatctgaacatggcatcagagaaatagccacggtcaaatagaccacggaatctttgaatagatcaagcttttcgagctcttcacagtgctttaaagcagcgtcacgttcaagcccaatagcgtttgattagccatgaacgacgacatcatgcagacatcatatatggttgacagagagcaagagtccattttcgattggggttgttatgcgaacatctctccatagttttcgaagtttgactttgaatttggcagtgtgatgcgcgatccatcgattgcaaagatgtgatagagacatgccatttttttcgctttttaatggagctgtagtaggtgtctacggagacatcaaacagttccttgaaaagagatggtagaatgccctgcctggcttggaaacggcctgttttgtgactttcgggaattcgagctgtggcagtcaagcggaggtttgccaggtttatgctcataggctgctttgaagttagagcagatagacaatgatatgagtcattgtgaggagtcctttccgaaaaccgtttttcagacgatgggattccagaaatacttctgaacggatcaattcggaaattttttgcaggatcttcctgcagatggatgtgaattcataaagtacctccaattgataaagaattgtcccgtccctgtgacggacatttgcctttaatcaattggccgctttcactacctcaagatttttcagtagtgaagcggccgcacattggatttcaagtatgatcgacactaatcgacttattcattatcccaaaacagatcgtcaagagttttgtcaagagccttgcagatggctatgcaaagacgaattgtaggattataatcacctttttcgatagcgttgatggtctgccgggaaacacctacaaggtctgcgagctgctgctgggagaggtccttggcagctcttgcggatttcagtttcagattcttcatcagttttgctccctgcgttctcttgctttctgaaaaaagactgtggctgcaataacaaggaacaaaattccaagagggagatttatatcacatatggtaaaacacccatcctcaagtccatcagttgcaatgttctttataccaaagtaaagatttgctacaccgagaagagtaattgatatcgtccacctcttccaggttcctgtaatgccaaagtaggcgcctttaagaatcatgcagacgacgtaaacttcaatcatcagaaagcttaccataatcagagcaaagccaccagtgataggaagcagatctgcttcaactatgaggccggcgattattcctccaaagataccggtgagagctgcatatttgtaggcagtgccctgtatcgctgcctgtctctcgtcatattcgcattttttgattcccttctttctacgaataaatgagaaaagaaataacacagcaaggaatgcccctaagaaaattaatacatcataattcataatgtcctccaatctgatgtcaactatattttacatttataaagatatcaccgatacgacataatgtcaagtataatttacattttaaagtgcattgatttatgataaaatgtaaatattcatagtgaagtattaaatatcaatacatagtgtaggagacagctatatgaatgaagaaatcttttcttttgtgatatatatgattcatgcatgtgctgatcgttggcataaagcaccatcgaaggtttatcaggctataaaagacagtggatgcttagatgaatacctggttcctttatatgatgtgctgcatactcagagtacagactatgtggtgcacgatatcggtgaatacttgaaaaatagggggatttcagcatgatagtttaccgcaatcaatcagattctgacatttaagaaagctatggagatagtgccatgaacgatgatactcttgaacagttttatcaggaggggttggaagaacgactgatatcatatctcgcgaagaaaaagaatatttcacttgagaaggccatggatatctattatcacagtgatatggccagatatatttctgaaggaaaatatggaatccagtatctggattataaagttctggcacagatgttgatggattcagaacaagatttatttgaaaaataaaaatgtttgacacacctaacaaactgtgcgataatactcataagttagaaaaaactaacaaatgtaatcttgaaaggagatcatttttatgggtaagatcgcgatcgtttactggtcacgtgaaagggtgccatgaaagggtgccaggcaccaatgtggtacacttagcgtcaacttaacttaattgcatgtctccaggatttttgaataggcatttttataatgtttgaatatctgccacgttttgaaggtgattttttatggcagaatacagtgcaggtccttgagattactccggagcacatcacggcaagaaagtacatgaacggtaaatttttttacgcgattggcaaaagaaaatacgcctgtcccgtgacaagatgagcggctattcatagttaatcattaacagggctgaccgtctatccggtagcctttcaattgtatcttacactttagtaaattctgtcaaatgaaagggacagctgatctatgcaatattatactcaagtgatacagaagaatatatttaaaatattttaatctatatcactgcaacttttcatgaaagatctgtttttacagaaaaaaattcatactctccagtggcaacattcatagtttttcctttttatttttttatgactaattttttgttaattttgacaagttggtcgataacttctttttgctctaatattacattgttctgctcggataacgaattttttaaaactgatatggtattattctgatcatctatcgttttcttctgtgtttcagtctgagtaagaagataatcggtatattgcttcagaaacggatcttgcgtcattccggtgatgtactgatctgcaatggtggagtagatgctggaccttttggcatatctccaccatatatcttcgatttcgtaatgaatggagttcgtagtccacggtttatagctgctggaaaaatggaggatagaggccttttcagcatcggtttccttagctccatcgttaaaggccaggagggtgaagagattgtatttttcccagtcgatatattttacctttccaaaaaatacgtaatttaatatgtcctggtcaaaggcaggcatctcaaaattccagtcattcaatgcatttacatatgtatttagggaaatgttattttgtttcatccaatcgatgttatagagaagaacgccggcattgaaatagaacggttcgctgcctgcgagttttccaaacatctccctttgcttaggtgaatcgagctgctctaaagtagttccgtagccatttctatcgtatgcaccagccagtgcggaaccatttaacaccatgttatagagttcggagatgtctttatttacgataatatcgacatccagatatagtatccgatttactgtgtcgggcagtagataggtgagcatcagcctgaaatatgtttcaatagaccacatgttattgacagggactttttctgagaaaacctgtctgtttatttttagcgggataatattgatatcatagttttttagtgattcttctataaaatctatgtctttatctgtaagttcgcagtggagcaggtatgcatcgatatgcactgggttattgatgcagagtgatgtcagcatgactatggtataatttacgtattttctgtttaatgctgtggcgatgttcatactgattaactcctcgttatttttttgaaggctgtgttcgcatcagataaatagctgtcatttatataatcggagacgtagaagattttaataatggggatttcagctatattagtggcaaacatcataaaaatcttgtttttcatatgagtttccttaattaaatgttggctttgtactaattcatgcagtagtctatgaaaattattatcatacttttcaggcataaatgcaatttttttatgcagttggactgaacgaagtgaatagagtataatgtctatgttgtctctatttctgttatgtaaatctactagatggtatgaatatgaacgaaaataaagaagaaaaaattaaattttcgataatagttcctgctcatagtgaaaatgaaatattgcggcgttgcttaaatagtctggttagtcaggactatgaaaatattgagatacttgtagtcgtaaatgcagcgacacagggaactaaagatgtcgcttttaaagcatcaaaagaatactcaaatattaaagtattttatactgacgaacccggtctttctaatgcgcgaaacataggacttgacaatgccaaaggagatattatcggattctgtgatgcagatgactggtaccagccgggcatagtaaaaaacgtggcagatgtattcgaaaacgagcattgtgatattgctatctgtggatttaatacagtcggagataagggggaaataatagagacaagattagcagggcaggatttcattctgtctgatgaagaatacctgatcggaatactgacgaattttaatataatgggatttgcgtggaataaattcattagtagtagattgattaaagatattcgttttaacaagaaacttaaactgatggaagacgctgagtttaacatacatgtcataaagaactcagaaatttttaataatgatttgaagatcaattatataaatacgattggaaatgcatattatcaaaatcccaatagtgcaacacacaatgtattagatcattcggatcatggcaagcttggatatatcgcagatttagatacgatagaaaacgagtttactctttctgaaaaagagaaagacgctttaaatgttgcaaagataagagatacttttggaatcctggtattatattataaatatgggatgctccatgaacctcaatttaaggacatcatagataattcaaggcagaattttttaaaaagtgctcattctatgtacgcctttagcggtgctgatgatgacgaaaagcagagtacctttattttagcgaatgcaattattgaagcagaagctgaaaagaagaacaaagggaaggatgacaagccaaaattttctattattgtccccgctcataatgaagatgagatgctgttgcaatctattaacagtattgagaatcaggattatgaaaatctggaaattattgttgtggttaatgcggcaacgcagggaactaaggatgctgctaaaaaagcatcggaagaatttcataatattaaaatttttaatatcgatgagccgggggtatcaaatgcgagaaatacaggtcttgaaaacgccacaggtgacataattggcttctgtgatgctgatgattggtatgaaccaggcattatcaataaggtgtcacaagtatttcagaatgaaaaaagtgatattgtaatttgcggttatagttttgcaggcgctgagggtgaaaaaaaagatatgcaggaaggacaagatatcgaactttccgaggaagactatttcacaagagtattgactgacaataatatcgctggagttgtatggaacaagttttttaatagcaatttagtagaaaatattatgtttgacgataaacttaaggtaggggaagacatagaattttgccttcatattgtcaagaataataaaaagctgaaaatcaattatattaatcagattggatatgcctattaccaaaatcctaatagtatatctcataatatgttggaaaattccgaacatggcagacttggaggcttgatttctttagatactatagaaaatgaatgtgaactctccgaaaaagaaaaaattgccatgggagtagtgagagtaagagtgactttagggcctctgctgaaatgtttaaacaatgaaatgtataatgaacagaagtataaagcagtcattgaaaatgccagggaggaattcttaaaaaacgctaagtatgtctatatgtctggttattttagtgatgatgaaaagatgaatatttttatattagcaaataaactcagtactgaatggaaataaacacgagaacacagatactggcatttgctttaataatacatttttactaatacgaggagacctttatgactgaatggaaaaatgaacaggaagccagagagcagataaaagcccttgtcggagattattatcatcagtttaagagacaagagacagatcacagtgattttaaaccgggtgaccgcatctcatatgcttcaagagtttatgatgagaaggagatgcagagcctgacagacgctatgctcgatttctggcttacgactggaaggtttgcaaatgaatttgagagggattttgcaaagtggatcggtgtaaagtatgcatcccttgtaaactctggatcttcggctaatctgattgctttcagcgcattgactgcaccggaactcggtgacagacagataaaacgtggcgatgaagtgattacagtagcttgtggctttccaacgaccattaatccgatactgcagtatggtgctgttccagtatttgtggatgtaactgtccctcagtacaatatcgatgtatctaagctcgaggcagcttatactccgggaaagacaaaggcggtaatgatcgcacatactcttggtaatccatttgatttggcagctgttaaatcattctgtgatgagcataatctctggcttgtagaggataattgtgatgctctcggatcacaatatacgattgatggcgttacaaagtatacaggaacctggggagatattggaaccagttctttctatccgccacatcatatgacaatgggagaaggaggatgtgtctacactgataacccaattttgaacaggcttattctttcttatcgtgactggggacgtgactgttattgtccgtcaggaagagataatacctgtgggcatagattcgatggtgactatggcgaactgccacatggctacgatcataaatatgtttatagtcactttggctacaatctgaaagtcactgatcttcaggcggctattggagtggagcagttaaagaagttcccttcatttatagaaagaagacgtcataactgggacagactccataaagcgcttgaaggaatttcagaaaaaattatacttcctgaaccagccgagggctcaaggccatcctggtttggatttcttatctctgtaagacctgaatcaggtttaagcaggaatgatgtaactagatatatagaagaccataatattcagaccagattacttttctctggaaatatgacaaaacacccttgctttgatcagatcagaggaacagatgcttatcgtatagctggtgagctgacaaatacagactttatagttaataatactttctgggttggagtgtaccctggaatgacagatgctatgatagattatatggcgcagattattacggaagcagtaaatcgttgattagatttttaatgagagcagcaaattttaactaatgaaaaaatgtaatacagttgaggaacttcaggaggcagcactaaaaatcaggcaaaatcttctgaaactctgtcataaagaaaatattcatatcggtggagacctttccattactgatgtcatgactgtcctctggcagtatcagatgaattattatccgaatgacattcacaatgaaaatagagacagatttattctttcaaaaggccacgcctcagcagttacaagcttcaaccaggctgctatcggatgcttttcatcagatgatgtgataaatgaatacgccaccgatggcggaagattttcgatgcattcctgcaatctggtaaatccttatgtcgaagtttcaactggatcattgggacatggatttcctatagcctgtggaatcgctcaggcacttcgccttaagaacaatacgacgagtcgtgtttatgttgtcatgggagatggagagcagtgtgaaggctccatttgggaggctgcaacaaacgcagcaaaacaaagacttgggaatctggtttccatggtcgacaacaatggcctcgaggcagacggagctttaaaagatgttgcaggaatttcatcacttgcagatagatacagggtctgtgggtggaatgttgtcgagctgaatggaaatgatatcgtagaaataaagaatgcatttgataatctcccagctgcaacaagcagtatcccaacagtttttatctgtcatacgacaaagggaaaaggagtctcctttatggagaatcaggctcgctggcatgcgggaaagctggatgatgaacagtataaaaaagctgttgagtctttgcagaatgaatatggagtcgaaagcattaaaaaatgataaatatagatcgtacttctaaaaaccttctccgagatgtggtgggggatattactacgtctataggagaagaaaatgataaggtcgccgtggtcaatgctgatctgatgggaacctgcaggatgcgttcgtttaataagaagtttccagacagatgcttcaatgtaggaatcgcagagcagcagatggtaagcttcgctgcgggcctggcacatgaaggatttatcccattcgcatttacaatggctccatttatctcaatgagagcatgtgagtctgtcagagatgatgttgcttatgcaaatgctaatgtccgcctgatgggaacctatgctggtgtttcaggtggaatatccggagcaacacattggagtgttgaggatgtcggcatcatgacaagtattccaaatataacggttattgaaatatcggatccgaccgaggcagatcagctgcttcgccaaagtcttgatcagaacggtcctttttattttagatacgggattatccctgttccgtcaatttataagaagaattatcattttgaaattggcagagcagaagtgttgaataaaggaaatgatggagcgtttatcgtttccggagtaacggtgccatatgccatagaagcatcaaatcggattgaagagaaaactggcaggcatataatggtaatcgatatgcatacgataaagccaattgaccgtgatgctgtaatgttggcagcggaaacaggaaatatcgtgtgtgccgaggatcataatatttacggtggacttggcagtcaggttgcaatggtgcttgctgaggagggtctcgcagtgcattttaaaaatataggtgttccggatagatttgtagcaatggctcatgcaccttacctttatcatgagtttggctatgatgccgaaggactggaagctgcaatgatgtcaatgatttcagaggataaatgaatatgaaaagagccattataacaggacctacaggagagataggaactgcgctgacaaaagaaatggtttcacatggtatagaggttctattaataacaaatcctaactccagacggaatgccacaataattgatgatccgcttgtatcaacgcttccgtgttcactcgaagattatgcttcgcttcagaatacatcgaagaaaaaatatgatgttttctatcatcttgcctggtcgggggcaatggggtccgggagaaatgatattcaccttcaggagaaaaatttgagaggcgccatagatgcagttgaactggccaaaaaatttggatgcagcagatttgtcggagttggatctcaagcagagtatggcagggttgaaggaaagttgacaccagatacaccggttcatcctgaaaatggttacggttatgctaaattgtgcgcaggtgaaatgacaaaggatttggctcaccaaaatgaaatggaacattgttggattagagtattaagtgtatatggtccgaatgataatccgaacagcatggtaatgtctaccattactaaacttcagaatggtgaagtacctgagtttacgcctggcgaacagaaatgggattatctttacagtagtgatgcagccagtgcattaagaattgttggagagcatggaaaagatggtgaaatttatattcttggaagcggagaagttcatccactaaaggaatatattgagacaataagagatgttgtcgcaccacaaagtgagcttggtattggaaaaattccatatgctcctaaacaggtaatgtttttgtgtgcggatacgacagagttaaacaaattaggatggaaagctaaagtttcgtttagagaagggattgagaatattatcatgaacattaatagaaaagaaattgtgtgggggggataattaaatgcgattataaaaaggctgcagcatattattttataaatacaatggaggattgctatgcagcgtaatcctcttgataataaaataatatataaagattgtgaaacaatttatttaaatactgataaaattgataggctgaagaacaaaaatatatttatcactggtgctgcagggatgctagcgtcttattttacgtattatctgtgttttcttaatgaaaaataccaaatgggtattaatatctacgctggtataagaaaacaagaaaaagcaataaagatatttggcaatatttgtaatagagaatattttcatattgttaatgataacgttattaatccggttaactcggatgttaaatatgatttcattgttcatgcagcaagcctggccagtccgcagtattatggcagcaaccctgttgaagtaataacgccgaacatattaggtacataccaactccttgaatacgcaagagaaaatcatatagagggaatgcttttctttagttctggttctatttatggagatggggacaatcttactgtaacggatgaaaattcacttggacatcttgattatctcaagtttggcaatatgtatggtgaaagcaaacaatgtggagagatgttatgcaaagcatttagtcatgaatatggtgttcatgttaattgtgccagaatctatcatacatatgcgccaacaatggatattaaaaacgataccagagttttctcagaatttgtaaagaatatggtatatggcgaagatatagttatgaaaagtgacggtacttcaaaacgagctttttgctatattacagatgctgtagaagcattcataaaaattcttctcagtgaagaaaatggtgaatgttataatatgggaaacccaaatgaatttatttcgattcgacaattggcagagacattttgtagtttgtcagatgatgattgcaaggttatcattcagaggcgcgaagataaaggttactcggcagcaacagcagtaagtcaaaattttagtgtgcagaagttaaaaaaactggggtggataccaaaggttggtgtaaaagaaggatttagacgctgcattcaatatcaaaagagtcttttataattaaagtactgagtataataaggagcaaaaatgtcagaacttcttgatttttataaaaataagacagtgttagtgactggtcacactggttttaagggaacttggcttacaagaatacttcttacatctggtgcaagggtaataggttattccttgaagccaccaacgaatccttctttatttaaaatggctgggtttgaggactatgaaaaaaaagaccagcttatgaatgtaatagctgatattcgtgatctttctaagttaaaagaatcatttgacaagtataagccagagatagtttttcacctggcagcacagccaatcgttcgtgattcatataaaaatcctgtctacacttacgaaacaaatgtcatgggtaccgtaaacgttctcgagtgtattcggctgacagatagtgttcgatcttctgtcattattactacagacaaagtttacaaaaacaatgagtggatatggggatatagagaagacgagcctctggatggttttgatccgtattcaaattccaaatcttgtgcggagctttcggttcattcctataaaaattcgttttttaatgagatggacggaagcgatggtaagagatattgtgcagtaagtacagcaagagctggaaatgtaatcggaggcggtgacttcgctaatgacagaatcataccggattgtgtaagggcgatggaaaatgcagtaaaatccaggaaaactgaaggagtgattgctgtaagaaacccatattctacacgtccatatcagcatgttcttgagccacttgcaatgtatttgacaattgcatataagcagtgggatgatctgtcaaaatcaagttattacaatgtcggcccggatgatgtggattgtgttacaacaggcaacctggtcgatttgttctgcaagtgctggaatgacttcggcactaatcttgcgaaagccaaatgggaaagccatgctgatccgaatggaccgcatgaggcaaattttctgaaacttgacagtactaagatcaagacaatgcttggctacaagccgaggtggcacattgctgaatgtatgcagaagacggtagaattcagtaaattatttattgaatcaccagagtcactgccaggagaaatggataaagaaataaaagaattttttcgccgattgtaaaatgaagttggacatctgaataaataataagatccatggcaggatctttggtagaatgttaattaccacaaaaaaactttctacaggagaatcgtcaaaacaaaatagcagtaaaatgaggtatgacggatatcatttgtaaaaaaatcatctgtttcatcagtatctcttaacagcttaatcaatggagcttgaaatactcctttggttgtgttatattttgttcagattaatttgattcaaatgaatttgaataaaaccgttctgaataaaacttcaggagatgacgttatgtttatcggtagagagcgtgagctgagtagtcttgatgagctttacagtcagcctggttttgggatgactgtgatctatggacgcagaagaataggaaagtctactctgataaatgagttcataaaggataaaaaagctgtattttatactgcaacgaaggttggcagggaaagaaatctcgaactgctttcacagcaggttatttcaacacttgagccgtctcttgttggggttacttttccatcgcttgaagctgtttttgattttatctcaaacaggctgagtgatgagaaactgatccttgttattgatgagctgcctttctgggcgcaggatgacagggcgctgctttctgtgatgcagaaatatatcgatacgatttggtctgataagaacctgatgatcattctttgcggttcgtccttaagctttatggaaaataaggttttaagcgaaaagagtccgctttttggaaggagaaattcgcagataagactggaggcttttgattatttagacgcggcgaagttcgtccctgcatactcctctgaagacaaagctgtggtctatggtattaccggtggtgtcgcaaagtacctggcacttattaatccaaaatgcagcgttgatactaatattaagcgtttatttttccataccgatggctatctctatgacgagaccaggaatctgctgacacaggaattttcagatgtcactatggtaaacaatgttatcgagcagattgcgtccggtgtaaacactgtaaatgagatatctcaaaaaatcgggcagaatcctacgactgttctctataccatagataagctgatacaggtcggccttgtagaaaaaagaaaatgtatcaccgaagaaaaaaataaaaagaaaacacagtatatccttaaggattcgatgttcagattctggtatgcgtttatcccaaaggctacaagtgtgatagagatggggcagggtgatcgctactatgacaaggtggtaaagccccagctgcatgattttatgggaaatgtttttgaagacatgtgccgatattatactctgatgaatggaataaccggggcatttggaagcatgcttacaagtgttggtgtctggtggggcactgagaacttcaaaaaaggtccagaaaatatccatcagtcagctgatatagatgtggtcggaatttctgatgtagataaaactgcggttattggtgaatgcaagtttaaaaatgatagaattgataagaatgtctacgatactcttgttagacgatcatctgtcattagcggaaaataccgtatcataagatacctgttcttttccctgagtggttatactgattggtttgatacaattaatgacgacagcattgttcttttgacgctggatgatttatacaagagtttttgataagtatctgctgaatcttctttgtgatagaatatagtatataactatcggatgggcggggaatcatttatgatgaaaataaatatcgctatgatcacgaaaaatgaatcacgctgcattgagaagtgccttagggctgctgctccatatgtggacgagattattgtagtggatactggctcgactgatgatacctgtgagattgcagtatccatctctgataagattcatttgtatcattttgactggataaataacttctccgctgccagaaatttctcgcttgagatgtctgaaaagcatggtgcagactattcgctggtgctcgatgctgatgagtatctgagaaagcctatgcaggatattcatgattttcttgaagcttcctgtgcgaagtgcggagatgcctgggctggatatctgttcagatacagtcagttctatggtgataatgatcagatagatatagaggaaagtaggattacacggctgattccccggggtaccaggtatacaggaataattcatgaacagccagactttaaaggaccacatatcagtactccttttatagcagatcatgatggctatctggataggagcaagggcgagagaaacctcggatacctgcaaaaagagtacgagaaaaatccacttgacccatatatctgctatcagatgggggttgctttaaagagtatgaagaggacgactgaggcaggcggttatttttcaaagttctttgatctgattgccggaaatgataacgcttttaaggctgattttgtaaaagatggagtggtcagatatttatatactctcacagatataaataccagtgaatcactggaaaaagcgttttcaatcgtatctgaaacagaaaagtactttttagaaaactcggatttttatttcttcagagggatttttttcatgaagcttgtgctttctgatacggcgaagtatatagagtatttgcctgaaatcgagaagagctatctgaggtgcatcgagatcggggagcgcgatgaccagatgactgtcacggggactggctcattcaaggcctggcacaatctgggactctactacagcctcttcggagataaggagaaggctgcaaaatgtcaggaagaagagatgaaaacaaaacagaggcggtagaccaaagctggtctgccgcctcatagtttttgcggaggttgtctttatcctgcctggggcgtataattattgaaagaggcgtgaaattactgagtcgatggaggtgcgcatgaaaaaacgtgtactgccggtgggcatacagagttttaaagatattcgagagaaaaactttgtgtatgtggataaaactgaatatgtatggaagctcagtacagatgtaaaaagctattttttgtcacggccgagacggtttggaaaaagtctgtttatctctacgctcgagagctatttttcaggtgaaaaagaactttttaaaggcctttatatagagaaaaaggagcctgagcggggagagaatgcctgggcgaagtatccggtcattactttttatctgtctggtggacaatacaatgagccggacgggcttaataacagattaatctctacattgacagatgttgaaaataagtatgacttagaacatgctgatggggatgtttcggttcgctttgaggaagtcataaaacgattatataagaaaactggtcgacaggtggttgtgcttgttgatgagtatgacaagcctctgctgtctacgatgatttctagtccagagcaggaagaaaaaaacagagagctatacaagggatttttctctattcttaaggatatggatgagtatctgaggttcgtatttttcacgggagtgactaaattcaccaaggtatcgattttttctgatctcaatcaacttgtcgatatatcaatgaataacgagttttctggtatctgtggaattacggaagatgagcttcttaccaattttgagccagagatagatagcctttctgatgaacaggggatttcacgtaaagaatgcctcgctaagcttgaaaaaatgtacgacggctaccatttttcaaagaatggtgtcggagtgtacaatccgttcagcctgctcagtgcctttatgaataaagatttcaacagctactggtttggaactggtacgcctgatatccttattaaaaaactgcagaaatctagtatgacgcttccgcagattactgatggtgtagaagcgacagaagatgagcttttgaactacagggttgaggaccaaaaccctatcccactctattatcagacaggttatctgaccatttgcggatatgacagcgatttcaggctgtattctcttaagctcccaaatgatgaggtaagatatggctttttgaactcacttattccgtcggttcttggatctggaaatcaagaaaatcctgtttctctcagatatatgctgatggatttgaaaaatggcaatcctgagtctttcataaatcgtctgacctctctttttgcagcaattccatatcctgagggaaaggctccggagtatgaaggtgagtggtcaagacagcttttccttattctttcgcttatgggtgcgtacaccagctgtgaagtacacatggctgcaggtcgggctgactgcgttgtcaaaactccggattatatctatgtcttcgaattcaagctcgataagccgatagaagatgcaatgcagcaaatagatgacaagggttatgctatcccatattctgctgacgaccgcaagctttataaaatcggagtagtattctcgacagagaagaggaatgtgtcggattataagatatcataagcgaagttgtttttttcttgtaaccagataggtggttatttttctggagctgtggggcgggtcattaagtcatgctttttgaccccttatatcatattaagttggaggaaaattattgatatggcatatagaaatttacgtttaggaattattggttctggccgcattgcggacagatttgtaaagacttcagtcgatggtgtgagtgtcgggacggtttataatccgcacgccgggagtgcaggtgaattctgcaaagctcatggtattgagaatccggaggatgatctggagcagtttttcgataagtgcgatgcggtctatatcgcatctcctcacgagacccacagcgcttatatcaggaaggcccttgaagccgggaaaaatgtgctctgcgagaagcctctggctctttctgggaaagaggcagaagagctttttgcgctggctgacagcagggggcttatccttatggaagccttaaagacagcgtactgcccgggatttgccggaatttgcaggctccttaaggctggtgccattggaaaagttactgaagtcgaggccgcttttacgaaactacagccgaccaactcgagggaatattggaacaggcagacggctggcgcttttacagaggttggcacttatccgatgcttgtgatctttactgtgctgggaactgatttcagggacgtaagatttgactcgacacctgtgtcgaatggtgtggatggatttactaacgcgtattttgattataaaggagagagagcagagaatggtcttggaattttaaggaccgcgggatcatttgcgagagcgaaaacgggtctttctgtaaagagcgatggctcgcttacgattagtggagcgatggggtatatttatgtgccggcaccgtggtggcttacgaagcaggttgaagttcatcatgagaatcctgacaagatcgagaaatacgattttgaattcgagggctcgggaatgcagtatgagataaatgtgtttaaggatgcctgcaacggagatcaggactccatcagccgcattttatttaacaaagatatctctgtcgctatggcttctgttatggggaagtttttatctgagcgcaccttatctcctgtcagaatttccaaagaaaaagtcaggatctggggctacagaggatgctgtttcagattccctgaaaacacgctgccggcttttgaggcgtgcgccagaatcccggggatcactggatgcgagatggatgttcagcttacaaaagacggtgaagtagttgttttccacgatgagaacgttaagcgtgtcacagacggtggtgacagactcttaaattcatttacgctgaaggaacttaagcagcttaaaatatccaacaggcggaagttcgattatatcgtcccgccgcttgatggagatcaaaagagacaggccgtggtcgagaagatcttctctgagattgaaagcagatatgcagaccagagctattttacaatcccgacattcgatgaattcctgacggcgatggagccgttctgtaagaacaatgggttcatgataaatgtcgagcttaagaccagcgtgatccgctacgaggggattgagcagaagactctcgacctcgtaagaaaacacggcctcgagaagtatattgtttactcatcgtttttagctgattcgatagagcttatgaaaaagctcgacccttcatgcagcacgggtatgctcgccggaacggtcgactactgcctgtatcgcacggatggaacgccgatcaaagcggatgcgattcacccgtggatcggaggcctctcttctccgcttcctgagggaaaagaggacattcctgtcagagcctggaacatggaggagccattctacactaatgacccgagaaaagtgctctcctatgaccagcgtatctacggtgagtcaggtgttacggatcttatcactaatattccggagaggtatctggtttaaaatatgtctgaaggctgccaatcacaagcgacgcgaaaggggattggtacgataagcgatatggaaaataaaatcaagctcaattatcaaaaactttgcgaggctgagatctctaaggcgacggctgacggcagagtacctgatgtgcttctgcacagctgctgtgcgccctgcagttcgtactgcatcgaatatctgtcgcagttttttaatgtgacggtgttttactataatccgaatatttatccggacagtgaatattttcacagggtgaaggaacagcaggagtttataaggcgatttccggcgaagcatccggtagggtttattgagggggacttcgagacgcaggaattttacagagcggcgaaaggtcttgaaaatgagcccgagagaggtgctcgctgcacggagtgctttaagcttaggctcgggacgacggctcaggtggcttttgaaaagggcttcgattattttacttcgactcttacgatttcgccgatgaaggatgcggcgcttttgaatgagatcggcggagcgatgggggaaaagtacggagtcaggtggctgccgtccgacttcaaaaagaaaaacggttatctgcgcagctgcgagctgagccgcgaatacggaatctacaggcaggactactgtggctgcgttttttcgtataacgagaggaagagacagaaggaggcaaggggtgtcaggtgatgagcctggcatttctttttgagatatgcaatatactctcctcgttgattttccggactcagattggtacaataaacactatggaaactaagagacagcctgactgtcaggaatttttacaaggataaaagaaaaagacaaaagaagacataacactgaaggaggaattacaatggcacagctctggggcggaagatttacgaaggatacggacaagcttgtttacgcttttaacgcgtccattggttttgaccagagattttttcatgaggatgttgcgggctcgagagcccatgtgaaaatgctcgcgaagcagggcattatttcaaaagaggacagggacgtgatcctcggcgggctcgattcgatcgaggccgacgtcgacaacggccggctcaagatcacagatgagtatgaggacatccacagttttgtcgaggcgaatcttattaaccgcgtcggcgacgctggaaaaaaacttcacaccggccgcagcagaaacgaccaggtggctctcgatatgaggctctatacgagaaagcaggtccgcgagacggacgaccttttaaagcacctgctcgggacgatcctttctatcatgcaaaaaaatattgacacggtcatgcctggttttacacatttgcagaaggcccagccggtcactctcgcccatcacctcggtgcatattttgaaatgttcaggagggatcgcgggagacttgccgatatttacgacagaatgaactattgcccgcttggaagcggcgctctcgccggcacgacttacccgctcgacagacagatgacggccgagtcacttggattctacgggccgacccgcaattcgatggacggtgtcagtgatcgggactacctgattgaatttctctcagctctttctatcattatgatgcacctttcgaggttttccgaggagatcatcctatggaattcaaatgagtaccgattcgttgagattgacgacggtttttcgacaggcagctctataatgcctcagaagaaaaaccctgatatagcagagctcgtccgcggcaagaccggccgtgtttacggcgcactgatccagatgcttacgacgatgaagggcctgcctctcgcgtacaataaagatatgcaggaggacaaggagctctcgtttgacgcgatggatacggcgaagggctgcattcatctttttgacggcatgctcgccaccctgaagttcaacaaagagatcatggagagatcggcccgtcacggcttcacgaacgcgaccgatgtggccgactatcttgttggcaaaggcatcccgttccgcgacgcccacggaattgtcggcaggatcgtcctcgactgcatcgacaaaaaatgcgcgatcgacgacctttcacttgatgaactcaaaaagttctcgccgaagttcgaagatgatgtctacgatgcaatctcgataaagacctgcgttgacaagcgccttacgacaggagcaccgggcagggcagcgatggaagaagagatcaaagcgtgcatcgactatctgaaggacgccgacagcctgatcgataaggcgtgaggcagtggcttttttatagaacctgttgtttaagaaaaacttaatccggtgcaatgctttttcaatactgagagtctgcgaagcaggaaactaaaagccatacttatgaagtctcaatataggactggatgttggtgaaaaacttaaagcagtgtaatgctttttcaatactgaaagtctgcggagcaggaaactaaaaaccagatttatgctgttttaatatagagcctgatcgtgtttgaaatctgcataggcttgtagaaaatttgagagatacggcagtatgctgaaaccatagaacgatgcgtttaagattcttgatcagcggaagcgctatcctgaaaatgaaaataagcgctttaagttttctgacgagttcatttgttatcttgaaaagcagggagaacgcactgtagagggcggcacatagacgagcgcacgcgaacagaaaaatcctacggagcgagaccgaccatctgcggcgctgcttcgggcataacaacgccttcaccacattgatggatgaatttgtcagaaaattcaaaaagtgggacaaaaagaaccgtccctactgtcccaataatgttttgacgcgggggcctgcaggtagtataatattagattgcaaaaatatttttattaaggagaaatttcacaatgaaatacggtgtaaatgagctcagaagaatgtatcttgatttcttcgagagtaagggtcacctgaaaatgaagagcttttcgctcgtgccacataacgacgattcgctgctgcttataaacgcaggaatggcgccgcttaagccttattttacagggcaggagatcccgccgagacgcagggttacgacctgtcagaagtgtgtacgaacaggagatatcgagaatgtcggaaagacagcgagacatcttacatttttcgagatgcttggaaatttctccttcggagattatttcaagagagaagccattcactggtcatgggaatttttgacagagatattaaagcttgatccacagagactctatgtgacaatttttgaaaatgacgatgaggctttcaatatctggaacaaggagatcggagttccggctgagaagatctacaggattggacgtgacgcagacggatccagcgacaatttctgggagcacggcgccggaccttgcggaccttgcaccgagatctattacgacagaggaccgcagcatggaaacggtcctgaggacgtaatgggcggagaaggcgaccgtttcatggaagtctggaacaatgtcttcacgcagttctataacgatggcaagggaaattattctgaactgaagcagaagaacattgataccggaatgggcctcgagagacttgcagttgtaatgcaggatgtagactcggtctttgatgtcgatacgatgaaagccataagagacgcagtctgtgcactctcaggaaagacatacgagacagatgataaggacgatgtatcgattcgacttatcatagaccatatccgttcgaccacatttatgataagcgatggtatccttccttcaaatgagggcagaggctatgttttaagacgtcttataagacgtgctgcccgccacggcagaatgcttggaatcaagggcgaattcatgggcaaactcgctgatgtcgttatcagagaaagccacgatggttaccctgagcttctcgagaagcaggaattcatcaggagagttctgacagaagaggagagaaagttcaatgccactatcgatcagggacttgagatcttatcagagcttgaggatgatctggcgaagaagggtgagaaggtcctgaatggaaaagatgcattcaggctctatgatacatatggattccctgttgatctgacaaatgagatcctcgaagagaggggattttcagtagacatggatggctttaaggcttctatggaggagcagaaggagaaggcccgtgctgccagaaagacatcaaactacatgggtaaggcggccactgtctacgatgatatcgacaagactcttactacagagtttgtcggatatgacaagcttcattgcgaagcaaatatcacagcgatgactaccgaggtaaatcctgatgccggaaagtacggcgagctgacagacgttcttcagaacggcgagaagggaaccatcatcactgatgttactcctttctatggcacgatgggcggccaggttggtgataccggtgagatcagaactgacaacggctgctttacagttacggatactatccatctcctcggcggacgtatcggacatgtcggctatgtttcagacggtttcatcagtgccaaagagcctgtggagatgtctgttgatcagaacagaagaaatcttatctgcagaaaccactctgcaacacaccttctgcagagagcactccgcgatgttttgggtactcacgtacagcaggctggatcttatcaggatgacaaggagcttcggtttgactttacacatttctcggctcttacacctgaggagctttcgaaggtcgagagacttgtaaataagcgtatccgcgctggtgtagatgttgttacagatgtaatgtcattggaggacgcgaagaagaccggagctatggctcttttcggtgaaaaatacggcgataaggtcagagtcgtaaagatgggcgactattctacagagctctgcggaggaacccatgtaaagaacacagctgatatcggagctattaagatcctctcagaggctggtgtttcgagcggcgtaagacgtatcacagcccttacttcggacaatattttaaattactacagtcagatggagcagcagctgaacgagatcctcggtgctttaaagacccctctgaacggagcactcgcaaaggttgagtcgctgcagaatgagatcaagtcattaaagagggaaaatgacagcttaaagagcgctgctgcaaaggagtctctcggagatatcaattccgatgtgacagatatcaatggtgttaagttctatgccaaggctctcaaaggtgttggcggaaatgaccttagaaatctcggcgaccagatcaaggataagctcggagacggagtcattttcctcgcatcagacaacggcgaaaaagttgcactcctttcaatggctactgattcagccgtaaagaagggcgttcacgctggaaatcttataaaagcagtcgcatctattgttggcggcggcggtggcggccgtcctcagatggctcaggccggcggcaaagatgccacaaagattcctgatgccatttcaaaggcgcaggaagttgtaaaggaacagctctcgtaaagaaaggtgactacccatgggacttgaaaaatgggaaaaagattcagagatcattaataaagacgacagcgtaaaaagtcttttgatccttcttaagggaactgttcagctgcagatgtctgacattgtttttgacgtgaatccgggaagcatcataggcatcgggtcggagcccggtgagacatatggcttctcgtgtgtggcgaagactgccgcagcgacatattcgtacgactttaattcacttgaagatgtcatccagatttttactgacaacccaaagatcgcaccagccatgtgcgaggcggttttaaaaaatgcctacaatatctacacgagtctcgagcagaaactcgagacctcgcttggcatgtacaaaaatgtgaaggaaaagctcgaagagtacccggtactctgcaggaggactggcgataagatccttgattttattatgcttaaagcttttccggcaccgcctgaagagacaggaatcgagagctggcgtgtcaactttttaaaggcgctcctttcattcgaaggcagaaaagatgagcttcttatgggtcagccggatctctgtatgggctatacctgcttcgcgattgaatttattcacgatgtaaaggcaaaagtcgccgaattttccaagtacacggatgatctgcgccaagcttcgggcgaatttctgatagtttactcagctgtcagcgcgaagagctcggctatcgagaccggagacgccggcatgatgcctccgatggaaaatctcctggaccagattctgatgttttccaaggcatctgagaaagacgccgctgagcttaaagcctgcatgcaggagtatgaggccttaaatgacagatacggtgtctctgatgagcacagaaagatcaggagaaggctcacaaaggctttttacccggtctatgaagcagttctgcttcaggtattcaagaaaaaaatcgaaccgcctgttatcataaagatgtttctgatgtttggtcttctagacgagaagatcgtgaccaaggatgagcttcagacgctctacggatttgcgaagtcatacaggccggatccggaagggcatgtgatgtgcgcctgggaatggctcagaaaaatatacaatctagaagttgatccgtcgagaaacgagtttgatctcgattatccaacttatctgcgtgagttaaaaaaccacggagatattgacgatgagcaggagcagaagattttaaagagcccgaggagacgtcttcactttgaactgtccaatatgtttacgatgggaaacagaatgacttttggccggatggcttctttcgagcccgcttttgacgatgtaaatgtgatcggctctatggagaagggatatctttacaccgagaagctcgaaaaagagctgtcttatgtaactgacagagactacagcattttttacaggaatgatatctattcggccccggagtttaacgtgcagcagcttgcaatccaccgtcagtttatgccgaattttattctgatgccaaatatgggatcgagatttgtgctttggcaggagattgagggcaagaggcgtcagtcgagcgccaggatgcttgtacctatcattatgtcggagaatatttccgacaatatcgcaaagctctgcggtgaattcaggtgggagatgtgcaagaccgagcagggcattcactggaatgatatgagagatccgtcgcttacggccgagtacaatgactacctgcagtttttcaagaagaactctgcatttacctctgacatcaaagagaagatcaaatcggagcttaaaaagcacaataacaattttaaaatggtcttcgtggccgactatcacgactatatcctctatgagagcaacggctccatgaggcttttgaagccggcccgcgagattctcgcaaagtactgtccgtttaccggagactcgaaggcactccttgcgacgaaccctacgtatcagcagtacattgagcgttttaacaatcacgagaaaaaggaccaccgtatcgtagagcttactattaagcgcttcgagaaaaatggcacgtcggttccggacgagcttaaagcggaagaagaatatttaagtcattaactcttgactaattgattttacgtgatataataatctttgtgtgaaatcgaccgtccggttgtgttttacatgaaatgaatatcccataactggagggaggtcgagtaagagtggcaaccgttatcgtaaaagagaacgaatcattagacagtgcacttcgcagattcaagcgtaactgtgctaaggcaggtatccagcaggagatccgcaagagagagcattacgagaagccaagcgtcagacgcaagaagaagtctgaagctgccagaaagcgtaagtacaagtaatctaatagattttttattatttcgccacacacggtgaagggattacagaatcaaaggagattctgaccagagggtcagagtctcttttttttcgcgtaataaatgagcggtgctgatacaggaagaaacgcgaggagggcactagtgtccttgaaagcgtttcttcctgtatcaatagcgcgaactcgcgagccgctggagcggagcggaatgcgaattgcaccgctcatttgcagttgcaatagcgcgaacgcgcgaatagcaccgctcactataacccctcatcattttctgacacaaaattaaattatctaattattagacaatttaacataattttaaaggaaaggaaaaaagctatgtcaaatccaaaagaagagaggctcgcgaagccagaaggtctctatgacccggcctttgaacacgacagctgcggtatcggagcagtcgtaagtataaagggcatcaggactcataagactgtttcagatgcgctgaagatcgtcgagaacttagagcacagagccggaaaagatgcatccgggaccaccggagacggcgtcggtatcctacttcagatctcgcacaaatttttcaagaaggcagcttctgctatcggcatcgaactcggagacgagggagattacggtgtgggaatgttcttcctcccgacagaggagcttaagaggaagcgcgtccagaagatgttcgagatcatcgccgagaaggagggcgttccattcctcggctggagggatgtcccggtaaagactgagatcctgggagagctcgccaagtcatctatgccatatatctgccaggcatttttgggaagacctgatgatataaagaagggcctggattttgacagaaagctctatgttgtgcgccgtgtcttcgagcagacctgcgaggagagtgcgtatgtgacttcactctcatcgaggacgattgtctacaagggcatgatgcttgtaaaccagttgcgcacattctacaaagacctgacagatccggattacgaagtcgccattgcaatcgtacactcccgtttctcgaccaacacgaatccgagctgggagcgtgcccatccgtaccgttacatcgttcacaacggcgagatcaataccatcaaaggtaacgccgataagatgctttcccgtgaggagactctctattctccttacctcgaaaacgatatgtcgaagatcatcccggtcgtaaatacgaacggttcggactctgctatgttcgacaatgttctcgaatttttgatgatgaacggaatgccgcttccgctcgctgtgatgatcacgatacctgagccatgggcaaacaacagggcgatggatgagaagagaagagatttctatgagtactacgctacgatgatggagccttgggatggcccggcgtctattattttctcagatggtgacatcatgggagctgtcctcgacagaaacggactgcgtccttcgagatactatgtgacagatgatgactacctgatcctttcatcagaggtcggtgttcttcctgtagatgagagccatattgtgaaaaaagaccgtctgatgccaggcagaatgcttctcgtcgacacaaagcagaagaggcttattgacgacaaggagataaaaaacacctacgcttcgaagtacccgttcggtgagtggctcgaccagaacctcgttcagctcgcagacatcccaatcccgaacaagccggttccgacgcacaacaaggtctcaaggcagaagcttatgaaggctttcggatactcctacgaggatgtaagggaaggcataatgccgatggccgagaacggcgtggagtcgataggctcgatgggtgtagatactcctcttgcggtactttcagacaggcacaggccgctcttcgactatttcaagcagctgtttgcccaggttacgaacccgcctatagattccatccgtgaaaaaatagtcacatcgactactattttcctcggaaccgccggcaatgtccttaaggaatccgcaaagaactgcaacctgctctgcatcaagcatcctatactttcagatgtggaccttctccgtatcaaatatatggacaggcctggattcaaggttgtgacgattcctatcacttattataagaacacttcgctcgagaaggctatcgaccatctctttgtagaggcggacagagcgtacagagacagggcaaatatcctgatcttaagcgacaggggcgtggatgaaaaccatgtggccatcccgtcacttctcgccgtttcagctctccagcagcatctggtacgtacgaagaagaggacaaggctctcgcttgtcttagagagcggcgagccgagaaacgtgcaccattttgcaacgcttctgggctacggtgcttcggccatcaacccatacctcgcacacgagagcatccaccagctcgtagaggacggaactcttaagaaagactactacgctgcctgcaacgcctatgacagcgccatcctctcaggcatcgtaaagatagcttcgaagatgggtatttcgacgatccagtcttatcagggcgcaaagatcttcgaggcagtcggaatcgaccgcgctgtgatcgacagatatttcacaggaacgacttcacctatcggcggaatcactctggacgatatcgcaaaagacgtagagtaccgccacgacaaggcattcgatcctcttgaactcggtgaggatacgactctcgactcgagcggctaccacaagatgcgctctggaaaagaggagcatctctacaatccgacgacgatccacctcctccagaaatcgacctggaccggagactatcagctttttaaagagtacgagaaagaggtcgagagggaggactgcgtaaagaatctccgcggactcctcgatttcaaatatccgaagaagggaatccctctttcggaggtcgagccggcaagctctataatgaagcgttttaagaccggcgccatgagttacggctctatttcacgcgaagcccacgagacacttgcgatcgcaatgaactcgatccacggcaaatcaaataccggtgaaggcggagaggaagaggacaggctttcggtaggtgctgatggacttgaccgctgctcggctataaagcaggtggcaagcggcagattcggtgtgacctctgtttacctgaattccgctcaggagattcagataaaaatggcacagggcgcgaagcctggtgaaggcggaaaccttcctggcaaaaaagtctacccgtggatcgcaaagacaaggctttcaacccctggtgtttcgcttatttcgccgccacctcatcacgatatttactctatcgaggatctggcagagcttatttacgatcttaaaaatgcaaacgacaacgcccgtatctctgtaaagcttgtttcagaagctggtgttggaacagttgcctgcggtgttgcaaaggcaggagctcaggtcattctgatttccggccacgaaggtggtaccggtgcggctccgctctcgtcgattcacaatgccggaatgccttgggagctcggtcttgctgaggcgcatcagactcttataagaaatggcctgagagaaaaagtcatcatcgagacagacggaaaacttatgacaggccgcgatgttgcgatagctgcactgctcggagcagaggagtttggatttgcgacagcacctcttatcacaatgggctgcgtaatgatgcgtgtctgcagcaaggatacctgcccggtaggaatcgctacgcagaacccacttctccgcaagcgttttgcaggtaagcctgagtacgttgtaaacttcatgaagtttatcgcagaggatctgcgtgagtacatggcagcccttggaataaggacagtcgatgagcttgtcggaagaagcgacctgcttacagtaagggaaaatgtgaccgacggaaagcatcctaagtatgccaaagtcgacctcacaaatattatcgagaacccgtttgtaaaggatatgaagccggttcactattacaaaaagaacgaattcgacttcaagctggatcagaccctcgacaagcaggtacttttaaagaagctgcctctcgacattgagccgggcgaaaagaagtcggtcgatgtcgatgtgaaaaataccgacagggcatttggcacgctgtttggaagcaggatcacaaggaaattcaagaacactcttcctgatgacacttacacggttcactgcaagggagccggtggtcagagcttcggagcatttatcccgaagggacttacattggagctcgtcggtgattcgaacgactactttggcaagggcttatctggcggaaaacttatcgtatatccgccgcagggttcaaagatcccggcagatgagaacatcataatcggaaatgtaggattatacggagctacgagcggaaaagcctttattgccggtgtcgcaggcgagagattcctcgtaagaaattccggagccactgcagtagtagagggtgtcggagaccatggctgtgagtacatgacaggtggtacggcagtaatccttggccgcacaggaaagaactttgcagccggaatgagcggcggaattgcctatgttctcgatgaggacgcgactctctacaagaggctcaaccagtcgatggtaagccttgagcaggttactgacaagtacgacgttcaggacttgaaagagctgatcgcagagcatgtggctgtgacaggctccgagaagggcaaggaaatttacaatcatttcgcagaatatctgccgaagttcaagaaagttgtaccgcacgacttcaagaagatgcagcagtcgatcgcctggatggaagagaagggactttcttcggaagccgctcagatggaggcattcagggctgttacaggtcaaagcgaagtggcaatcaagagagacgacgagtatccgccgttcatagcctgatggaaaggagaagtcatgggtaagccaacaggatttttagattataaaagagaagaatcagaggcgctccctccgaaggagagaatcaaggacttccacgagttccacaagccactgacatatgagaaacagtctatccagggcgcgaggtgcatggactgcggcgtgccgttctgccagtacggatgcaatataatgggaatgacctcgggctgtccgctgaataacctgataccggagtggaacgacctcgtctatcacgggaactatgagcaggcatatttcagactgcacaagacctcgaatttccctgaatttacaagccgcgtatgcccggccctctgcgaaaaggcctgcactaacggcgtgtattctgacccggtttccacaaaggaaaatgagagagcgataatcgaatacgcctacgagcatggtatcgcaaaggcccgtccgcctaaggtccgcaccggcaaaaaagtggccgtgatcggaagcggcccttccggacttgcagtcgcagatcagctgaaccagagaggtcacctcgtaacagtctatgagagacacgacaaggtcggaggacttttgagatacggcatcccgaatatgaagctcgagaagggcataatcgacagaaaagtaaaggtaatggaagatgagggaataacctttgtgacaaatgccgacgccggacattctcttaaagcagccgaccttaccaaaaaatacgatgccgtggtattgtgctgcggtgcctcccacccgagagatataaatgctccgggacgcgatgcgaagggcatatactttgccgtggattttctgacttctacgacaaaggcattaaatgccaatgctgttccggaaggcgattacatctctgcaaagggcagggacgtaattgtgatcggaggcggcgacactggaaacgactgcgttggaacctgcatgaggcacggcgcaaagtctgtgacacagcttgagatgatgccggctccaccggttcagcgtactgctttaaacagctggccagagtggcctaaggtcttaaagaccgactatggccaggaagaggccatcgcggtatttggccacgatccgcgtatttaccagaccactgtaaaagagtacaaaaaggacaagaagggaaatcttcactcggttgtcctcgtctcactcgaggcaaagaaggatccgaagaccgggcgcctcaacatgacgccaattgagggcagcgaaaaggaagttccgtgccagcttgttcttattgcagcaggctttctcggctccgaaaaatatgtgacagacgccttcaaagtcgagcttgacaagaggacgaacgttgcaggaaaagacggaagccacgcgacctccgtaaataaagtgtttaccgccggtgatatgcacacaggccagtcgcttgtcgtaaaggcgattgctgaagggcggaagtgcgcaagagaagtcgatgaatttttgatgggatattcaaatctttgatgtttttcaaggcgggccgaatgttgcggcctgcctttttcaattaaagtctttcattttttatgcaaataagttatagtatttgggttgatttcaattttacaattaaggagtcaagtttttatgaaagtctacatcattgactacaagactgttggcgccgaaggagtcagggagatcgagaagggtgtcgagggtgacgcgatattttttgtcaccggcgatacttcaaagctcccggtccagatcaccagcatgcttgaagaaacgaaaccgcagcccgcaaagcctgagacgaaaaatcctgcggctgagccggaaaagccaaaagctgagtctgcaaagtctgaggaaaagaaggcaaaagccgcgcccgcaaagcctgaggccgagccggggaaatctgtggctgaacctaagaagccaaagatcaatcctgaggtcttgaaagaggccagagctgcttttgcaaagcagacaagtcaggagcagcctgttgagaagaaggctgaaccaaagaagaaggcgaagctttcagacgagctcaagaagaaggtgaaggaggcagttaagccggcaggacttaaggccatagagtacgcgagactctacaaggcttttgcggagtcagctgataagaacgagtacaatatcgctctttcaaagggattcaaggcccagaagaaggccaacgatatttacaagctgacgaagtcggtttttgaggagagcaaaggaatttaaaaaacgaagacatttttcgaaaacaattattagaagggactaaaaacaaatgttggaaaaagcatttcatttaaaggaaaatggtacgaatgtcaagaccgagataatggccggcatcactacatttatgacgatggcgtatatcctggctgttaacccgaatatcctctcgagcacgggaatggattcgacggcagttcttatcgcgacctgtcttgcctcctgcttcggtactctgtgcatgtgcttcatggcaaattacccgttcgctcttgcacctggcatgggactcaacgcatttttcgcatacaccgtatgcaagaacatgggatacagctggcaggtagctcttgcagccgtatttatcgaaggaatcgtattcattgtcctttcacttactaatgttcgtgaagctatttttaatgcaattccatccactttaaaacagggcgtttccgctggtatcggacttttcgtagctttcatcggtcttcaggatggaaagcttatcgcagattcaccttctacattcgtaacctatgtagacttcaggaaaaactggcatcaggcaggttcttttgcgctgctggccctgatcggtcttatggtaatctcaatcctctacatcagagggatcacaggagcagttctctatggaatcatcatcacctggattatcggaatgatctttcaggctgttggaatttatgtgccgaatccagaaaaggggttctactcagttttcccgacagctgtatttactgatttctccaaatttggcaacacattcggacagtgcttcaagggctttgccacgatgaatgacaagggcgtgttcaacttcatcacagtctgcttctcatttctgttcgtagatattttcgatacgatcggaactctcgttggatgctcagagaaggctggcttcctcgacaagaacggaaaacttcctcacatcaagggtgctcttctcgcagatgcatgcgctacctctgtcggtgctgttttcggtacttcgacaacaactaccttcgttgagtctgctgcaggtgtcggcgccggcggacgtacaggacttacatcacttactacaggtcttctgttcatcgtcgcaatgttcttctcacctatatttacagcaatccctggatttgctacatcaccagccctcatattcgttggtttcctgatgctctcagccgtattaaagatcgacttcaacgacttcagagaagcaatcccggcttaccttgcgataatcgcaatgccgatgttctacagcatttcagagggtatctcgatcggtatcatttcatatgttatcatcaacaccatctgcaacacattcatgaaggagaagaagagagtcacgatcctgatgtatgtcctggctgtgctctttattctaaaatacatattaattccaagataacagaaaaatcattcaggcgcggtggggagcttattgctcctcatcacgcttatattttgtaaaaatatgaaaataagattggaggaaaaatggaactgagatcacttggaaaggagctttccggaaatgtctatccgggccgtggaatcgtagtcggacgatcagaagatggaaagtcagcagtgactgcctattttattatgggaaggtcatcgaactcgagaaacaggatttttaaagagagcgatgacgagggaataaggacagaggcctttgacccggcaaaacttgaggacccgtctcttattatctatgctccggtaagagtccttggagatgatactatcgtaaccaatggcgaccagaccgatacgatctttgatggcataaagaagggccttacgtttgagcagtctcttcgttcgagagagttcgagcctgatgagccgaactacacgcctcgtatttccgcagatcttcacatcgaaaatggtgactactcttaccagatgtcgatcttaaagagcgatatgatggatccgtcctgcacggacagatacacgttctcctatgacaagccaaaggctggagagggccgcttcattcacacctacatgggcgacggaaacccgcttccttcattcgaaggtgagccgactcctgtcgacattacgggcgacatcgattcatttactgagctcgtctggaagaatttaaatcaggacaacaaggtctcgctttttgtccgctttatcgacatcgcctctggaaaatatcagaccaggattgttaacaaaaataagtaaaatattgtttgaccaatcagcttaatggaaaggaaaaggaaaatgaaagaatttgctttaaagtacggctgcaacccgaatcagaagccatccagaatttacatggaggacggttcagatcttcctgttacagttttaaacggcagaccaggatacatcaatttcctggatgctttaaacggctggcagctcgtttcagagatgaagaaggccaccggtcttccgtcagctgcctcattcaagcatgtttcaccggcaggcgctgcagttggccttcctctctcggatgtcgagagaaagatctactgggtcgacgatatggacatggagttttcaccgctcgcaaatgcctatgccagagccaggggcgctgaccgtatgtcatcgttcggcgacttcatttccctctctgatgtctgcgatgttccaaccgcaaagatcataaagagagaagtctcagacggtgtgatcgctccgggatacgagcctgaagccctcgagatccttaaggccaagaaaaaaggcaactacaatattatacagatagatcctgactatgttcctgctaaggtcgaaaaaaagcaggtcttcggcgtcactttcgagcagggcagaaacgagcttaacataggacctgacttcttcgacaatatcgtaacgaagaataaggaccttcctgaggcagccaggagagaccttgccatctcgatgatcactttaaaatatacccagagtaactcagtctgctatgtaaagaacggtcaggctatcggcatcggcgcaggccagcagtcgcgtatccactgcacaaggcttgcaggaagcaaggctgacaactggtggctccgtcagtgcccgaaggtattaaaccttccattcaaggagagcatccacagagccgacagggacaacgcgatcgacctctacatcggcgatgagtacgaggaccttctcgcagaaggctcatggcagaatgtctttactgagaaaccggacgtcttcactaaagaagagaagagagcatggcttgacaaaaacaccggcgtaacacttggatcagacgcatttttcccgttcggtgacaacatcgagcgtgcccacaagtcaggcgtcaagtacatcgctgagccgggcggctcgatccgcgacgacaacgtaatctcagtctgcgataagtacgatatggtaatgtcgttcactggtattagattattccaccattgatatccctatgaaaatctctatttactgtgttggaaaagtaaaagaaaaatttttccgtgacgcgatagccgaatactcaaagcggctgtcgcgttacgcgaagcttgagatagtcgaggttaaggacgaaaagactcctgagaacgcatctgaggctgaggagtcaaagattaagctgatagagggagagcgtcttctggcaaaaatccccgattctgccttcgtcgttgctttagcgattgggggcgaggagcttacctctgtaaagcttgctgcaaaaatcgcagagcttgccatttctgggaaaagccacattgcttttgtgatcggaggttcccttgggctctcggaagaagtcatgaagcgtgccgactactcactttcattttcaaggctgaccttccctcaccagctgatgagagtgatactcttggagcagatctacaggtcgttccggatcataaaccacgagccctatcacaaatagggacagtagggacggttggagcggttgttatgctgtcgcgagtccgaaggacgaagcgagagcattataaaccgcccatgcaaaaaatggtcacccgggcggcaacatcgcgcacgctcgcgacgaaaaatcctaatgtcgcgagcccgtctctatctgcggcgctgcttcttgatgcaaagccatatgtgccagcgctggattttgccttgtgaaaaagcggcaatggtgacgaaaaagccccgcatgggagggcgatggggttaaggacactgaacttgcctgactgcttccaggctgccggattcactggaataattgccggtgaaatatcaggctgatggaaccacaatataaatgccgcggctgatcagaatgtgatcttcctctgccgctcattcggaatgggtagaccgcttttttctatgcggagagcgcggactaagtcgagagccttcatatcgagtctgttatctgtaaatccatttggaagttcgttcacagagaagaacagtggggcagagcaggacttttttattcccttaagcatcgaaagcccgtcaggggaagcgtctaaaatccaaaggtatggaacaaagtccttttctctaagactaaagatatctttatctcttatcccgagcaggatatgtatcagcgcgcgccttatccttgaagccgtaaggctcttgttcttaagaagcatagtgaactgggtaaagccggtaaactgaggaaggagtcttttgatccggtcagagagctcttcagagacatctgaaaattcactgtaattatcgtgtgacagaagtgccaggtgcagaggcagactcaggtcgtcatcacacaagagaagatttttcccacgggaatcttttagagcctgatatgaaaatgcagtcagatgctttttgacggcgtctaaattcccatcgtaaatcatacgccttatatatgtggcggatacaaattctccgtcgcttagagcatcattgtagctcgttccctgtctttttacaggaataagttcgatatcgaagtggtgccttaaaatagctttctcgtattcgactgcgaggatattattcgggctcgagacgatttctgagattgcatcatcaaatgaaatggcggaggcatcggtgtctttggcaggaacggaagcagagcagatattaaaataagctttcagcgcgtcctctcttgcagatggaaagctcattccgctttttaaatctgcctgtagtacgtccttaaacgcagccggctcttctaagagaacttttgctgtttttttaaaaagagaaatatctccgccctcaaagccgcaggcaattttgtcgcagccgcaggcggcgagcaggcatacgccacactcggcaaagatttcggcgctcgcgcaggaggcagcgacaggcattccgatgaccaggtccgcacctgaagaggaggcggccggcattccaacgaccagatcagcgccggcatctacggcggccttggcacgagagtatctgtcgattattgcgatgccgcctctctgagtaaattcatttccgagggcgataattacagaatcagctccgagaacattctttgcataatcgattatatatttgtgcccggtgtgaaacgggttaaattctgcgacgataccaatgcgtgacataagactcctatttcattgttgaagtatttttcctgtagttgtataataatatagctgtgaaaaattgtccacagaagttataaaattataaatccgaatcaaggagaaggaagcaaaatgaaggttttagtcatcaactgcggaagctcatcgttaaagtaccaggtcatcgattctgatactgagaaggtcctcgccaagggactctgtgagagaatcggaattgacggaagactcgtttaccagccggcaggctcagacaagatcaagacagatgtcgcaatgcctacacacaaggaggctgtaaagcttgtacttgacgcacttgtaaatcctgagaacggtgttttaaagagccttagtgagatcggagcagtaggccaccgtatcgtacacggcggtgagaagtttaccaggtcggcagtcatcaccgatgagatgttaaagaaggttgaggagtgcaacgagctcgcacctcttcacaacccggcaaacatcatcggaatcaatgcctgcagagagctgatgccgggagttcctatggttggagttttcgatacagctttccatcagacaatgcctgctaaggcatatatgtacgcagtaccttatgaggactatgagaagtacggtgtcagaagatacggtttccacggcacatcacacagcttcgtaagcaagcgtgcagcagaggtttcaggagttgatcttcacaactcaaagatcatcgttgcccaccttggaaacggcgcatctatctcagctgttttaaatggtgagtcagttgatacttcaatgggcctttcaccactcgagggccttgtaatgggaacacgttcaggagatatcgatccgaccgctgttcagtacattgcgaagaaggagaacctcgattttgacggagttatgaaccttctgaacaaaaagtcaggtgttcttggaatctcaggagtttcatcagacttcagagatcttcttgcagcagaagaggagggcaacaagagagcaaagctcgcagttgatatgttctgctacagagttgcaaagtacatcggagcttacacggcagctatgaacggcgttgatcttatcgctttcacagcaggcgtaggcgagaacaacggctttgtcagagagcagatctgcgagtatcttggattccttggagtaaagatcgacgccgaggccaataaggtagccggcgaagagaagaagatctcagcagacgactcgaaggtattagtttatgtcatccctacaaatgaggagcttgccattgcccgtgagacagtagctcttgtaaagtaatcgattatgatacttgatcttacaaaactcctgtccgctggtaacggacaggaaaaatatacatcgacctttgatatgtcagaagtggctcactacggtgagtcattttctgtaaaagaggcttggccatttgagatcactgtgacaaatgaatcgggaaagagccttacggtatctggaaacaccagagtaacactttctattccgtgtgacaggtgcttaaaagaggtggcggttacttttccaattgagataaacgagacgtttactattgaagatgaacagatcgcgaccgaccgcgacgagaacgaagacttagccgacaagaagagcattgatgtcgacaggatggtctacgaccagatcgagatgaactggccggataaagtcctctgcaagcctgactgcaagggcctctgcccggtctgtggtcatgacttgaacgagggcgactgcggccacgacaagcaggcacttgacccacgaatggcgcagatattagatattttcaaagagaaagatcagtgaagacgaagcagttgaaaaagtgattgacaaatgtccggcgaagttttataataccatttgttgtgggtaaaatctgcccgcacacaattaattcgaataattcaaggaggtgtgtaacgtatgtctatctgcccaaagaacaagtcttctaaaggaagaagagataagagaagagcgaactggaaaatgagcgctcctacacttgtcccatgccctaagtgtggtcagcttatgatgccacacagagtctgcaagaactgcggtacttacaacaagcgcgagatcgttgctgttgactgattactacagtgttgctatttggttgtgataaattcaggagttgctgggaccttatgtcccgtcgggatgtacaatggaatgtttttatcatatatgcttaataattgaggtgtaagatgagaaaatcagttcagcctgagtattatcaggcaacagttacctgcaactgcggaaatacattcgttacaggttctacaaagaagtcaattcacgtcgaagtctgctcaaagtgccatcctttctatactggccagcagaaggctaacaaggctcgtggccgtatcgagcagttcaacaagaagtacggatttgacaacaagtaataaagtatttgaggccggggtttttaccccggttttttagtaaagggattttatggcatacagcggtataggcggacaggcagttatggagggagtcgagatgttaaacggcacgaaaggcgccgtagcagtaagactcaccgacggaagcatacatacggataccatggacataaacccggttccagactgggtgaagcacactcctgttgtaagaggcgtctactcattttttcactctctggtggtgggcatatcgtcgctttacaaatcaacatcctactttgaggatgaagacgaaaagcagaaggcagaggaaaatcctgcgaaggaaaaggcggagatgggagtctcacttgttatctcatttgtcctggccctcgcgatctttctgtatcttccgatgtttttgtcgggatttgtaaatcattttacgaaggctgcctgggtaagtgtgctgtttgagggaatacttagaatcgttatatttttgctgtacatctattttatcgggcttactccggatataaagcgaacctttatgtaccacggcgccgagcacaagtgcatcaactgcgtcgagcacgacctgccgctgactgttgaaaatgtgcgctcttcgagccggtttcacaagagatgcgggacgagttttatatttatcgtgtttctgataagcgtgtttttattcatgtttatccgcaccgacaacatggccttaaaaatccttttcaggctgcttctgatgcctgtgatcgccggcatttcgtttgaatttctgcgactcggcggccgcagggaaaaccggcttgtaaatgccctcgcaaagcccgggctctgggtgcagcgccttacgacaaaggagccggacgattcgatgatagaggtcgggatcgcttcagtgcgcgcggtatttgatccggataaatttatacaagaccacgaacttcaacagtaagatatgacatacgtcctgactttaaaaaactgcatagaaaaattaagacaggcaggcatagatgatcccgaatcggatgcaaggatcattttaactgaagcatcggggatggactatgcccatctgatggcagagatgcgaagtgaagtttctgaagatacttcacgcaaaataaaaaaatttatggaaaagcgcctgaaacgtattccgcttcagcagataacgggttacacagagttcatgggacttaagttttcggtcgatgaaaatgtgctctgcccgaggcaggatacggaagttttagtggagcaggtgcttgatgccgccgataaaaacagccgtgtactcgatatgtgtaccgggagcggctgcattgcggtaagcatagcgaagcttaaaaaagctgatacaacagcctgcgacatttcagagaaagccatagccattgctgaaaaaaatgcaagggacaatggcgtttctgttcattttttcaagggtgatctgttcgaggcactgccagaccatgaaaaatatgatatagtagtatcgaatccgccttatatcaagtctgatgtgatagggacgcttgagccagaggtaaaggaccatgagccgcggattgctctcgatggagcagaagacgggctttttttctacaggcggataataatggatgcgccggattatttgagaaaaaacggtctgatattttttgagacaggatatgaccaggcggagcaggtgaaaaaactgctccttgacagaggattttcagatattaagattacaaaagattacggaggaaatgatcgtgttgtagcaggtgttttcaaatgagttaacagaacatagaccagaactttttacaggagatttacagatatgtttgaaaaccttgaaaatttacgcatgcgctatgacgagatcatgcatcttgtaagccagccggagatcgccggcgacggggctgcgtttcagaaacttatgaaagaggccaatgggattaagccactggtcgacacctacgctgcgttcaaagaggctgtgtcagaaaaggaagatgctcttgcaatcttaaacgaagagaaggatgaagaactcagggaactggctaaggaagagcagtctgaggcagagaagaagattgaaaagctaagacatgagcttatgatcctcctccttccgaaggacccgaatgacgacagaaatgtcatcatggagatcagagccggggtaggcggagatgaggcggcactttttgcggctgatctgtatcggatgtacacccactttgcggagtcgaagggctggcacacggagatcatcgagtgcgaggagaccggaatcggcggaatgaagcaggtcaacttctctgttagcggacagggtgcctattcaattttaaaatatgagtccggagtccacagagtacagcgtgtcccggttacagagtcgggcggcaggatccacacttcgacagcgactgtcgctgttatgcctgaggccgaggaagtggacgttgagataaatgagaaagacatcaggatcgatgtcatgagggcgtccggcaatggcggacagtgtgtaaacacgacagattcggccgtaagacttacccactacccgactgggatcgttatctactcacagacagagaagtcacagcttcagaacaaaaacaaggcatttgaactcctgcgtaccaaactctatgacctgaaactgcaggagcagcaggccagggcaaaggatgagagactttcgcagatcggcacaggcgaccgctctgaaaagatcaggacttacaactttccgcagggaagagttacggaccacagaatcgggcttacgatctacaggctggatgacgttatgaacggggacttaaacgagatcctcgaggcacttatcgcagctgatcaggcgaagaagctggaaaaactgaacgaggcgggctgatatgttaaaaaataaaaccataattttaggagttacaggttccattgcagcgtacaaggcggctgagatcacaagctgggcaaaaaagcagcatgccgatgtgaatgtgatcatgacaaagaatgcccagtatttcatcaatccgatcacctttgagacgctctctgggaacaagtgccttacggacacttttgacagaaattttcagtacaatgtggagcatgtagagcttgcaaagagggcggacctctttgttgtagctccggcatcggccgattttatcgcaaaggcagcaaatggcattgccgacgatatgcttacaacgacgttccttgcgtcgacctgcgagaaacttatatttcctgcgatgaatacaagaatgtacgaaaatcctattactcaggataacatcgcaaaattaaaaagattcgggattaaggtcatcgagccgggtgccggttatctggcctgcggtgacacaggaaagggtaagcttcttctaatcgaagatatagaggagcacatcctgcttcatgcggcatacgaccatgacctcagcggaaagaagattttagtaagcgccggacctacctgtgaggatatagatccggtcagatttatcacgaatcactccacagggcggatgggatacgccgttgccagaaacgctgcaaggcgcggtgccgatgtcactttagtaagcggtccggtgtcacttaaagagcctgtcggcgtcaatacagttcatgttacgagcgcacaggagatgtttgatgagatcacagctgtaagcgatgaacaggatattatcgtgatgacagcggctgtcgcagacatgaagcctgtaaacaaggctgctgaaaagatccacaaggttacgatgccggatgcgatcaagcttacgactaatccggatattttatcgtatctcggtgccaacaggagagagggtcagaagatcataggattttctatggagactgaaaacctcgtcgagaactcgagactcaagcttagaaagaagcactgtgacatgatcgtggcgaactgccttaaagtcgctggggccggttttggaacggaaacaaacgtagtgacacttatctcggccgacaggatgcaggagcttccgataatgtctaaggatgaagtggcagaaaaaatctttgattttattcaaaaagattgttaaaatctttttactttgctataatagggaaacgtgggcagagtttgaacaataaggagaagaaatgagcgtagcaattttaacagatactaacagcggaatttcaccagacgaagccagaaaaagaggcatcttttcgataccgacgcctttttatatcaatgacaagctctactatgagagtgtagatttagatcacgagaagttctatgagcttcaggcttctggagcagagatccacacttcgatgcctcttgtcggagacgttttagacgagtggaacaagcttctaaaggactatgacgaggttgtttacattccactttcaagcgggctctcatcatcctgcgagacagctcagatgctctctgaggacgacgattacgacggaaaggtctttgtcgtaaataaccgcagaatctctgttacgatgaagctttcagtcatggaggcaaaggccctcgctgatcagggaaagagcggaggagagatcaaggaatacctcgaaaagacagccggggattcctcgatttatatcacagtagatacgcttaaatacctgaagaagggtggacgtgttacgcctgctgcagcagccatcggctcactccttcatattaagcctatacttactatacagggagacaagcttgacaaattcgcgatggcccgcactatgaagcaggcgaagcagatcatgctcgatgcgataaagaaggacaccgaggagagattcaaggatcctgacggcagcggctgcgtgatgtctatcgcgcacaccaacaaccgtgcggcagcagagcagtttaaggatgaacttttagctatctacccggacagacaggtcatcattgatgaactttctatggttatcgcctgccacatcggtccaggatcgctggcagtcacgacatcacagagttttttaaaggagatataatatggttaaggcagttgtaggagctaactggggtgacgaaggtaagggaaagatcaccgataccctcgcaaatgatgctgacatcgttatccgttttcagggtggcgcaaatgcaggacacaccatcgtaaacgagtacggaaagttcgcacttcaccttctcccgtcgggagtttttcaccagaatatcacgaatgtaattggtaacggagtggcattcgatatcgacaagttcttgaaagagctcggagacatcgagtcgaagggagttccggcgccaaatatcatcgtaagcgacagagtccaggtcctgatgccttatcacattcagttcgatacgcttgaggaggccagacttgcaggcaagtcattcggctctacaaagtcgggcatcgcaccattttattcagacaaatatgctaagatcggctggcagataaacgagttttaccaggacgacgacgcgctgatggaaaagatcgaccacatcgcagacattaaagacgctcttctcgtaaatctctatcacacagatcctatcgacagaaagggacttctcgagtggatcaaggagagaagagataagatccgtccgtatcttgcagatgtaccgaagttccttggagaggccttaaaagaaggaaagacagctcttctcgagggacagctcggaactatgaaggacccggatttcggaatctatccaatggtcacttcatcttcacctatcgctggattcggagccatcggagctggaatccctccatacgagatcaagcagattgtagtagtttcgaaggcatactcttcagcagtcggagcaggagagttcgtatctgagatttttggaaaagaagcagatacgcttagaaatcacggcggagacggcggcgagtacggcgctacgaccggcagaccaagaagagtcggctggtacgactgcgtagccagcagatacggctgcagactccagggcgcaactgacgttgcatttactgtattagatgacctcggatatcttgacgagatccctgtatgcgtagcatatgagctcgatggcagacagatcacggatttccctgtcacaaaggatttgaagagatgcaagcctgtttacaagactctcccgggctggaagtgcgatatcagaggaatcagggagtttgaggacctgccgaaggaagctcaggattatgtcaacttcatcgagcagcagatcggatatcctatcacgatggtaagcaacggaccgtcgagagacgacatcatctacagagtaagtccgctcaataaatgatgttcaaaatataaacacaaaaaaaactataaaagggcacagctttcacgtaatatagaggctgtgtctttattgttgttataaggagatttatgcttaaagtagaacatttgactaaaaagtacggaaagcacactgtcgtaaatgacttgagcttcaccgcggacaagggagagatagtcggactgttagggccgaacggcgccggaaagtccactactatgaacatgctgaccggatatctggctccggacgaaggctccatcgagcttgacgggaaagatcttacgaaccctaagaaccgcaaaaaagtcctgatcggctatatgccggaggtgccgcctctctacaacgatatgactgtaaaggagtacctcatatttgcctctgagcttaaaggcgtaaaacacgctgatcgaaaggataaggtcgataaagtgatggaagagaccgctgtaggcgatgtgaaggaccgtctaataaagaatctgtcaaaaggatacaggcagagagtcggttttgcctgtgctgttctgggagatcctgaggtcattatcctagatgagcctaccgcaggacttgatccgagacagatcgtcgcgatgagggatctgatcctctctcttaaaaaagaccaccttgttatcataagctcacacatcctctccgagatcgaagaggtctgcgaccatgtgcttatcatttccaagggtaagctcgtcctctccgacaacaccgagcatctgctcgaggagcatgatgagtcacttgaggatgtattcctggaattgacttctgacgaggaagacaaaaaggaatcaaagccagtatcttcgagatttgaagatcaggaagatactgatgacagtaccagtgatgaagatgaagatacagaagagaccgatgcagaggaaaccaattcagaagatgaggaggatagaaaatgaaagcaatatttaaaagagaattcctctcatttttcagaggcataaccggatggctgttccttggactaaacctcgtagtttacggcctctactttacagtctataacctgatgcagggaatcccgagcatcgcctatgcgataaacgggatgtcgtttatttttcttataacagtaccgatccttacgatgagggtgttcgctgccgaaaggcgcgacaagacagatcagcttactatgacttctcctgtcggcgtgggcggcatcgtgcttggcaaattcctggcacttgcctgctgctttgctatagttgtggcatttatcgcggcctcaccttttattttaagaatatacgggaccgtatcactgaaggagagctttacatcggtcttagggcttctgctctacggactgacccttcttgcagtcggactcttcgcctcggcactgacaccgaatgtgattgtaagcgcagttgtttcattcggcctgatctttctcggatatatttcaagctcacttgtaagcgcactctcgcttagcggagtacctgcaaagatcctcggctggtacgactttaccacgccgctttcggattttttgtcgggaagcctctcccttaaaaatatagtctattttctgacggtcattgtgctctgcctggtccttgccacgcagatcatcttaaaacgccgctacacgatctcgaagaagagacttacggtctcggcattttcactcgtgacgataatagcagtaattgcagccgcaatcgtcggaaattttgcaatgacgaaggtgcctgacaagtacgctgtccacgatatgacaaaaaggaagtactacacactttcggataagactaagaatatactctcgaagctcgacaaggatgtcacgatctactgccttgcgaagaagtcctcgcttacatacgactatgaagtgactcttaagaagacgctcgacaactatgcggctgactcggattatgtcactgtaaaatatgtcgatactacgaagaaccctacatttgcttcaaagtacacggacagcgagctctcctccggaagccttatcgtagtcagcggaaacaggagcaggacgatcgatacctcagatctctatgagactcaggtagactcttcgacctactcgcagcaggtgacaggctacgatatcgagggccaggtcacaagcgcgatcaattatctgaatgccagaaatctcgagaagatctatctgctgagcggtcacgatgagatgtcactttcgtccacatttacaaagacacttacgaagctcaatgcacagacagccactcttaattttcttaaagccgattctgttccagaggatgcggcagctgtgatcattttcggggcgcagtctgacctctcgaaaaacgatgtcgaaaagcttgataactatgtcagcggcggcggaaaagtatttgtggcgctcgatgtcataaagaacagcgggcttaaaaatctgaacagatttttaactgataacggaattaaagctacatccggaatcgtagcagagacgaatgaaaactactacacccagaaccagtactatctccttccaaaggtaaacagcactaaggcaagcgccgacgtctcaggaacacttcaggtgttcatgccgttttctgtaggacttacgaagacaaatgcatccggtataaattacctgaaccttgctgtgacaagcgataaagcgatagcgaagaattcactttcagattcaaatgcgctgcagaaggctgtatcagatacaggtactgtaaagaaggaagatggagatgcacagggacagttctcactcggacttatttcgataaataagaaaaaaggcgaagtggttgccttcggatctgcctatacattctcagacgaggagaaccagatggtatcaggaaagaacgcaacgctcttctcagatgtattctcctacctgctgcctgacgattcaaagaattccgtaagcatccctgtcaagtctatagactcgacgactcttacgatcaatgcctctggtataaagatcttcggatttctgaccggactgatcctgccgcttgcgcttatcgtctgtggaattgtagtatgtattgtcaggagaaaaagataatgaaaacaacagccatagtcctcgctgccggaaagggcagcaggatgaagagcaatacaccaaagcagtttatcggagtgaagggaaagccgataattgcctacagcctcgagacattcgaaaagagcagcgtagatcagatagtccttgtgacttcggaagataatattgaccgctgcaattctatcgtaaaaaattttaatatagaaaaatgcagcgatatagttgccggtggaagcgagagggcactgtcagtctgcaacggactgaaaaaagccacaggagactatgtgctgatacacgacggcgcgaggccgcttgtttcctcccggatcataaaagatactattgaggcattaaaagatcatccggccgttgtcgcagttgtcccggtaaaggatacgataagacagattggagaaaacggagagcttaaggatgcgatcgagagatcgagtctctttggaatgcagacgccgcaggctttttggcgtgaaaagataatcgaagcttacgataagctttttaaagaaaacgctgatttttcaaagataactgacgatgtgatggtactcgagaaggcattcggtatccacgcatttccggtggatggagaggaaatgaacagaaaaataaccacgccagaggacctggcgtggcttaaatcgatagtttagtctttcttcctgttcgcgtcgttgaattctctgttatccggcttcgcaatccgcatgaagatgccgatgacccagagcatgaccgggataacgacagtggctgcgatgcaggccttaaacatcgtcatcgtatgagggttgtcgatgatcgcgaagacaagagtcaggacatacataaacacgagcagacagaccgcgactattccaaaaatccgtttaaatttcttcatttcaaggctccttttccaatcatgatattggaaaatacgagtcttgtcaatagacgacttttgtgataaagtaaacaggtcgctgaaaaaggaggaaaaaaagatatggcaattttagacgaatggaaggctgtggcctatgacaataaacaggacagatatcacctcgagaaattctggaacaactatttcgagaaagagaagggcgtttatgctatccttctgaagaatccggataaggtctacaagggaacagtccacgatctcgcagagcagttcggcctgacagacctcgagatggctggatttctcgatggaatccaggagagcctcaaggagccgaatcctatagagactatggaggctgatacagaggtttcgctctgctacgaccttgagaaactctacagaaatatggtagatgcgagggcagagtggctctatacacttccggagtgggacaacatctattcgaaggacaagcagcacgatattctgatctcacagagaaagtctcacactgtacacgttaagaagatcggccgcaatgatccatgtccatgcggttccggaaaaaagtacaaattctgccacggaagaaagggcgcagagccacttcctggatatgagcagtaagaaaagggggttaatccccctttttatattgtctgtaattatcactctttcggcctgcagtgcagataagcctgctattgacaagatgtctgcgaaccggacagcttcggaaaaaaacaccacgaataaagctgatgaagatgtcggacagaagaaagatccggccaccgaaaaaaagaagacggatgcgaagaacaaaatcctgaaaaaagcatctgacggcttttttgcaggggagagtgaaaaagacagggcaggctttctcgactggtttgaaaagacatatggggacaaaacgcttgagacaatagcagataacggtgtctttgacgacagcacagtctggcagaattcgacaggaaggacaataaagacccttttctgggactatcacgcggcggctgaggatccattttacaaagcaaacctgaggagagagataaagaccagtaaatccggagaggctgaatttttattcagcggagacttaacccttgccgagcacacggcgaccactgtccttatggacaaaaatcccaacttactgtcgcagtgctttgaccagagccttatggatacgatgcggtcggcggacttttttactgtaaacaatgagttctgctatggaacgaaaaacatcggaaagcccatttccggcaagactttcaccttcagagcggacccaaagagggcgaaacttttaaaccgtatcggggtcgaccttgtctcactcgcgaacaatcacgtctatgactatgggaaggacgcatttttatatacgctttctactttaaaaaaggacaaagttccctacgtcggtgccggcaaaaatctcactgaggcaaagagggcgtactatgtgacagcagatggaaggaccgtagcaatacttgcgggaacgcagatcgaaagatctgcaaactacacaaaggcagtggccgcggattcgcccggagtacttaaatgcttaaatcccactgaatatgtcagggcgatacgcaccgcaaaaaagtacgctgacacggtctttgtgatctgtcactggggaaccgaagggacacaccagtacggtgacgaccagacaaaactcgcaaaaaaattcatcaaagagggagcggatgcagtaataggcggtcacacccacacgcttcaggcagtcgagtatgtggacagtgctccggtgttttacagtctcggtaattttttcttttcgacgacgatgaaacagccgaagggatacgacaccggacttgcgaagattacagtgaagagaaacgggaagatttctgctgaatttatcccctgccgcttttcaggtggaaagacttctaagcttaagagcggctcagctaagtaccgcagggtaatctctgatatgaacagctggtcccagacagcagtcattcaaaaaaacgggatgataaaacgaaaatgatgtgttataatcatagcgtttgttgaatagaatatttttttatggaggcatttactcatggcaaagaaaccatacgtacttcttataatggatggcttcggattaaacgacaatccgaaggcaaatgcagttgcacaggcaaatacacctgtactcgacggacttgttaaagagtatccgttcgtcaagggttctgcttcaggtctcgctgtcggacttcctgacggacagatgggaaattctgaggtaggtcatatgaatatgggcgccggacgcatcgtatatcaggagcttacccgtatcaccaagtctatcgaggatggtgattttttcaagaatgaggagctcgtcggagcatttgagaatgccagaaagaacggtaagagcgttcatctctggggacttctctctgacggcggagttcactcacacaacactcacctctatgcactgcttgagatggcaaagagacagggcgttgagaacgtctatgtacactgcttcctcgatggccgtgacacttctcctacagcaggaaaagaatacatcgccgagctcgaagagaagatgaaggagatcggtgttggaaagatcgcatctataagcggccgttactatgctatggaccgtgacaacagatgggacagaatcgagaaggcttacagagctttaactcttggcgagggcaatgaggcagacagcgccgcagaggctattgagaattcctatgcagctggaaagacagatgagttcgttatcccttgcgtaataaaggagaatggaaagcctgtagctacagtacaggatggagacagcgtaatcttctttaacttccgtcctgacagagcccgtgagatgacacgtgttttctgtgccgatgatttcgactgttttgacagaggagacaggatcaagactgactatgtctgcttcgtccagtacgatgacacaatcccgaacacaaagatcgctttcaagaagcagatcttaaagaacacctttggcgagtacctcgcagctcacaacatgactcaggcccgtatcgccgagacagagaagtatgcccacgttacattcttcttcaatggcggaatcgaggagccgaacaagggcgaggacagagtccttgtaaagagcccgaaggtcgctacatacgatctgcagcctgagatgagcgcacctgaggtctgcgacaagctctgtactgctataagaagcggcaattacgatgttattattattaattttgcaaaccctgatatggtcggccacacaggcgtccttcctgcagctataaaggctgttgagactgtagatacctgcgttggaaaggcagtagacgccgttaaggagatgggcggagttatgttcatctgcgccgatcacggaaactgcgagcaggagataaattacgagacaggtgagccgcttacaagccacacgacgaacccggttccgtttatccttgtaaacgcagacccttcatacggactccgcgagggaggaaggctctgcgacatcgttcctacacttattgaactgatgggaatggagcagccggctgaaatgaccggtaagtcactccttataaaaaaataaaccaacactttaaagaaaggaaaaagaatgaaagagtacaagcctgttaaagaaggaaaagtaagagaggtttacgatgatggagattccatcatcatggtagctaccgaccgtatcagtgccttcgatgtaatccttaagaacaaggttacagataagggacgtgtcctcacgcagatgtctaagttctggttcgactatacaaaggacatcattcctaaccacatgatctcatgcgatgtaaaggatatgcctgaatttttccagaatgatgagttcgccggacgcagcatgaaggtaaagaagctcgacatgcttcctatcgagtgcatcgtcagaggctacatcaccggaagtggctgggagtcatatcagaagaacggtacagtctgcggaatcaagcttccttcaggacttgtagagtctgataagcttcctgagcctatatatactccgaccacaaaggctgatctcggtgatcacgatgagcacatcaccttcgaggagtcagttgatataatcgaaaagcttcatcctggaaagggccgcgagtacgctgagattattcgtgatgacacaattgccctctacaagaagtgcgctgattatgctctgacaaaaggaatcatcattgctgatacgaagttcgagttcggtctcgatgagaacggaaacgttgttcttggcgatgagatgcttacaccggattcttcaagattctggccggcagagggctataagccgggacagggacagccttccttcgacaagcagtttgtacgtgactggctaaaggctaatcctgacagcaattatgacctgcctcaggatgtaatcgacaagacaatagcgaaatacaaagaagcctacaagcttcttacaggtaaggatctttcatggtaggtttaagccggattctatcgacttctgcttatttttgatgaaaggtttatatggaaaagtattttgaaaaaaatgcatcggacagtcttcacgaggagtgtggtgtcttcggcatctacgacctcgatggagaggatgtcgccggcacaatctactacgggctttttgcactgcagcacaggggccaggagagtgctggaatagctgtttccgacactaatggaccgaagaacaatgtaagcgtcatcaaggatatggggcttgtaaacgaggttttctcaaaggataatctctctactcttcatggagacataggtgtaggtcatgtcagatactcgaccgcaggagagtccaccagagaaaatgcccagccgatggtcattaactatgtaaagggcactcttggactcgcccacaatggcaatctggtaaatgcaaatgaactgaggcagtacttatcagagactggagctatctttcagtctacgatagatacagagcctatagcatatctcattgcaagagagaggcttcattctgcgacagttgagcaggctgtaaacaacgcctgtgataagctgcagggagcattttctctcgtggttatgagcccgagaaagcttatcgctgcccgtgaccctcatggctttaagccacttgtgattggtaagcgcggcaggagctatatcttcacctcagagacagcagctcttgatacgattggagctgagttcgtccgtgatgtccgccctggagagacagtctgggttacaccggacggagaactccacagcgatatgtcccgcgccattcctgaggaaaagcaggcgagatgcattttcgagtatatctacttcgcaagacttgacagctatatagatggcaggtctgtatatgatgcgaggattaaggccggacgtttcctggctcaggattcgccggttgatgctgatctcgtagttggtgttccagaatccggaaatgccgcagctatgggctatgcacttgagtccggtattccttacggcacagcttttgtaaaaaacagctatgtcggaaggaccttcataaagcctgggcagaagagcagggagtcctcagtccgtgtaaagcttaatgtcttaagagaagccgtaaagggaaagagagtcatcatgatcgatgattcaatcgttcgtggtacaacttcagacaggattgtcggaatgcttaaggaggctggcgcttctgaggtgcatgtacgtatctcttcaccgcctttcctttggccgtgctatttcggaactgatatccctgtaagggagcagcttatcgcatataatcactctatcgatgagattagaaaaataatcggagctgatactcttgcgtacctgtcgattgacagactccgcgagatggtggatggcctttctatctgtgacggctgctttaccggcaaatacccggtcaagcctcctgaagaggatatccgcggcagttatgagaagtaaaattttttccgttttttaataggagttattatgggaacagatgcatatattagtcctttaagcgagagatacgcgagcaaggagatgcagtatattttttcagaggataagaaattctccacctggagaaagctctgggtcgctctcgctgagactgagatggagcttggcctctctgagaatggcaagccggtaatcactcaggacatgatcgacgagatgaaggaacacatctacgatatcaactacgatgtcgcaagagcccgtgaaaaggtagtccgccacgatgtcatgagccatgtctatgctttcggaaagcagtgcccgaaggcagcaggcattatccacctcggcgctacaagctgctatgtaggtgataacactgatgtcatcattatgcgtgagggccttcagctcgtcagaaaaaaggtcttaaacgtaataaacgagctcgcaaagtttgctgataagtacaaggatctgccgactcttgcgttcactcatttccagccggctcagccaaccactgttggcaagcgtgcgactctctggtgcaacgagttcatgcaggaccttgaggatatcgactacgtgatctctacgatgaagctcttgggatcaaagggtactactggtactcaggccagcttcctcgagctcttcaacggcgatgatgaaacaatcgataaaatcgatccgatgatcgcgaagaagatgggctttaaggagtgcgttcctgtctctggtcagacctattcgagaaagctcgatacaagagttttaaatgtccttgcgggtgttgcagcctcagctcataaaatgagtaacgacatcagactcttacagcacttaaaggaagtcgaggagccattcgagaagaatcagatcggttcatcagcaatggcatacaagagaaatcctatgagaagcgagagaatcgcatctctgtccagatatatcatgatcgatgccttaaatcctgcaattacttcagcaacgcagtggttcgagagaacgcttgatgattcagcaaataagcgtctttcagtagcagaaggattcctcgcaacagacggagtgcttgatctgtgccttaatgtcgtagatggtcttgtggtttatccgaaggttatcgagaagcacctgatggctgagcttcctttcatggctaccgagaacatcatgatggacggtgttaaggaggggggcaacagacaggagcttcacgagcgtatcagagagctctctatggaggctggtaagaacgtcaaggagaacggtggagacaacaaccttctcgagcttatcgccgctgacgatgccttcccactcgatctcgagaccttaaagaagtcgatggatccaaagaagtatgtgggccgcgcacctcgccaggtaaccaagtacctcgaaaatgtcgtaaatccggttcttgagaagaataaggacgagcttggtgtgaaggctgagataaacgtataattttggatttcgtagaaagctgccaaagtaaacggcgaacgattgttgcgtttttcgtcgtgagtgagcgcgctagctgcggcccgggtgacaaccgttcaaacagaattgcttaaaaaattgcgtcagcaattttttaagcaattctgtgcgttttgtcagagggccgctaataagcgcgcgcgatcgaacagaaaaacgtgacctagtgagccgttgctttggcagcttttttacagatagcaatgaatttatttcaatacatacttgacataaattcatctagtgatatactaacaatgtcaacaaaataaaaggtacacagtcctaataaattcgtagatgggaacaagtcatgtagacatacacctcacagagaagtgccggttggtgcgaggcacaggatgcgtctataatgatatcctcccagagaagcagtgctgaaccgttcgtaagtaagcgctgacggaatcctccgttaaagggaagcgcatgttggtgcgtgaagtgtcgtttgcgattcgcaggcggaatcagggtggtaacgcggaaatagatatttttcgtccctctcaggcagcataaatgccgggcagggacttttcttttgcccctaccgctgtgaaccgaacgaacttcaaggaggtactattatgaagaagcttcagaaactggcaaagcttatgtcaaaccacacggcacttgtcgttatagcatttgcggtggtaacgtttatttttcctgcgtggatggcatgggttaatcacgcgtggtttacggattttgccaccaaccgttttacatctcagactcttataatcggcgtaatcatgatgagcatgggaatgtcgatgactaccaatgatttcaaaatcctcgctcagagaccgctcgacatcttcataggtgcagctgctcagtactgcgttatgccgttcctggctttcgcacttgtacatctgctccgtctgccatctgacctggcacttggccttatcctcgtaggctgctgcccgggcggtgtttcatcaaatgttatgtcttatctctgccacggcgatgtagccttctcagttggtatgactaccgcatcgacaatacttgcacctgttatgactccgcttctcgtttcacttttggcaagcggcgctacagtacatatcaaggctttcccgatgttcgtttccatcatagagacagtaatccttccggtagccgttggttttgctctgaatgctttcttaggaaaaaataaacgcttccaggaattccagaaactgatgccggctgtagctgttcttggtcttgcctttgtcgtaggcggtgttgttaattcacagggcgcaagcttctttacctcaggccttgtaatcttccttgcagtattccttcacaacggacttggatatctgcttggttacgtagtcggtatttttacaggaatgaacaaggcaaagagaagaactatctctatagaggtcggtatgcagaacgccggtatggctacaaacctcgctacgactacagctcagttcgctgctatgccaaatgccgctataatcgccgctgtttcatgtgtatggcactctatctcaggtacaatcctcgcaggcttctttgcatggcttgacaaaaaagctgaggagccgcataatgaaaaagcagcagcagtttcaaaaaatgcagcatcagccgattgatttaagattttttcaggcggctgcttaaagattgttcattaattgaaaggagccgcttatggttaccatctatggtcttaagacctgcccatactgtgactttgtaaaggcacagattgagggcagagaggacgaattcaaatacatcgatatcggaactcatgtgaagtatatgcatcagttcatgaatctgcgtgacaacagacctgagttcgaccacagcaaggagattggagatatcggaattcctgcctttgttcttgaggatggaagcattaccttagatcctgcaaaggtcggcctaaaggagtacgacccgtcgatgccttcctgctcgattgaggatcacaggaacggtaaaaagggctgctgaaaatactagataatagagcctcttccggttcgaaagaaccaggggaggctttttggcatttgacaggaggtaataatatgtttagaaaaatgagaaggttcaagcagcagcttgaggatagcgacgcgcttgaggtcttaaagaatggacatagaggaaccctttcgctgattggagatgacgggtatccgtatggggtgcctatcaactattttctgggcgaggatggtcacatctatatgcactgtgccgcagccggacacaagatcgatgccttgaaaaaatgcgacaaggtctcatttacagtgcttgaggaccagccaaaggaagagggcgattttgcgctgtatgtaaagagtgtcatcgtatttggaagaatttctatggttgaggacagggagaaagtgctaaagagcgctatgagccttgcagatcatatctatcctgatcagaaggagttctataagggagatctcgagagaaacagatgacagatagcaaaagagccatcatccaggggcttctgcaggagtatgatatccgggatgcaaacgacatccaggaagccctcaaggatcttcttggtggcaccatcaaagaaatgatggaggctgagatggataatcatcttggctatgaaaatcagagcgtaacggcgattccgagaagaccgcaactaccggaacggttacaagacaaagcgtgtcaactccagctacggcagcatggatatcgagtcccgcaggacaggaattccacgttcgagccaaaggttgtaaagaaacgccagaaagatatatcagagatagacataagatcatctctatgtatgccaagggaatgagcactacacagatacggagatcattcaggatatctatggctttgaggcttctgagggctttatctccgacgtgacagataaaatcctgccgcagatagaagaatggcagaacaggccgctttcagccgatatccgatagtgttcattgatgccatacacttctcggtccgtgatgacagtgtggtaagaagcttgcagcatacgttgttctcggcataacagtgacggcaaaaaggaagtactggctattgaagtcggcgagaatgagagcagcaagtactggctgtctgttctgaattcctgaagaaccgtggtacaggatatcctgatactctgctcagacgggcttaccgggatcaaagatgctatatcgacggcttttccgaaaacagagcagcagcgctgtgtattgtgcatatggtacgcaacacccttaaatagttccgaacaaggacatgaaagcatttgcaaaggacttaaagactatatatacggctgctgatggaaaactgctcttaccaatcttgagaaagtaactgaaaaatggaaggaccagtatccttatgcgatgacacggtggaacgataactgggatgccatcagcccgatattcaagttctccaaagacgtcagaacagctttctacacgaccaatgccatagagtcactcaattcaccctgcgccgtctgaacctctcgggctttatcatacttaagagtctaagcctattctgcactgttttgaaagtacaagtagctaccagtaaagctataatctgctgtaatgtcaataataaagattgacagaattatttctgaacttcttgacatttcaggatgctgatgaggcggacttggggatatgcctgaagcattgctatatagatatggttcctttgaactgctttataagtgatggagagttcctgttctatgatcaggagttcaggtttgatgattatccgctaaatgcgctgcttgatagagtaattggtgttctatctacgcctcagattacaagatttatcagcagggacgagatgctgaagcggtatggattgtatcaatacagaaatatgtgggatacgattggaaacagtttcgcgcataagcttcgaaatgtttcattccttggcgaatacgactctgcccatagaggtgattatgaaaatatcggcgataatcgccttagaatgaattattctgaatctgagtatgagaagattttccttaatatctttaaggatactgacaggcttcaggttttcgtatttggtgccggtcagtatgcggcgtattttcttgagatttatagtaagcatctaaaaatcgccgggattcttgataataacaggaataagtggggaacggattttcatgggaaaaaagtcttcccgcctgatgttttaaaagaccatgaccctgattcatataaagtaataatatgtatgctcaggtttcaggacgcctatgaacaggcaaaatctcttggtgcgaggcatataggagtttactacaggcatagatcatacgagctgccatggcagagaaattcttataaaaatgaagagccggttgatgtagccacgtcagataataaccagagccagacaaaaaaatacaatgtgggttatgtggctggcgtctttgatctctttcatataggacacctgaatcttcttcgacgcgcgaaggagcagtgcaattacctgattgtaggggttgtctcagatgagcaggtcagacgctcaaaaaagagagagcctgtaataccatgcagggatcgaatggagatcgtaaaggcctgcagatatgtggatgaggtctttgagataccgatagacatggccggcaccagggatatttacaatatgtaccactttgacgtacaattttcaggaagtgattacgcacaggattcgggctggctggcagataagagatatctcgaagggcacgggtctgagctcgtttttcttccatatactaacgggacaagctctacacaaatcagggagagcctgttaaagggctagtgaatgcggctttttaaaatatggctttttagaaagagaaaagattatggatgtaatttttgatacttatgggcttttcaaacgattcaaacagcctaaaggaaatatttctgatgtcaggaaggctggcttttcaggtgcactgcttgatttcagaaatgcctgtccaccaggaatttttaaacatatgactagaagccgtaatgatgcaaaggccgagggagaggtttttcttccagatgagcctgaaaggattggtgagacggttaagccgtttcttgatgcctgtaacagtaatggtatacaggtgaaaggtgcaatggctccagtgatcccgcttgacaggtcgaatccgcttatgaatgattaccagcgcgtactctcagcatcaagtgtcaggtgtgcgatggagtctggctgcaagtggtgtattgtgccaccgctctttgttggtataccgcttgagaaagaaaaagatgtaaatatcgaattctacaggtcttttattccaatactaaaggagtattctgaaaagcatccagataaagaatttaagattctattgcagaatcaatgccgtgaccacagcgggcatttggtcagaggaatactttctgatgcagacgaggctgttgaatggctcaatgagcttaacgaagattccagaaatataattggcagagatgcctttggtttctgccttaatatcggccatgtaaatgtctgtggccaggatctcgatgagatcacaccagtacttggtaattatatagatgcagttattctcactgataacaatggaaatgaagactgcgagatgctgccgttttcctgcgcgtcacgtggaattggtggagacctggctaatgctgatacagactggcgttcagttattcgtggacttagaaaaataaaatatgacgggccggttattttttcaatgtcagacaccttagcagcattcccggtatttatatggccgcagcttattgcgtttgctaagactgtttctgacttctttgtctggcagcttacgatggagcagactatctctaagtattctcatgtggtgctttttggcgctggcaatatgtgccggaattacatgatggattacggtgagaaatatcctccactttttacctgtgataacaatagcaatcggtggggtgaggagttttgtggactggagattaagtctcctgagagtctgaagaacttgcctgaagatacaggaatttttatctgtaatgagtattatacagaaatccgttcgcagttagaatcaatggggattaaatcgaagattgagtattacagcgacagatacccgaatactgaggcaaggaccagacttaaaggtctttggaaaaacgcatgatctgcatttagtaaaagattttacagacagatggtgattgcaaaaggtttttgatattcaaacagacattgtgaggaaacgatatgcttgaaataggcgtgcagacacacaacatcgtaaaagacgagaatcccgaggaaggatttaaaatgatgaaggcagcaggctttgactgtgctgacttttctcttaatatgtatctaaaaaatactgatctctatcaggacagattgaatggattttttgatcagagcattgatgagctgaaggattttttcaaacctcatgtagaggcagcaaagaagtgcggtatcagaatccatcagatgcatatgccttatccgaactggattccgacagcaaaggatagcgtcaatgaatatctgattcatgagatggcgccaaagagcattcaattaagtgagtttctcgggtgtaaatatatagtggtgcatggccttaaggttaaggattactatggtactgaagaggcagagtgggaagctaccgagaactttcttcatactattctcccaatggctaaggatatgggaaaggttacctgcatagaaaatatctatacttctacaggtggtcatatcaaagagggcccttgttgtaatgcgaggaaggcggctgagagaatagatagaataaatgagcagtatggatgcgaggtgttaggtttctgcctggataccggccatgcgaatatcgccggaatcgatctcgaaaggtttatgacgattcttggaaagaggattaaggttctccatatccatgataatgatggtgagagggatctgcaccagatgccgtttacttttacaaagacaagagaaaacaagccatcgacagactgggatggcttcttaagagcattgaagaaatcgggctttgacggagtgctgaacttcgagacagcaccggtgcttacttcctttcctgaggagctgaggccagaggcactgcatatgatcgctgcgatagggcgttacttctcaaataggctggatgagatgtaaaaggcctgcttatttttcgcagaaaattcaattgattttatgctctgtgccttttataatgaaatgaggtacctgagcgcggcgagaagtatgaacttcatcggctgattggagcattgctatcgagtgaattacagcaagaggcaaagcttgaaatcatagagcatgaatataacattccaataaatagagacttgagagaggacgtgagcgtcatgtgtaatttgagcgaaggaatcgaagagaaaggcattaaaaaaggcattgaaaaaggcattgagaaaggtattgaaaaaggtattgaaaaaggtgccaggcaggagagtgaaaaatttattcttaatatgtatcagcagggttgtacattaaaactgatagcgagtgtggcaggtatcagtacagatgaggtcgaggctattataaataaaaagaagcctgctttgtcatgattatcagctacacatgtgaattgatttactcagggacggcagatcagtggtgatttaccgtctcttttatgttataataacactgagttagtcgtaaagaatgataaaagatatgtgttgatttaaatcctgttttttgagattatgtggaggcaatcaatatgagatataaggaaatggcaaaaaatctaatagacttgataccggacagcaaaatgatttatgtattatcctatttacagggtgcggcagttccggatgatactccgaatgatgaaacgctagaaggaattcatgaattagagaatggtggcggaactacatttagcggaactacagcagagctgtttaatgaattaatggcggattgatatgttagatgtacgatattcttcaaaattcaagagagattttaaaatctgctgcaaacgtggatatgacttatcactacttcaagatataatcaataagttaaggattcctgagaatttgcccgataaaaattaagaccattcactagttggcaattattcaggttatagagaatgtcacattgggtcagattggcttttgatttataaacaggttggtaaggaattaagacttgatcgtactggcactcatgctgatctttttggtaaataattacattgttggtgtttaatgcgtgtcatgtggtaaatatataaagcaaaatcgttcggaaagaagcagagtgtgttgtcaagtggtggattgcaaaactcctatgacttttgctataatatctgcaaaactcctatgacttttgcagatacgaggctgttatgtatagagaaatcatcaaagaccttatcaagtggaaaaataataatcgaaggaaacctcttatccttaccggggtaaggcagtgcggtaagacttatatagttgaggaattcggaaggaataatttttcaaatctggttgtggtaaactttgaacaggacaggtctgtctctgcgctgtttgattatgattttgacgtaaacagaattgtaactgagatcagccggctgaaaaaagcagatatcattcctggtcagacgcttttattttttgatgaaatacaggaatgcccgaaggcagttactgctcttaaatatttctgtgaggatttgcgcggtctccacttgattgcggcgggttctcttcttggtgtggcattgacacataagaatatttcttttcctgttggaaaagtaaatcggatgcagctgtatccgatgaattttaaggaatttgccatagcctgcggtgaagaaaatttcatccagacgctctctgactggccatttgacagggagataccagatctttattctgttcctatgaaaaaactgctcgatgactactacatagttggtggtatgcctgaagctgtgaaggtttggtcagagactcatgactatgacgaggtaactgatgtacagaacgaaattttaaatgattacgagtctgatttcgcaaagcatgcgccactgtccgaggttccaaagattaagatgatctggaactctgtgccggtgcagcttgccagggaaaacaacaaattcgttttttctcatgtaaaagagggtaaacgttcggctgatcttgaggatgcgcttgaatggctgattgatgcgggaatcatatataagctgtgcctggtggagaaaccggagcttccgctttcgggctttgccaattattcatatttcaaggtctatctctgtgatttgggtcttctacgtgttcggtctggtttatcccccaagactatcattaatggcagtgggagcttcatcagatataaaggagcaatggctgagaattttgtttatgaggagctggtatcgattgggaaaagtccatacttctggcgatccgggaatacggctgagctggattttatatatgatggagacgattcagttgtccctgttgaagtaaaagccgctgacaatacacaggctaagagctatcggattttctgcaaaaaatattctccgcagaccggttttaaaatttcacgcaaaaatatcgctgaaaacttttgtgaaaacacccgcacgataaacctgccgatgtatatgacctggaatataaagaggtatgagtgatttgtgatagaataatttcttaaatttgatttttcacatgggccgatttggaaagataaatatgatgtggctgccagtaaggctgagaaaaagtacaatgttccaaaggaagagtttttggagatgctcaagtcatataagccagatgatgagttgaagcaggggtaaagtacaaaaatattaacttagggatggtagattcatgacgatttaccgtacttttttactaaaagtttgataaccaggatatttgaatggtatagtctaactgattggaaaactactaattaaaaagccagaatttatttacaggtgatatatatgattaaaaaatggaacagtgaagaagaggccagagcagagattaaggctatggtcggggattattataatcagttcaaaaaaagtgaaaatgatcatagcgatttcaagccgggagaccgtatgggctatggtgggagagtttatgatgaaaaagagatgcaggcactgactgatgcctgtcttgacttctggcttactactggccgcttttccaagcagtttgaggaagagtttgctaaatggattggtgtcagatatgctcatctggtaaattcaggatcttcagcgaatcttatagcttttagtgtacttactgccaatgaactgtgagagagagcaatcaggcgtggcgatgaggtaataacagttgcctgtggctttccgactacagtaaatccagtgcttcagtatggtgctgttcctgtatttgtagatttgactataccgcagtataatgtggatgtcactatgctcgaggaggcatatacacctggaaaaacaaaggctgtaatgcttgcacatacgcttggaaatccgtttgatataaagacggtaagagatttctgtaacaggcataatctgtggcttattgaggataattgtgatgctttagggtctaagtatactatagatggtaagacacggtatactggcacctggggtgatataggtacatcatcattctatcctccgcatcatatgactatgggagagggtggtgcagtttatacggacaacccgcttctgaacagactgatactttcatacagagactggggaagggattgttactgtccgtctggcagggacaacacctgtggccacagatttgatggtgattatggtgaattaccacatggctatgatcacaaatatgtctacagtcatctgggatataatctgaaggtgactgacatgcaggctgctgtgggattagctcagttagagaaacttccagaattcattaaaataagaaagcacaactggtccagacttcatgaacagctttctgatctggaggaacagattattttaccagagcctgtggaaaattcagatccgtcatggttcggttttttgatatctctaagaccagagagtggactgaacagaaacgatgtaataaattacatagaatctcataatattcaaacgaggctgcttttcagcgggaatatcataaagcagccgtgctttgatgaaatcagaggaacatcggcctacagagttgttgggaatctgaaacagactgattttattatgtcaaataccttctgggtcggtgtttatccgggaatgacagatgagatgatagactatatggcacagattattaaagaggcagtaaggaagtaataaagatcaaggagcagataggcatatgatgcttgattttttcaaaaataaaagagtgcttgttacaggtcatactggtttcaagggaacatggctttcaaaaattcttataaacgctggtgctgaggtgactggatactctctcggtctgccgacagagccttctttattcgagatggcagggcttgatgccgtaaatgacatccgtggtgatataagggatttgaatcacctgaaaaaggtttttgatgaatgcagaccacagattgtctttcatctggcggctcagccgatagtgagggaatcatataaaaatccggtttatacgtatgaaaccaatgtgatgggaacagtaaatatactggagtgtatcaggctgactgactgtgttcgttcatcggtgataatcacaaccgataaagtttataagaataatgaatgaagccgaggtggcatataaaagagtgtataaaaaaaacagttgagtttagtaagacatatatagagaatcctgatagactgccagaagagatggatagagagattgaaaccttttttacaagtatatgctccgcacagatatgattaagaaggtggcggattattttatctagaagatttctgtaaagaaggtgatgagaaaaatggaacagcaggtaagatttaataacacattaaataaagacttggaccttagtgttactgaggatgggaaagattattattgccttacagtaggaagaaaatcgtacgtatctggtatggcaatagattcaggtgctgtcagaggccatattactattggcagatatacgtctattgcaaaaaggatagtcttagaaatagggtttaatcatgatcatcatctggtttcaaattttccatttaaagattttgacaacactattgacccggctcagcaggacttaaaccattattatgaaaataatcactatcatgtcattataggaaatgacgtatggataggggacggagtcaggatattaggtggggttcatataggtgatggtgcagtgataggcatgggagctgttgttacaaaagatgtgccgccttatgctgtcgttgtggggaatcctgctagagtagtgaaatatcgttttgatgaagaaactatctcaaaactgatgcagatcagatggtggaactgggacgatcagactattcaggacagggttcctgaaatgaaagatcctaaagcttttgcagataggtattataaagagcctgcagagattcctaactctgaatttactgatttgatgaacagaatgaaagaagaaggagtaaagattttttatttcgttcttgactgtaatgcaccgctgcctctatgggaaaaggtcatgaggtctttcatggaagcatacatgagagataacaggcagcttctaatcgttaatatccctttatttgttcagagcgacagtacttatcagggtgtagaaaaggttttggacgatttttcgaaagaatgtgatggaataataaaagtttcaaacggtgattcttcattttatcatgcagatgtatatgtggcaggaaatgatgtcaggtctttagtatatctagataaagcttctgcgttagggatggaagtcaggagtgcctgtgactgggagtctggtctcttctgaagtaactgcgtgaaaggtattttttgtaggtaaaggtaatgaacagaatttatatcatttgtattcccaataaagccagcggtgggccggaagctatgaatcagctgtgcagagcgctacgtgatatggattatgatgcacagatgtttttcccgccgtatgacacacaaaagtattcatcgcctatatgtgatgaatatctgcattatgaaaatccatatacattaaaggcagatgatgctccagataattattttattttccctgaaattatgactatcaataaaatgccgatgctgaaacactcaaagaaaatcatgtggtggcttagcgtagacaattttcttgagcaaaatggggtgtttggaaaagacctgctgagcgaatttatcaatctgtattatgattatcattttgtccagtccgaatatgccagaagatactgtatcgacgaaatgggtattcctgaggaaaaaatattctatatatccgattatctgaacgattcatatatatcaaaagcaaaggataataccgaaaagcaaaaaaaagatcaggtattatacaacccgaagaagggcattgaattcacaaaacttttgatgaattatgctcctgatatcacatgggtttcgctgattgatatgacttatgatgaagtgcgggatacgatgcaggagagcaaggtgtatatagatttcggcaatcatcccggaatggacaggcttccaagggaggcggcaatcaacggatgctgtataatcacagacaggagaggagcggccgcttttcgagaggacgtcccgattcctgataagtacaagttcgacgacaacgaggattctgttccagctattattgatgcagtccgttttctgctccaaaactatgattcatccaaaagcggttttaatgactacagagtatggatcaacggagccagagatagattctacagtgatactgaaaaagtttttggaacgataatccagaaataggaatctgattgccgattggattattatgaaaacgagtatgatacttattcgagagtttgaaaaaaagtctgtaaaagttttcatatagggtctttcatgatacaattattttaattcatggagggcctattattatggcaagaagagaaaagcaaccagtacaccacgttcagccctttaatagtttgatccaggaaacctccgttgaaaaaattattgcgatgtagttattttatagctaatagaaaaacttatagatattgagggcgacagttgctgggatatggacggttaaaagcgattaatatttttatttttaaatatgtttacagaagccaaggaaacagattcaaaaaaaaaatggcacaggatatcattatcatcttcctataggtatcacattggtatcctttccatgaacagacaaaaacaggaacaaagaaaccaaacaccacacaagagcaatgtcccccacccccaaacgcccctctcccacctccctcaaccaccacgcccccatcacaaccctcccccttattcccgcaactacccctccccccacaccaccccctcacccccccaacatgcctatccctactatcctcccccccccagatcgccatcctaactacccccctaatctacacccaccactccctcccagtgcatttctcccacacacccccaaacctaccaaagccctacccaaattaagcaagccaccccacaacaacgaacatcgtcatatacccacgcctcaactctcaccacagtcctccccctgctaaccagtagctaagtgccgataccaacaaagacagcactaaacgatcagctaggcctttaccaatccccaacctacaaacagactcgcccactttacctctccattagatcacaaacacaccctctctcaatcactgtcatccgggatcataagattcgagcattacttgttgagggagaaaacagtggagatgtttttcgtgagtttctcttatcaaaaggtctggatgtaacgagctacagtattgatgatcttcattattagtagtgaacctaaagatcaggagtacatatctgataagaatgataaaaaaagatgatactgataaatacgattatatcatctgcatcggagtattggagtactgccatgtgcccgaaaaattgcttaaaatcttagctgattatttgaagaaggatggcatttttctcctgggaactgacaacaggtgtgttctcaggtatttctgtggagacagagataagtttactggctgtaatttcgacagtatagaggattactacagggtagatgaaaatgaattcccgcagatggatggcagatgctattccaatgaagaaatcaaacgaatgactgatggggcaggtcttgtatgccggcactgctattcggtgtatccgtctattgaagctctcaattgatttaccgtgggatacttttccgaatgaggaatttctggacggtattttactgattataatcatccggatacggtgtttctgcaggagaaccagattctgcagagtatttctggcagcaggcttttccatgagatggctaatggattctatttgaatattggtaggttgcttcgtgaaactgctaatgaatataagcatgtaacttgacaatggaccgtggcagaaaacttgattttgccacctgtattggagatgaaaaagtaataaagaagcctttgtatgaagaggggacagagcatctaaaggatatggtatccttacaggatgatttgaatgctcatggtattcatgtcgtaaatggttgcttaagttctgacggatagaaatgccttttattgatgcagaaaatggtgtgagccattttacgagacttgctgattctgataaagagctcttttttaaggaacttacagatttatagagaatataaagagctcatcagaggtatcagaagttagtgcgtatgatttttgaaaaagaatggctatggctcatttgaatcatatgatgaaatacagcattctgaggtaatgacaaatattatcaaaaaaatgaacaatgagttagatgaaagtgtgatatgtagaaaatgtatgtttgcaaccaaaaaatcataatgatttattttgaaatttaatagaaaacaataaagatcagacatgcatatagaaaatgttgtaatatagcggatattatttggaaaggaaaatagataaactgatttcaattattgtacctatatataatggtgaacgaaatttagtggaatgtctagatagtctgaaaactcagaattattcaaatatagagattattttaatagatgatgggtcaaaggatagaacagcagacatttgccatcgatatatttcagaggacgggagatttcgttatatatatcaaaaaaatggagggcagaatgctgcaagaaaaaatggtgttgaacatgcattaggagattgggtgatgtttgttgatgctgatgattttgtcacagcagattactgtagttcttttaaggaggtacaatctaaaacaggtgccgatattgtattcggagttcaacagcgttatcaggatggaaaatatggaagaaaatctcaagttttatcaggagtaatatcaggcattgaggttttggaaaattttctcaaaccacgcttttttgaaatgcaattaggtggtgttttgtttccagttcttttttcgaaggtgattattcaagagtcatttatgaaaatggatatgagaattcgttatggagaggattgggggtgtacgatatacagtcttcttagtgctaaacgtgtcgcttttttaccacgtgttacgtatttttatcgtcaagaagcatcatcttgcaatcatttacatacaaaaagtacggtagttgatcaaaaattattgagggggtttattttacactcaattgctactagcattagaaattataaattcatacaaaagaaaatagactggcttattattcaaaatttattattgggcggatatgagtattttagcgatttttttggactatatccgtttggaaaaatattacctggtaaacgaattgtcatttacggtgctggtgtatttggagaagaaatacatgataagtttccaaaaaatctagtgctcactgggtgggttgatcggcagtattcttattataaatctttgggaaagcatgtttctcctgtaaataaattgctagagatggaatttgattatgtgatcatagcagtgacaaatcctaatactgctgacagtattgtaaatgatttgctagatgagagaattccagaagaaaaaattttaagagttgaagagaaatggattgattctgaatatactgaaagaaaattacaagaattggaggaggtcaatgagaattattgctatgtaccttccacaatatcacagagtacctgaaaatgataaatggtggggagagggatttacagactgggtagctgttaaggctgcaagaccgctgtttgatggtcatgagcaaccaaatgtaccgttgaatcataactactatgatttaatggataaaactgtaatgcagcagcaggctaatctcatgaaaaaatatagtattgatggaatgtgtatctatcattattatttcaaagatggcagaaaaatccttgaaaaaccagcagaaaatctattaaggtggaaagacatcgacatgccattttgcttctcttgggcaaatgaatcctgggttcgttcttggagtaaaatgtctgagggggaaggaaatccatggtcagcaaagttcgacagaaaatattctggcgaggatgattctgggatacttctagaacaggattatggcagtaagcaggactggatcaaccattatgagtatttaagaccattttttatggatccgagatatatcaaggtagggaatagcccggtttttatgttttataagactgataaaatctcgtgtataaaagagatgcttgatgtttggaatgaattagcaagaagtgatggattagatggtatattttctattggtgccaatactagagattacaagacaaaaggtttatcatgtagtaccttgcaggaacctcaggatacaatgagcagattttttacaggaaagtttgacaatggcaagggtgtaatgtcagctattgattactctgaaatctgtgaaaaaatgatattcaagccgactgaagagggacagtgtcttggagcatttccaggctatgatgatacaccgcgtagagaaaatggcggttcggtagtttacggacgaagccctgaactttttgaacacttgatgactcagataatagtaaaagccaggaaaatgaaatctccatttgtttttataaatgcctggaatgaatggggcgaggggatgtatttagagccagacgagagatacggctacaagtttttggaggctgtttcttcggctgtaaaaaaagcatccagtagtaatgtgacttttgattataaaaagcagattctgattctatcagatgaaaacagagcgattcagaagacatgtgacaggtatcatggttattgggagataatggatgaatggattcgtctgatggaaaatgatggcagaatatcagatggctttccagaggattctggcaaaagagtcatgatatatggcataggaatgcttggaaaacatttggtaaagcagttaaaaaaagaaaaagttaatttgattggggcgattgataataaagccggaagtaatccagatgtacaggttttcagaccaactgaaaagcttccagatccagatttaataatagttacagttcaatatgactattcaggaataaagcaaaagttagcgaaaaaggttggagataattgtattattctttcattggatgaaatactaagattggcgttagagaggaattgatatgaaccataatttaacttatgcgatatatggtattaacagagtatcaaaagattttttatatattttcgataaactgaatatttctctagcttttgcatcaaaaaatgaaacaccaaaagattttaataggataatttcagcgccgattatatcagagaatgaaataacgggtaatagaaacaaatttgatgctattattgtttgtgattttgataaatcggctaaaactaaattcttagataagcttggctataaatatggaaaagattatttttatgaagaagattttttcgatgttttagatgattcagttttgaatccggagaaaaaacctattctaatttggggagctggacgcaaaggggaagctttcattcgatggaataaatggtttgatgtagaaaaagttattgactcaaatcctaaagaggaaaaactttttggttaccagattgttaagccaaatgatattattgattggaaagattacttcattattgttacagttgtaaaaaatgatgatataatcaatttcctggaaagcaaaggtcttgtttataataaggattattgtaagttttatgactttatgtcttaccctagtatgatgcttagacagaccatttttgaaaaaaaggtgtatgatttcaactgtaatacaatgttaaatcatgcggaaataggtagtcagggcaatactatctgttgctgcagcacatttattgataacagtctgggatatatcgttaatactcataagtttcatgctctctggaactcaaatatacataaaattatgtgtctgtcaaatgtaaacaggacatattctttttgtaggacagatatgtgtccattgtttgtaggaagacatttaagtgaacaatacaatctggcagaaccatatccaaggtttgaaaatagccccaatacagtattagttggttttgattacacttgtaatctgaagtgtattacatgtcgttcagattatagatttgctagagatgaagatcaaagaaaaatacaaggtattgccgacacatttagaaaggagatattacccggatgtgaatttctcatcatggctggtgatggtgaggtactgatgacaaaagcttatcagtctatttatgatgatccagctatgaagaatgtcaagtatttcagacttctgacaaatggacttctgttcacacctgctaaatggaaagagcttagagaacatactgatgcaaaaataatgatgacagtctctatagatgcagcgacacctgagacatatgaaaaaatcaggagaggtggacggtttgatatcttaaagagaaatatggaatatgcggcaaagctcagacatagtggagagctatcatatcttagattcaattttgtagtacagaggatgaattataaagagatgcctcttttcgcagaatggggcaagcagcttggaatagatgaagttttctttaccaagattttgaattggggtacatatagtcatgaagaattcagaaatattagtatgatggaagaggatggtattacaccgaagccagaactagaaaaagtattagaaactcctgtttttagtgataaaattgttgatttaggtactatcagatcgcatcatcaagcagttgatttaatagatataaataattattatcgatgggaacttgaacgaaaagtaccaggactttttagtgaaaaatgttaataatttgacgtttttaactgcgcaattaaaaaggtgatgtgaaatgcaatcgttattcaattggttggatagtgggtataatacaataaatagtctaatttcatactatcgtgatcatgaaaaaaaaatgatgctttggggtgctggaaatcgtggtatagcatttttacagatgtatgatcctaatgcagtttatctgagtggcgtatatgatatgtatccgtcaaagcagggaaccatattgaaaacaggacatcatgtatttgcaccagaagaagtaaaatgtgatgttatttttgtgctttctaatggcatagaacggtttgcacggaaatacatcaaagaacatggacgaaatgaaaaggtaattgatattttagatattatttttggtaaactgcctttgtcaaaaataattcaaactgatgatgttcaattaatccctgttagaaaagagaaaatatgtggattgaccataatgtattatcccaaagaggcaaatttctcatatgtgaagcagtatgctaaagaacttgaccatcttgtgatctttgacaattcgcctagtgataacaaatctttttttgaaaaggcaaattttccggagaatacggaatattattggaaccatggcaataacattggtctgggggatcccatcaacctattggcagagaaacttgcaaattctgattacaattggattctgacttttgatcaagatagcgtactagaagaagatatgattactggcatgaggaaatttattaattctgataaatgtacagaagatgttgctgtcgtatcgcctcagctggtttcatgtgagaaagatgttcattctattaaagagtcagttttccctttttgcactcatacatattttattgcgcaaagtggtatgctgcagcgaatcagaactattcaagctattggaggttatgacaaaaatctgtttatagattcagtagatacagattttgttgtaaggtgtatgatgcatgggtaccagactataagattgaatgactgttttttatatcatcagttgggagataaggatgagaagcagataaatattaacggacacatttataatacaaataagtatggtccgctgcgctactattatcagtatcgcaatgcactttattgcaagaataaatttcgtggaagtgcttatgagtttatttgggatgaggttttgaatgtattaaataatactgtttctctagaagaacggtctaaggatatatcagaaatgatagtacaggcaaaacaagattattcgaaacgagtcatgggtaaatattgtggtgtaaagtaagttagacgaaatgttcatgcatttgacatataaaattttccaaatatcagctctttcatttgcatgtaattgattacaatttaagaagaaagtagtgcttatgatgattagaacaatcatatttggaacaggaacatatctgaaaaaaagagtaggtatgttacctaaagaatttaatattttagcttttgctgataataatagttctttatggggacaagactttattggcaaaaagattatctcaccggatgttatttcaaaatttaaatacgatattattattattgctgtaagcaataaattttttgaggaaatcaataatcaattaatttctttaggaattccagcgagtaaaatttattcttttgaatttattactgctatgaaaaaacagggggaaattaaatattacggaactaatgtccacaacttctcggcagatgttattattattagtaatgagttgaattacacaggtgcacctatggcatgtatttctgctgcgctagtattaaaaaataataataaaaaagtctgtattgctgcacctagtgctgatttaagacttgtgagagaaattaatgaaaaaggaattgttgttgtagtggcaccagccttaaatcttccaggaaaaaaggaattgttacttgcaaaaaattgtgattttgtgttagttaacgtatatacaaatatttctgctgcctgcgaatttagtaagataaagccagttttatggtgggttcatgaaactaatgatataattcatattacaaatataatatatcattgtaatattattaagcctagttttacagggattcatacggttgctgtatgtgaaaatgtgaaagataatctaaattctgtttggccagatttaccggtaacaattatgaattatgggttattagatttttacaatacgaagataaaagataaatccaagtattataagattaactttgcaattattgcaaacatatatacattaaaagcacaagatgtttttgtgaaggcagcactggaatattttaaaatctgtaatgtacctgcagaattttggatgataggttctggtagtaaatcagaattttttgatgaagtaatggaactttctaataaaaatcccaatatcatctggaagggagaaatgagcagggaggagttggaaagtatatatcctcaaatcgatgtagtggtatgtccatccaggcatgagggactacctattgccgtaaatgagggattgatgaatgctaaagtatgtatagtagcagatactgccggtgataatgattacatcattgatggtgagagcggattcctctttcatggtgaggacgttaaaggattgtctgaaaagatgaaatatgtggctgaaaattacgaaaatcttggagaaatgcgccataatgcacgtcaggtttatttaaatcactattcaatggattcatttagtgaaagattaaacaacgaaatagaattaactataaaaaactggagaccgaattctaaacattcaatttttggtaatcaaaacctattagaaacagaggcagactaaaaaattgagcttttaaaggatgactggaatagcatgatttatgaagaaaaagtgtcagtaataataccgtcacttaatgtatttcaatacatacagagatgtattgagagcgtcagaactcaaacactaaaggaaatagagatactttgcatcgatgctggttcaactgatggcactcttgaagtcatcaggagagaagctgaaagcgactcaagaattacacttattcatagtgataaaaaaagctatggttatcaggtaaatcttggaatatctatggcaaatggaaaatacatttccatagttgaatcggatgaccagatagaaagcgatatgctcgagaagctttttggagaatctgagaataataagcttgatttcattaagagtgattatttggctttttctcatggaaagaaaaataagaggaaaatattagaatctgacaagctatataataatatcttaaatccaaagcagatgccactattgcacactatggatatgagcatttggacaggtatatataaaaggcagtttataattgataatcatatcctgttaaatgagtcagctggtgctgcttttcaggacattgggtttgttacgcaggtcctgtgctatgcggagagagcagagtatttgaatgaaccgttctatatttatacagagaatagagaaggggcatcaactctgaataaaaagtgctttatatatgcatatcaggaatggaaaaggatatttgagaatcagataatctctgatgagatatttgagtcgcacaggaagtgtatagtcacaagacttgtagatacagtattgcctgaatcaaaaaaagttctcatatcggaggattataacattgattctacattctataaggagccgtgtgagtggttctctcgacttatcagaaatgaatggaaaaaaggcaatattcttttcagcaatttgacaagagaatcgctaaaggatatatggctttttacatataaccagaaaagctatagtgaaaagattaagacagagaatctgctgatgcagagcataaaagaagaactgaaagagactctcctaaatctgaagagaccatttgtgattttcgggagtggtcagagaggaagaaggtttcttgaggaatatgttcttccgttaggtctgaaaccactttgctttgtggataatgataagtcaaaatatgacagctatatagatgaggtataaaaagcagattcttattcttcagaggaaaacagactgattcggaagacatggacaggtctcatggtttcattgggagataatggatgaatggattctctgatgaaatgatggcagaatatcaatggctctttccggtatgttctggcaaagagatcatgatatatggcatagaatgcttggaaaacatttggtaagcagttaaaaaaaagaacaagttaatttgatggggcgattgataataaagccggagtatccgatgtacggtttcagacaaactgaaaagctttcaatccaatttaataatagttacagttcaatatgacattcatgagataaagcaaaagttagcgaaaaaggttggagatattgtattattctttcatggatgaaatactaagattggcgttagagaggaattgatatgaaccataatttaacttagcgatatatggtattacagagtatcaaaagattttttataattttattatttcgataactgatatttctctagctttgcatcaaaaaatgaaacaccaaaagattttaaatggatattttcagcgccgattatcagagaatgaaaaacgggtaatagaaacaatttgatgctatattgtttgtgatttttgataatcggctaaaactaaattcttagatagcttggctataaatatggaaagattatttttatgaagagatttttcgatgttttaagatgagtcttttgaatccggagaaaaacctattctacatgtgggagctggacgcaaaggggaagctttcattcgatgaataaaatggtttgatgtagaaaaagttattgactcaaatcctaaagaggaaaaactttttgtttaccagattgttaggccaatgatattattgatggaaagattacttcattattgttacagttgtaaaaatgaggatataatcaatttcctgaaagcaaaggtcttgtttatatataaggattattgtaagtttatgacttttatgtcttaccctagtatgatgcttagacagaccatttttgaaaaaaaggtgtatgatttcactgtaatacaatgttaatcatgcggaaataggtagtcagggcaatactatctgttgctgcagcacattattgataacagtctgggatatatcgttatactcaagtttcatgctctctggaactcaaatatcataaattatgtgtctgtcaaatgtaaacagacatattctttttgtaggacaatatgtgtccattgtttgtaggaagacatttagtgaacaatacaatctggcagaaccatatccaaggtttgaaaatagccccaatacagtattagtttggtttttgattacacttgtaatctgaagtgtattacatgtcgttcagattatagattgctaaggatgaagatcaaagaaaaatacaaggattgccgacacatttagaaaggagatattacccggatgtgaatttcatacatggctgtgatggtgagtactgatgacaaaagcttatcagtctatttatgatgatccagctaatgaagaatgtcaagtatttcagacttctgacaaatggacttctgttcaacctgctaaatggaaagagcttagagaacatactgatgcaaaaataatgatgacagtctctatagatgcagcgacacctgagacatagaaaaaatcaggagatgtgacggtttgatatcttaaagagaatatggaatatgcgcaaagctcagactagtggagactatcatatcttagattcaattttgtagtacagaatgaattataagagatgcctcttttcgcagaatggggcaagcatggaatagatgaagttttctttaccaagattttggaattgggggtacatatagtctgaagaagtcagaatattagtatgatggaagaagggttgtattaccaccgaagccagaactagaaaaagtagaaaccctgttttttagtgataaattgttgatttaggtctatcagatcgctcatcaagcagtttgatttaatagatataaaatattattatcgatgggaacttgaacgaaaagtaccaggacttttagtgaaaaatgttaatatttgacgtttttaactgcgcaattaaaaggtgatgtgaaatgcaatcgttattcattggttggatagtgggtataatacaaataatagtctatttcaatactatcgtgatcatgaaaaaaatgatgcttttggggtgctggaatcgtggtatagcatttttaagatgtatgatctaatgcagtttttctgagttggcggtatatgatatgtatatccgttcaaagcagggaaccatattgaaaacaggacatcatgtatttgcaccagaaaagataaatgtgatgttattttgtgctttctaatggcatagaacggtttgccggaatacatcaaagaacatggacgaaatgaaaaggtaattgatattttagatattatttttggtaaacctgcctttgtcaaaaataattcaactgatgatgttcaattaatccctgttagaaaagagaaaatatgtggattgaccataattattatcccaaagaggcaaattctcaagtgaagcataatgctaaagaacttgaccatcttgatctttgacattcgcctagtgataacaaatcttttttgaaaaggcaaattttccggagaatacgaaattattggaaccatggcaaataattggtctggggatcccatcacctttggcaagaaactgcaattctgattacaattggatctgactttgatcaagatagtactagagaagtaatgattactggcatgaggaattttattattctgataaatgtacgaagatgttgctggtcgtatcgcctcacctggtttcatgtgagaagatgttcatatctattaaagagtcagttttccctttttgtgcactcatactatttattgcgcaaagtggtatgctgcagcgaatcagaactattcagagtttggaggttatgacaaaaatctgttttatagattcagtagtatcagattttgttgtaaggtgtatatgcatgggtaccagactaaagattgaatgactgttttttatatcatcattgggggagataaggatgagaaagcagataaatattaacggccacattataatacaaatagttgtccgctgcgctactatatcagtatcgcaatgcactttttgcagaaataaatttcgttggaagtgcttatgagtttttttgggattaggttttgaatgtttaaaatactgtttctcttagaagaacgttctaaggatattcagaatgatagtacgcaacaagattcgaacgagtcatggtaaatattggtgtaagtaagtttaggagaatttcattcatgcttgacttaaaattttccaatatcagctctttcatttgcatgtaatgaatacaatttaagaaaaagtagtgcttatgatgatagaacaatcatatttggaacaggaacatatctgaaaaaaaaataggtatgttacctaaagaattaatatttagcttttgctgataataatgttctttatggggacaagactttattggcaaaaagttatctcaccggatgttatttcaaatttaaatacgatattattatattgctgtaagcaataaattttttgaggaaatcaataatcaattaatttctttaggaattccagcagaaaatttattctttgaattattactgctatgaaaaacaggggaaattaatattacggaactaatgtccacaatctcggcagatttattatattagtaatgagttgaattacacaggtgcacctagggcatgtattcggctgcgctagtattaaaaataatataaaaaaagtctgtatggctgcacctagtgctgatttagacttgtgagagaattaatgaaaaaggaattgtttgttgtagtggcaccagccttaaatcttccagaaaaagaattgttacttcaaaaattgtgattttgtgttagttaacgtatatacaatatttctgctgcctgcgaatttagtaagataaagccagttttatggtggtcatgaaactaatgatatatcatattacaaatataatatatcattgtaatattattagcctagttttacagggtcatacggtgctgtatgtgaaaattgaaagataatctaattctgttggccagatttaccgtaacaatatgaattatgggtatgttttaacaatacgaagataaaagataaatccaagtattatagattactttgcattattgcaaacatatacattaaaagcacaaaggtttttgtgaggcagcactggaatattttaaatctgtaatgtacctgcagaatttttgatgataggttctggtagtaaatcagaatttttgatgaagtatggaactttctaataaaatcccaatatcatctggaagggagaaatgagtcaggaggagttggaagtatatatcctcaatcgaggagtgtatgtccatccacatgagggactacctattgccgtaaatgaggattgatgaatgctaaagtatgtatagtagcagatacgccgtgataaatgatacatcaattgaatagtgatttaaataaacctgacgtgcattatgggcgcatttctccaagattttcgtaatttcagccacatatttcatcttttcagacaatcctttaacgtcctcaccatgaaaaggaatccgctctaccatcaatgatgtaatcattatcaccgcagtatctgctactatacatactttagcttcatcatccctcattacggcaatagtagtcctcatgcctggatggacataccactacatcgatttgaggatatatactttccaactcctccctgctcatttctcccttccagatgatattgggatttttattagaagttccattacttccatcaaaaattctgatttactaccagaacctatcatccaaaatctgcggtacattacagattttaaaatattccagtgctgccttcacaaaatcttgtgcttttaatgtatatatttgcaataattgcaaagttaatcttataatacttggatttatcttttatcttcgtattgtaaaaatctaataacccataattcataattgttaccggtaaatctgccaaacagaatttagatttctttcacattttcacatacagcaaccgtatgaatccctgtaaaactaggctaataatattacagaatattatatttgtaatatgaattatatcattagtttgcacccaccataaaactggctttatcttactaaattcgcaggcagcagaaatatttgtatatacgttaacaacacaaaatcacaattttttgcaagtaacaattccttttttctggaagatttaaggctggtgccactacaacaacaattcctttttcattaatttctctcacaatcttaaatcagcactaggtgcagcaatacagacttttttattattattttttaatactagcgcagcaaaatacatgccataggtgcacctgtgtaattcaactcattactaataataatacatcgccgagaagttgtggacattagttccgtaatatttaatttccccctgtttttcatagcagtaataaattcaaaagaataaattttactcgctggaattcctaaagaaattaattgattattgatttcctcaaaaaattttatgcttacagcaataataataatatcgtatttaaattttgaaataacatccggtgagataatctttttgccaataaagtcttgtccccataagaactattattatcagcaaaagctaaaatattaaattctttaggtaacatacctactctttttttcagatatgttcctgttccaaatatgattgttctaatcatcataagcactactttctcttaaattgtaatcaattacatgcaaatgaaagagctgatatttggaaaattttatatgtcaaatgcatgaacatttcgtctaacttactttacaccacatatttacccatgactcgtttcgaataatcttgttttgcctgtactacatttctgatatatccttagaccgttcttctagagaaacagtattatttatacattcaaaacctcatcccaaataaactcataagcacttccacgaaatttattcttgcaataaagtgcattgcgatactgataatagtagcgcagcggaccatacttatttgtattaaatgtgtccgttaatatttatctgcttctcatccttatctcccaactgatgatataaaaaaacagtcattcaatcttatagtctggtacccatgcatcatacaccttacaacaaaatctgtatctactgaatctataaacagatttttgtcataacctccaatagcttgaatagttctgattcgctgcagcataccactttgcgcaataaaatatgtatgagtgcaaaaagggaaaactgactctttaatagaatgaacatctttctcacatgaaaccagctgaggcgatacgacagcaacatcttctgtacatttatcagaattaataaatttcctcatgccagtaatcatatcttctctagtacgctatcttgatcaaaagtcagaatccaattgtaatcagaatttgcaagtttctctgccataggttgatgggatcccccagaccatgttattgccatggttccaataatattccgtattctccggaaaatttgccttttcaaaaaaagatttgttatcactaggcgaattgtcaaagatcacaagatggtcaagttcttagcatactgcttcacatatgagaaatttgcctctttgggataatacattatggtcaatccacatatttctcttttcaacagggattaattgaacatcatcagtttgaatatttttgacaaaggcagtttaccaaaaataatatctaaaatatcaattaccttttcatttcgtccatgttctttgatgtatttccgtgcaaaccgttctatgccattagaaagcacaaaaataacatcacatttacttcttctggtgcaaatacatgatgtcctgttttcaatatggttccctgctttgacgatacatatcattacgccactcagataaactgctataggatcatacatctgtaaaaatgctataccacgatttccagcaccccaaagcatcatttttttttcatgatcacgatagtatgaaattagactatttattgtattatacccactatccaaccaattgaataacgattgcatttcacatcacctttttatttgcgcagttaaaaacgtcaaattattaacatttttcactaaaagtcctggtacttttcgttcagttcccatcgataataattatttatatctattaaatcaactgcttgatgatgcgatctgatagacctaaatcaacaattttatcactaaaaacaggagtttctaatacttttctagttctggcttcggtgtaataccatcctcttccatcatactaatatttctgaattcttcatgactatatgtaccccaattcaaaatcttggtaaagaaaacttcatctattccaagtgcttgccccttctgcgaaagaggcatctctttataattcatcctctgtactacaaaattgaatctaagatatgatagctctccactatgtctgagctttgccgcatattccatatttctctttaagatatcaaacctccacctctcctgattttttcatatgtctcaggtgtcgctgcatctatagagactgtcatcattatttttgcatcagtatgttctctaagctctttccatttagcaggtgtgaacagaagtcctgtcagaagtctgaaatacttgacattcttcatagctgatcatcataaatagactgataagcttttgtcatcagtacctcaccatcaccagccatgatgagaaattcacatccgggtaatatctcctttctaaatgtgtcggcaaataccttgtatttttctgatcttcatctctagcaatctaatctgaacgacatgtaatacacttcagattacaagtgtaatcaaaaccaactaatactgtattggggctatttttcaaaccttggatatggttctgccagattgtattgttcacttaaatgtcttcctacaaacaatggacacatatctgtcctacaaaagaatatgtcctgtttacatttgacagacacataattttatgtatatttgagttccagagagcatgaaactttgagtattaacgatatatcccagactgttatcaataaatgtgctgcacaacagatagtattgcctgctactacctattccgcatgatttaacattgtattacagttaaaatcatacacctttttttcaaaaatggtctgtctaagcatcatactagggtaagacataaagtcataaaacttacaataaccttattataaacaagacctttgctttccaggaaattgatttatcatcattttttacaactgtaacaataatgaagtaatctttccaatcaataatatcatttggcttaacaatctggtaaccaaaaagtttttcctctttaggatttgagtcaataacttttctacatcaaaccatttattccatcgaatgaaagcttcccctttgcgtccagctccccaaattagaataggttttttctccgattcaaactgaatcatctaaaacatcgaaaaaatcttcttcataaaataatcttttccatatttatccaagcttatctaagaatttagttttagccgatttatcaaaatcacaaacaataatagcatcaaatttgtttctattaccctttatttcattctctgatataatcggcgctgaaattatcctattaaaatcttttggtgtttcattttttgatgcaaaagctagagatattcagtttatcgaaaatatataaaaaatcttttgatactctgttaataccatatatcgcataagttaaattatggttcatatcaattcctctctaacgccatcttagtatttcatccaataaagaataatacaattatctccaacctttttcgctaacttttgctttatcctgaatagtcatattgaactgtaactattattaaatctggatctggaagcttttcagttggtctgaaaacctgtacatctggattacttccggctttattatcaatcgccccaatcaaattaactttcttttttttaactgctttaccaaatgttttccaagcattcctatgccatattcatgactcttttgccagaatcctctggaaagccatctgatattctgccatcattttccatcaacgaatccattcatccattatctcccataaaccatgatacctttcacatgtcttctgaatcgctctgttttcatctgatagaatcagaatctgctttttataatcaaaatcacttactactggatgctttttttacagccgaagaaacagcctccaaaaacttgtagccgtatctctcgtctggctctaaatacatcccctgccccattcattccaggcatttataaaaacaaatggagatttcattttcctggcttttactattatctgagtctcaagtgttcaaaaagttcagggcttcgtccgtaaactaccgaaccgccatttctctacgcggtgtatcatcaagcctggaaatgctccaagacactgtccctcttcagtcggcttgaatatcattttttcacagatttcagagtaatcaatagctgacattacacccttgccattgtcaaactttcctgtaaaaaatctgctcattgtatcctgaggttcctgcaaggtctacatgataaactttttgtcttgtaatctctagtattggcaccaatagaaaatataccatctaatccatcacttcttgctaattcattccaaacatcaagcatctcttttacacgagattttatcattcttataaaacataaaaaccgggctattccctaccttgatatatctggatccataaaaaatggtcttaaatactcataatggttatccagtcctgcttactgcaataatcctgttctagaagtatcccagaatcatcctcgccagaatattttctgtcgaactttgctgaccatggatttccttccccctcagacattttactccaaaaacgaacccagattcatttgcccaagagaagcaaaatggcatgtcgatgtctttccaccttaatagatttctgctggtttttcaaggattttttcgccatctttgaaataataatgatagatacacattccatcaatactatattttttcatgagattagcctgctgctgcattacagttttatccattaaatcatagtagttatgattcaacggtacatttggttgctcatgaccatcaaacgcggtcttgcagccttaacagctacccagtctgtaaatccctctccccaccatttatcattttcagtactctgtgatattgtggaaggtacatagcaataattctcattgacctcctccaattcttgtaattttctttcagtatattcagaatcaatccatttctcttcaactctaaaattttttcttctggaattctctcatctagcaaatcattacaatactgtcagcagtattaggatttgtcactgctatgacacataatcaaattccatctctagcaatttatttacaggaaacatgctttcccaagatttataataagaatactgccgatcaacccacccagtgagcactagattttttggaaacttatcatgtatttcttctccaaatacaccagcaccgtaaatacaattcgtttaccaggtatatttttcaaacggatatagtccaaaaaaatcgctaaaatactcatatccgcccataataaattttgaatataagccagtctattttcttttgtatgaatttataatttctaatgctagtagcaattgagtgtaaaataaaccccctcaataatttttgatcaactaccgtactttttgtatgtaaatgattgcaagatgatgcttcttgacgataaaaatacgtaacacgtgtgtaaaaagcgacacgtttagcactaagaagactgtatatcgtacacccccaatcctctccataacgaattctcatatccattttcataaatgactcttgaataatcaccttcgaaaaaagaactggaaacaaaacaccacctaattgcatttcaaaaaagcgtggtttgagaaaattttccaaaacctcaatgcctgatattactcctgaaaacttgagattttcttccatattttccatcctgataacgctgttgaactccgaatacaatatcggcacctgttttagattgtacctccttaaaagaactacagtatgctgtgacaaaatcatcagcatcaacaaacatcacccaatctcctaatgctgttcaacaccattttttcttgcagcattctgccctccatttttttgaatatataacgaaatctcccgtcctctgaaatattcgatggcaaatgtctgctgttctatcctttgacccatcatctattaaaataatctctatatttgaataattctgagttttcagactatctagacattccactaaatttcgttcaccaatatatatgtacaataattgaaatcagtttatctattttcctttccaaataatatccgctatattaacatttttctatatgcatgtctgatcttattgttttctattaaatttcaaaataaatattattgatttttggttgcaaacatacattttctacatatcacacttcatctaactcattgttcatttttttgataatatttgtcattacctcagaatgctgtatttctcatatgattctgtattcaagttacctaatacataatccaaaccgaagtcattacaacataacaccaatgatccatctggcaaaagcacattatgatttaatactcttgacctgctgcaagatattttccctgataaatgttttgatacaagtttattattgtcatttccaaatttcccgctctgtcactcatttcacaataaattttcaattttcctgaagtaattgcgttactttttcactaggttcaaactgacaatttgcccagtcaaaatggtgtaccatcaagtctttttgcagcaacaatcttccttattttactcagatattcatctgtcactggaatattggcataaccaaatctatcagttgtatgtaatactactttttcaaatggaattttcaaaattttatcaataccatcttcatctattccttgcagagtagtaaatagtgccgtttaaagcctttattttagcgtattccatcatttctatagcttctgataaaaaaaaggttcaacaaagcctgaccagtctaagattgtattctccggaatcttatccatgaattgcataaaatcttcaagtgtcatcatggattttctatgattataatttttataatatctatcagcaacaaactctgtggacaaaacttacagttaaccgcacatccgatttttggagtcacctcaataatcgggctattaaacctagtttctcttcgttatctaacatcaaaatccattcagtaaagaaacaatctcattaattcctcttctcttaagctattttcaatattatttttaccatgctgtaaaacacccattactacagatttctgacctatagcgttattaatttttcatagcttaaaacattcaagtcatcaacaatggttggttatttttaaactagtaacacaaaacctgaaatatttatgttgttctgtctgcataattttaaaactattcgtcctactttgccggcgccatatatacctaggctctggtaaatttataatctcatttatatagcatgctaaattatccataaaagtacctaaatttatttaaacaaacatttaaaccaactcatattaccatgatgaatccaaaaagttttatctgttaccttaaccttccctgaatgttgatttttcccttgaaaaatcataggatagatattcattccatccacattttgaaacttattattaatttctattccatattttattaaaactttcaatgaatgagttccacagcttgttttatcaacgcttccatcttgccttacaaatttacaatcatcataataatcacgtaattttcttataatatccatattaggtacgcttccgaagccagagccaagattcattgtcaaacttccatctatgcacccaaaacatttttgaaataatagttgatcgggctttttaattaattctatatctgtatctaaatatatacctccatacttataaagaacgtcaagtcttaagtaatctggaacaaacccccaaatttgtttttgataagcctgatacatatatttattctttttaatatcataattgctttcattccactctataaattcataatcagggcaaagttttttccaattttcgatgtttcttgtgatagattcgggtttatttccaccaaaccaagcatagtgtattatttttggaattattgggttatcattctcttttgagggagctagatatgtagagctttcaagctcgacatccgaagtttcatccaaagaagcaacctgaatatctacacctgataaaatattatttaagccctcataaatttgttcatagtaaatacttgttattagaataaaaattttatcaggatcataattcaaaatatcttctgcagaaattattgggatatctttaccttgataagagacactacctcccacttttgagcgattattatctgcataagcaatcagattatcttctaacccccaaatataaaagtacattgctactctttgaccttgaaggccagtaccaaagcatattactttttttccttttatcagttcctttaactgatgaattgacattggtttgagtcttatcatatattccttctctgctctttattcattttctattgtaataacatttacaaactaacaattttttgcaaatttcaaatataaagcataatatcttttctagctaaaataatattctctactgtacgagcatacacataatagttgctcataaaatcatattctttatcagtatcaggagcctcaaaaacgataactttaaaaggccatcgttttaaatcacatgactgtaatatatctatatcaagtccttctacgtccaaaaaaagaatatctggagcctcatcaaaattttcactcaatatcttattaatcggttctacctcaacattaatctcttcgcacttatatcctctatcgattacttcattagccaatgatttcgagaatgttgaatgtcccaaaagattaggaaacatataaaatttcgcagagctagaactgatgtccccccccgctcccatttttaaaagtttatcttgtggtctataatcttctatcaaatcccagcaagtaggattggcctctaccaaaactcctttataatccggcatcgttgaaaacaattcatttaacagataagaattgtttctaaagacaggatgacatacacctatttctaaaaacttgactgatttgagagcgatttgctgaatcagcgaaaataccaacaaatcttcgcatgatttaccattaatttttggaactacatgtccagatttaagaataatatctaccaaaggataaataataacatctatctgtccgtggtcgaatggtttaatctgctctaatatttctttctcgtatattgcataaataacaactaacactttattgctctcaagttcaagagcatcaggtccttttactattaccccattaatagtttttccaacatttttttcagttccatcaataacataatccatgtcgaaatagtcttgtctataatgaagacgaaaaagcattcctgttccccaacctatcactttactatatttcgattttaattcatgattagttatcctactaaaatatctcatagaaatcatttccttccatatttctatctcttttattgtaaacaggcacaaaatattaaaacaaattatacctttatatagtatatttatttttttcttcttgaatatattttatgattagatcacttattttatcactggcatctccagtcttaacccatcgcaactgtttagtcatttgctctgtttgttttatgtaattactagtatcaaacgaagctattttatcttccatttcccgattgtttctaatcacaacaaacggcacttcaatatcaaagtccggtgccatctgcttattacttgttatagtatcgtcatcatgtatctcaaagcaaaggttcccacgatctcctacatactcttctatatcgtccatatatagaaataccggtatgccataggctcctgcctcaaatcctactgaactgaaatctgttactacggcatctgaggctgctataagccaattcgtatcgtcctctttgcttacatctattacacttggattggagacactttgggttgcagccagctgtggatgtaatttttcaagtacataccattctccaccaaatttctcatgcagagactttttcaacagatttatatctatagaggtctgctctgaaaaaacctgcctgtttattttcattcctgactctctatatgtaggagcatagagcacaatcctactatcagatggaagcttgtatttttttctgacagaagccctaacctcttttctatcataagacatcacatcttctctcgcctgaccgagctttagaatcgtgccatcatacaccattcctttaacgaaaacctctttcgaccaatcattacttactataaggcgatctatcatatctgaatcattcttgctgaccagataggctatcctagaaaatttatctccacgccatagtcctattggcttgaagccaacacatccatgccaggtatttatgtaatactgttctctcctctttaccgtccctaatggctttctataattatctatccaaaccttcgaccgtgtcagccagtaggcactgctccagagcgtatttggaacctctctgatataatctggaaaagtgtgctcacctggcttatttacaagccagacgaatttgagacttgggtcctctttatgcagttcctgtactatgtacttaggattgcagccgaaacctcccttaccctcgaaggtgcagacacttatcagctttttatcgatgggaaatatcctgcataaatagaaggcagcactgtagaatgctgcctttaattttctataggctatgtattggcgctcattcatagtccacacctttttttatgtgatgcttcttcatatacttcttctgcttcccataaaatggatagtcgtgggctgcctggccattgtgaaaagtcatgtaatcgtcgccgtagtgctcctcaagcactgctttatacccaacgggtactggaattttgataaactcaaatggctgatagatgactgactcaaagttttctatcggaatagaatagtccgcgctcgtattgccattgaacctgttgaactgcaagccagccctgctgcatccatcgtctgctccatacatgcctattatagaatcggcgagaccatagagctgcggaagcacatcttttgaagtatctatctctattcccatgacatctttaatcttctggaggatgtcattcctgtcctgcttcgaagatttggcctgctgccacacaccaatcccagcaagggcgagtgccagtagtctgctctgcagcttctgcgactcgggattatcaggcatccagtctataggatatatgtctattcctgtgatatatgggcagccacagaaatagtctgtatctatatgtcccaggtctgcgtacgaatttccatttgcaacctctggaaaaatattcatacggtcggaattccagaacgacctgaagtagagtccgtcaggcagctcactagaaacaacactctggaatttattgtagtcttctctcatgaaggctatatcgatgtcgtcatcccacggaataaagcccttatgtctgatggctccaagcagtgtgccaaaatgtgcgaaatatttaatctgatgcctctggcagatatcatcaattactgaaagaatcttaagctcggaagcccagcagtgtttcatttcagacgtaactaaaaagtcgtttctgacttcctctttataaaaattctccggaacttcaaacttcatttaaaccccattcttaagctttcttactttcacttatttttataagcatattttttgtcacttgtttttgaacgctgtcttcttatactcgctgtatttttctatgatctcggccatgactatcgactcctttgcagtaagcttgtaaccgtttctggaaagtccggctatttttctaatgaattcgctgatctcatatctgagtccatcgcctcgaaatggcggatcatatgactcgatcttagacgcgtcctcatacctgacctcaaaatgcttcataagccaccacggagactgcgcgagtatgtatcctttcgtccccgaaatgacaagctgtccttcggtcttaacggcaacccctgtcctggcagatgccattgccctgtcataatatatttccattttatcatatatatcgacaccattttcatcaaatatactgtgaaaggaaatatctctgtaattcgttccgagaagctttattatcggcaccagaaccgacgggccaaattcataaaaagcacctccatattttgcatcggttctctcccttgaatctgccgtcgcaagccttgtgaaatcagcctcgatgtctacgatctcacctattttaccacttgtagctacatttataagttcctgaaaacccggactatacgctgcctttacagcttcaagaagcactaattcttttgattccgcaagattatagaggtcctgtgtctcatgctttgtaaaagccagtggcttttctgagaggacgtgtctgcctgcgagcagtgctctcttcgcataatcaaaatgtgtctcgtttggcgaagcgatatagactgcatctatattttcaaggaatttctcatagttcttagtttcatatagaagtgatggaaaactcttctgacacacttccagagtctcagtatttttatctgaattgtaggctgctatgatctgtgcgccgctgatgtatttcgactcggacataaatcgaggagccattcgcccagtcccgacgattccaatccgaatcggctgaaacatatttgaccttatcgccgtcgatgagatatccggagtacgcggcagatagaccactttgcagaactgattcagatagtcgaaagtgccaacccagtcacttccgactgtgaaaatatcaacttcatatctctggatgtcctctatcttctgaccctcatgatcttctattataatctgatctgcgaatccagtgtcctttacatgctggactctcgtaagcacatcctcgacaacatttatttttccacggttctcatcgaagtgctctgaggtgacacctacgatcagatagtcgccaagcgcctttgcgcgtttcaggagattgtaatgtccctggtggaacagatcgaatgtaccgtaagttataactttagtcatagttatactatctttgattctctctcttttaaatatattttaccggcaaatcctgatcttttatctcattataaataatatacaaggtgtttagtttatcagtatttccagtattcctgtaaatatccatcaacttttttaccataccctttttatccactgtatcatataccaaaaaagcgctgagtgctggtaaagatatctcaccatcagctatttgcgctgtaagttcttcatacgcactttcttccatgccaagctccatgcgacgcagaagaaaacgtgtctgtatatatttgtgatgcatctcatcataagtcttgcagtcgctaaaaaaatttctgctgacacctgccatactttcaccttcgtaaattttatacatcacaccatcaataagaagatctgtattttttgcaccactgcttatgtatgctgattaaccgcattttcagcaatcagcaggttataccgcggaaaaaattccgcatttatatataacggccgcatatctgtggtcaaaaacagtaccttgaaaaaagcacaaaataagtcagacgccctgcccggattctgaacaggttcgtcacaaagatggaagccctacagagccgtatgatgtttcttcaagctttgtttttatgagtcccagaccgtagcatctcttgctgaggctgaagctcctttccacttcgatcctgtctgtattgtctttatattcaatgtgctttcttcagcactgagttcctttgacggtcttccgagctttggccctgagagccttatgccgttttctttgcagaactttctgttttctcttgttctgtagatctgatctgcaagaacacgctccggataatgtcctgtccgtgtttgtatgattccaggctctcttaaggacttcggattcattgtatggatcaaaagttatcttttcgatccttcccatgtggtcctcatcgatactgaggtcgaacttgataccgaattccacgggagatttcgtcttgcctctcactataggtctgatatacggctgtgcgatgcttacgatcctgtcggctactttatgcgtctgttgtcatacatgtatttctgctgctcatagagctttctgatcgtatctagagcttttcttcttttggcagaagtgcatatccgtctgatatatatctgtcgatgtagcccagatcgcgtctcacatagcccagctgcttgcgtactgtcgctctgatctttttctttgagcgtttcttgcatggcaaggttgaggtaatcctttcttcctccctgcagtaagtacgcggtctgaagtccgttatctccgcatatcggaagatgatatcttcaagtttttccctggcttcgttcagcagtgaaaaatcctgtggataacgtatgtatgagggtgcacatgtcgcatcgatttgagcgttccgctgtttacatctttatcagcagcttcaggactttcagtcttgtcaattttcttcctctgcagcagagccttcggagcttccgttgtcgttctttcatgcgggtctttgttctctgaatcctgcttcgctttattttcttcagcggatttcattcatgaactgactcatgtcgaatctatgcgctttctgaaagctacaagtgtgctcgcatcaaacggcggcgtctcctgataccggagccctatgaaatactggagatacgggttctctgtgatctcctctacagcctcttgtcagagaagcctaaacgtttctggatcatcatgctccgagagccatcctgcatggctttgcgacatttcctgtatcactcttgaaacgggaagcatacttttcttcgtattcatcccatggaatgagctctgccagcctgatccagcggttttccggttcatgtgcatcccgagcggctgattgaaatcaaaaaaagaatactctgacttatcttttgctttatacacgattttaatgctccgagggtaaaatttttatcagaaactgcacgaaaagatgaatgaaatatcaaaatccatgcatctattataccctatgagccagaaatcgcgtattttaggcaatttttaaagtttttttgctaatcagcaagacctaattatatctctaactttatcccattgcctcaaagtaaatgacaattttgcctgatcatgcagaatattattcagattgttttgttcttcatcgtatttttcaaaccatcctttatctgaggcaaaaaattcaggatactcattgatgcacttctcacgctcagcggcgtaatacttgtattttgcatatccgctgttatggatcacccacggttctttctgggcaggaacaacaactttatatccagctcttctcatctcaaacgattgagagatatcatacatgtcaaaatgtgtaaacagatcctccctccatggtatatcatactgtgttgcaatcaatagcccatccacggcatcaacttccacattttttttgttgctttccctgtgcaccagataaaatgaaattcctggctctctgacatccaataatccaaaatgccaatcagttaatattgacatattttttccaccaaccatgcctatgataccaatttgagggtcactttgaaaaacagccagaatatcatataagaaattctggtttctgataaatacatcctgatggagatatatcttataccttgcattactgctattcattgcagcattgtaggctgagcacatcgagtcagcttcctttatcgaaataacatctatatcatatccttccgggacattcagacgattgatgtaataaacacattcatcaaaatactgatcattattctcacatatgataaaagcaaattcactttttctctgcttatttttattgaaaattctttcatgccatttcttatatgaatcgcaaaaatcattccagtatggtttatccccataatgagattccaaaactttatcaaaatccttatctattttcatattattcggattcagctctgacatctgctgcctctttttagaacaagtctaaaattaccatctaagatatttttatcatttcggaaatatctaatcatactgaactggtcagcataaaatctaccgattttttcagtctcatcatcagaattattatctgagattacaatctcaaccagaccccttttaaattcattctgcttaataatagactcaattgtaagtataagacatcctgctctattaaatgttggaatacaaatactgatcaacggtttcctactgccagattttgtcaaaaatggactgtcagaaaaatctttgacccagtctgatgctttctttataataatccctgattcttttgctttttttatgtatggagccagcttcacatcattccctgaaatgtagactccaatgtgtttaaatagagtagattcagctccattttcatttacatatttaataataccttgacatttaatgcaaaacctgtcaattactgcatttacttgctcaaaatctttcctgcgggtgtacttttccggaatatctatgatcagcagctgagtatccaaatatgaaaacatttgctcaaacgcatagagcactttatcccatacagaagaatctgaatcataatctagtacaaagtaatatatttgtcctccagctagtttcatagcgtccattgcatctgcaaattgcaaaagccgggaggcagtcccggcattaatatcatttttcataatattgtctctgctgtaaatatgtattctaacgcaagtaaatcatctgtatctggctgatcaaaaagttctgacagattgttaatatatttttcttcttccactgacggttttttaccaattactgatttaatattcttaatagaatacccacttccagaaatcagtctggcagcttcattctcagtatagaatctgacggtaccattctttattattccatcgtcactgtaagtaaacctgtcatctgcaagcagtgagatgattatttcgtaatatctgatattcggaatgctgataataagacgtccattcttcttcaaatatttagatatactcctcagatatttgcccggattatgtataaactgtaatacatcactcaaaatgatataatcgaagtaaccctcgtatttttccccaaactctgtagtctctaaatctcctgtcaggatctctccaaaggctttagcatatgatgctaacgtttgattcggttctactcccttgtattctgcatttggatattttgttctgattactgcagcctgtgtacctatacctgagccaacctctaaaatataaaggctcgtacccctctttgctctaatttcatctacaatttttaagctgtctttgaaatatctggtaatatcgaatcctatcttatcaataagtttctggcaattcttcttcaggaggtcatcataatcctgtccagatttcagaagttctgcaaatgatctgttgccataatgaaatacaaaactattcgtgcagagcagattcagtttttcctctttaagtattctgaggcccaggtctaaatcctcgctgttacctggattgaatctctcatccaaaagtccgacaatatccagtgttgttctcttcaaaagcagagaaaagccaataaggaatggtttaaatgcatagggaaaggctcccggtatattaacctgttctccaaactgaataaattcctcgacactgtttgcctttacatctactgcctgtccatttgctgcataattagtgatactcccggtactgccaaccttatcactctcatacaatcccatcttaagccagaagagtgcattggcaggaagaatagtatctgaattcaggagatagatatcgttatccttctctgctgcgtttattccatcattgcagcctcctgggaaaccacgattctcgtgattttctataagtgtaatccagtctaatgacttgagataatcgagacttccatctgtagatgcattatccacaactataacctggcatctgtcaagcggtatagtctctttgatgctgtcaagacactgcctgagatagtccttcgtgttaaatgaaaggataactatagatgtctttggtacggtgatgcctccattctcgagagaatctataatctttttgataaaagatgcctgatccatctctccattctttttagcgtaatactccgcctgatacagacagataagctcctgtgctgtattgacctttgaataataatcacccagagagacaaagagtgaagaactccttgggttgatcaaaaatcctttattcagatagtagagttcattttctctatttccaagtttgttatacaaaaacgcggcagttatgcagaggtcctcagagagatatttctccggattcacttcctctctgagctccgtcaacatctcatcagcttccttgtaaagtcccctttgaactatcgttccaaactgggctgccatttttttctttgcttcgtccattagttttctccaattctatatttataactgtcctgcgagttccctctttttcttctccccatatgcactgatatatgtcttcatcgtctcagtgaagggatcatatagagcggcacattcttcaagtgccttcatgtgctctacaggagtatgcttctgttccgagcttgcagtctctataaacctcatcgcaaactggcactcctgcggaagaatcgtaagatctcctacaaatagctctggcttatatatattcagataaaatgtcacgcagtcactgcagtattttgtaagcaatgcagcaactttaccgacatcatctatttttctcaaatcatgttcctcaagcttcagtctgaagtactcgaatctgatatcgttatcgtcttctatgatatcagatatcgccttaactgtccttgtcctttcttcaaagtgctcaaccatcagaagatcagtggctttcttccatctgataaatggaacatctttaaaaagctgtaacagatcgatgtgatcttctgctgctatatcccagatacatggatccatatcaaaaaaatctataacacagtcgaatatcagctgatacatatccgaaagcttagatctgtcaaatctataagcatagagaagccgcatatacagaaggtatatatcatccgtactgtctgtctttccatatacttctacgagtttatcaaaagcctttttatcatctttttcagcttttcttgcatcatccattaaaagtttacatggaaaaggatttttacatgcttttgatgcatattctacaaatttttgattaaaatcaaaatgtgaaaatgcataagttagtccttcacaaaatgtaactaccggttcatactgatatgtcagatcaaatctgtcaaaataatcgtagagtacagatatatctccacatctgactccggccgctatagccctgctgatacagtaaagaatcctgttctggtcaaagatgtttccacacatgaacgtcatatcatctatactagtatcttctgtgagactgatcttatcgtaattttcaagatattttctggcatagtaatatacttttctgtaattctttttttcccaataacctattacagcgtaaaaacataatccagtttctgctttttcggtatttctcatatcagaaagaaattccttcagatttgaaaacaatttatcatactggtatgtttgaatctccgaaatcagaatcccctcataaaaaatacatctgaatttatttgtaagttcatcatctcgattcactatcatttgatttgaattaagacagagctcttccaaagcattgtaatcatgtgtactattatattcctgaaccagttgaatcctccaatacggattatatggttccttctgcatcatttcttttaaaagcggaatattcctattggacttttcaaatagtattttttgatctgtaaaaacatagccataatggtgcacaaagcaattgagaccttttacttttccactaacaggctgcggatactcatgaatttttccatggaattccaagccactgactttttttactattcttggattccaagcatcagtgtattttttcccttcataatctttatagtttcttataatatatttggcgattccataactcttatattcacctgaattaaagaaatcgactatatcatcagtgttctcaaaccactcatcgtcatcgacaaacataaaccactggcctgtgcactctttaactccagcatttctggcctttgcaaagtcattgcaccacttgaattcaactactttgtcagcatactttgaaagcagtggcttagtatctggaccacagcctgtgtctactatgacaatttcgctcgacattcgattcctaatagtcatcagtgagtcgagacacttcaccatctcgtccttattccttcccgaacagagaagagagattgaaagcaatggctgtgtattttcttttttcataaaacacctctgaaaaaacaaagacgggagtccgcaatatacggactcccgtctgccgcgtgtgcggtctgtgcactaattttttgaaataataatgtagatacgatacctttgatctgactattactgcagaagtgaaagaacaccctggttagactgattagcctgtgcgagcattgactggccagcctgctgaaggatattgttcttgctccaggtaaccatctctttagccatatctgtatcacgaatacgtgactcagctgactgagtattctctgagatgttgtccaggttagcgatcgtgtgctcaagtctgttctgaacggcaccaagtgaagcacgctgtgaagaaacgatatcaatagctttctgaatagcgctcattgcattaccagcattctcataagagttaacagaaagcttggtaccatcaattccaaggccacttgtactcatattaccaatgctgagaacaatagactgacctgaaagagcaccaacctgaaggctctttccagtgaaatgaccatcgagaagattcatagtgttgaactgtgtagtagactgaactcgatcgatctctgatgagagctggctcatctcgagctgaatttctgaacgatccttcgtagtattagtatcgttggcagcctgtgtagcaagttcgttcatacgctgaagcattgagtgaacttcgtttaaagcaccctcagctgtctgaactactgatacaccatcctgagcgttagttgaagctctatcaaggccacgaacctgtgatctcatcttctctgaaatagcgaggcctgctgcatcatctgctgcacggttgatcttgtatcctgatgaaagcttctctgtgctcttagctctggcatttgttgtgatgcctaacattctgttggcattagctgcctgcatgttgtgctgtactaccataataatttacctccatgtaataactccagaaatttctggaatcggcaggaaatccattccctgtcttgtaacaatgtcttcggattcataagacctctgcgccgccgccctagtgcacataaagctttaacgcttcgataaaactcatccgattttctttacacttttattatcgggggctctcaaaaatatataacccctttttgaaatttttttttaaaaatttttacggatttattaatggtaaatgctgcgtccgtttatcgtaagtttaggggtctatttctggtaaaccgcgatgctctcctttggcatcgtgatcgtcccatccttctctgtgatctgctgctttcctactgtaagaactcccttcaatttattatatccgtctggaagatcagaagtctttagtgttttgggtttatcgctggtgttgtagacgatagcgagtggttttatctttgaatcgtctgatgtctttgtgacaatgagaatgctgtcatttgatgcgctttccactctgacttttcctctcgcgatagccgggaacgaatttctaagctttatggcctgctttacatagtttaagattgaggtttgggatttggcctgcttgtcctcgggagcgtacttcattttgaagagttccatgtccttcggaccctcggtcatgccttttgcgccgctgtcagccgtccagtacatcggagcgcgcttgttttcgtctttgccgctgcccttcattccgatctcttcgccgtagtagacgaaggcgctgccgctcatcatcagattaaggccctctgcgaattttgtcttagagccgtcgtcgcccggatagtagccggctgagcgcgccatatcgtggttcgtgtagaatggtgcctctattcctctgcctgatgaattcttcgctatttcgtcctgggccctgaccatctcttctccgaagctctttgccgaggtctggccgcttactgtctttgcaatcgtgccctcgtcgttcgcgaagtcgaagtcaaagaagctgtcgacgccgctctgatagtatctggcatactgtgtcaggtcagcccagcactctccgactatataggcgtctggattttttgctttgacttcgtcgtttaaccacttcaggaatgcgatatttttcttttcatttcctgtgtaataatatgtagtggcgtcgagcctgaatccgtctactcctttgtccagccagaaatcggttatcttttttatctcgtttcttacttctttattgtctaggttcaggtccggcatgccttcccagaactgtgcctcgtagtaccacctgctgccgtagagctgcttatagccgctgtcttcctccctggaaaaattgtaatattttatatatttacatttctcagggtccggtttctgtccgtcctttaagctcttcaaatactctgctgcctttttaaaccagggatgctcgaccgacgtgtggtttaatacgaggtcggtgataagctttatgcctttcttgtggcaggccgcgacgaggtttttaaaatcctccatcgtgccatattccttgtcgactgccatataatcggagacgtcgtatttgtgataggtaggtgaagggcagatcggcatcagccagatctggttgaagccaaggcccttgatatagtctagcttctcctcgactcctttcaggtcgccgaccccgtcgccgttcgagtcgtaaaatgatccgacaaatatctcgtatgtcgtgcggtacttgtcatccgggacattttccttatttttgccgttgatgctttccatataggaaacggcttctgccttttttcctgtggtcctgctgccgcagcctgtcagtagtgtcgacagcgcaagcgccgctgtcaggaccgcgcttaaaattctcttcttcaaagcaatcctcctttgcctgtcttattttataatatttctcttaaaaagtgtgccgcttcgcaaaatctgttataatattgacacgaaacgtaaaaaatggacataggagatcttactttggcttgcaaatggaaagccgtcctctttgacatggacgggactattaccgacaccgagaaaatttacaactatttctggaacaattgcgcgaaggcgcttgggatgtatgatttcacctatcaggattctctcgaccttcgctccttaaatcacgatgactcgaaaaagctcctcgaagagcgccacgggcagactgtggattatgacaagctccacaagactgtcggaaattgcgtcaggaaatatctgcaggaaaatcctgtgcctttaaagcccgggatcatggacattttaaatgaatgccaccgcgtcgggattcaccctgtcgttgtcacggctacgaatctcgcggccgccaccgaacggctcaaaagcgccgggctttttgaacatttcgacgatgttatcagtgcccacgaagcgaagcgcgggaagccctaccctgacccctatctgatggccgccgagcggctttcgctcatgccttccctgtgtcttgctgtcgaggactcgccgaacggctgcatgtccgcgatcaacgccggcatggacacgatcatggttcccgacctgacagaacccgatgccgcactaaaaaagaggctctttgcagtcgcaaagagcctcgcggatatcattccgataatttcggggtgatgatttcaatatgtagattcgcggagctggaaatatacaagcttcgttctcgcagtttcagtatggatatacatgaggattaaaatcttaaagaataaaaatccagtctcaatatagatccgctacacttcaagaatattaaacgcttgatagcaggttttaatataggcttttgcggagccggaaatcttaaatgcattgtagaatattcacaagcaatggctgtatattaaaagcttgaaatgaactctttaagattttttatcattatcacattcatcttgaaaataactaaaagctctttaagaaattaacttcctcccagctctatattgatactggaagaaagccattgtattaatttcaccccggaaatggctatactgaaaacgtggccaccagatatacgggcagacaaaagccagtgcagacacatgtggctttgtatcaagaagcagcgctgcagatacgggggccttttttcccaggaagcagctccgcagatacgggggccttttttcccaggaagcagcgccgcagatagggacgggctcgcgaccttaggatttttcgttgtgagcgtgtgcgctagctgcggcctgggtggccacccgcctgaaccataaacgcatgaaaaccatacattggccagaaggccgcaattaggcgcgcacacgcgaacagaaaaatcctacggagcgaggccggccatctgcggcgctgcttcggactaaaagacataattatctgataattctaaaaatgggacaaaaagagcggttcgccgtttccgctctgacttcgtccttcggactcgtcaatcgcggacggctatcgcatgggcggtttataatgctctcgcttcgtcctacggactcgcgacagcataacaaccgctccaaccgtccctgctgtccctaatagagaggggaagggtagatgccttcctcgaccatttttttgaaggaagcctgtactgccgggacgtcttccttgtaggtgaggccgtaccaggtgtcgtgtgatttcagaactttgacgtcgatctccttcttctcgaggagctcgccaacgaattcagggatcaggaactcgtccttcatcggatcgccattgcctttgttaaggaggttgtcgaggaaatcctcgaagcccttctcgagcttaggcataaagtcaggagtaaatccccacatgttcatggaaacgagtgagttcacgtcgagtacgccatgctcacctttggctccgccatcaggaagcttctcgatgtcgtgtgtctcgtcaatgcctgtcagatagccgtcatctgatgcagcgcatacgccacgggtaacggttccgaaatcgcttaaagtattctttaggaggaagccagccatgcagtagtggccctctgagccgtcaggtacgttcttcaagtagtctgcgactacgcggaatgcttccttgccatagtagtcgtcggcatttattacagcaaatggtttgtcaagaagagtggaagctgaaaggacagcctttcctgttccccagggcttcgtgcggccctttggaagtgagaatccgtcaggaagaagagtaagggactgctttacatagtagacacggacattcttcttagcggccatcttctcgacgcgctttccgataatatccatgaaatccttctctatctcatctctgatgataaatacgatctcgttaaatcctgcctcgatagcgtcatgaactgagtagtccatgatgatacttccgtcttcgccaactggagacaactgctttatgccttcaccaaaacgtgagccgataccggctgccataattactaatgatatatctttcatatttatttcctgaaaaacagcagcgaatgtctttcacattcgctgtctgattaaatgcttaaattataattagtttcctggatatgtgatgactgagtcgatgtcgtagtccttgagtctctcgcggcctttaagtcctgcgagctccataaggaagatcatctttacgactttgccaccgagcttctctacgagcctggctgctgcctcgatcgtgccgcctgtggcgatcaggtcatctactaaaacgaccttctggcctggctttacggcatccttgtgcatctcgatagtagctgtgccatactcgagatcgtatgtctgtgatactgtctctgcaggaagctttcctgcttttctgataagcacgaatggcttatgaagattatacgcaagaggagttccgaaaataaatcctctcgactcggttccagctatcacatcgaaatccacgccgtcgaggaagctctggagctggtctatagcgagcttgaatccatccggatccttgagcactgtcgtgatgtcacggaacataatgcccttcttagggaaatccgggatcgtacgtacataatcttctactttgttcatttgtaagtatctcctataaatttatttggttcagcctctctcaaccctgtcctctactctcttcacgagttctgggaactgctggaggatattcgtcatatcctcgaagataaggctcttcttcgtgatatttgtagagagggtatcgatatggtcagccactgtctgataatatggcttcgactcttccatcgtagactgcagtgtagtcatatcctctgagcacttgtcgataacgccgaccatgttcgtgttgccgtcttcgatctcgccggctactgacttgatagaatctacgacttcctctgtctcattgatatgagtcatagaatcctggatagctgatctcgtatcgttgatagagttcatcagacggttgttgttctggttcagcttgtccatagactcgccgatagaagctacgagtgtcttgatgttactcgagagctcatttacctgatctgcaacaactgcgaagccacggccgctctctcctgctctggctgcctcgatagatgcgtttaaagcgaggaggttggtctggtttgcgataccgttgatcgcatttaccttgtcgaggatctcatcgaaactggactggaactccttgaatacttcctctacagtggagatagtgtcatttacagaagatgaagatgtgcggacattgttcatgttcttgtgtgtgtcatctgctgtagtgagcatcttcttaatgatctgctcaaagttctcagtaactgaggtaacttccttgaagcgctcattgaactgctccatggtatctgtaacttcctcggaacgcttctcaacctcttcgaatgaattcttaatatcgttcagtgaattcgttgtatcaagctcctcctgctgaagcttatccttctgctcgagaatgtactttccactgtcaatgacaggctgcatctccttggtgatgtctaacttctctttaacctcaacaggttcctgttcagtctgcttctttttcttgccgaacataagtgtttccctccattttattcaaatactgccataaccatggtctgattgatatgctgtcttccgaactgctcgccgcctccgacataacctgtcgaaactgctgtgccttcgctgaaatcgcggaggtattcgttcatgtagttctcctgtgtaaagagcgtatatctgaatatgcagtttaccgagagaatcagcgacggagtaggaatctcctctcttctcttcgcaagcgtatctgcgttgatctgcttgtaatcaagcctcctgcagaaactgatcctgtcgtttaagttcactctcttgtaacactcaatagagccgtcgttcttgacctctctcatcgatgcaataaaaagatcgtcgccaacttctcttccaagtggagaattcaggacatttccctctatatcgcctttagcaactcctgtctcctctgagtagacatctgtggccggcctgtaatcgagttctactacagcctttctcatcaggtccaccttggtagcggtgtgctcaatcggagaatcctgcaagccgtagatattctccatagccgtatatacgcggccctcagtattctttatcgcgataaacgcgcaggcgttctcaaaagtctctccgttcacacagaccttcgatggctgaccctcaggggtcccgtaaacagttcccccaataagaggaatgtcatcactggcaagctccatatgtacagtggagacgagtacttcctcgtcgttcgtgcagaattcaaatatgactccgttgtccttcgacggacggatctggtcgagagcttcgctcatatgaatgacatccgcaagaggcgccgtagccaggtgctttatgacatctgccttgacttcacatccgctcataagagctgtgactgtaaggccattgttctgatcaaccttgtctccgtgataccagatacccgaagtacctatgatctgcgcattgggatatgccttcctgagtccggccgaaacttcttcgagccacgcgtagttacagtaaaaaataatccctttcggacttcctgcgagcttttctgtgacttctgctacagctgcatctgccgatccgctatagctgacagctaactgacttttcactcttactgccctccttaactaatgtcttcccattgcagactcacacaacactattttatttttttaaagtgatattgtcaacctatttacataaaaaaagccgccagaattgatagatttctggcggttcctgctgcttttccggaaactgatttattaaattttcattactcgtgtgtaaaatccgaaccaaaatacttgattgagagcttctttaaggttccatccgagcgcatttcctttaatgccttgtttatcgcggagcgaagcgtgtcgttgttctgtcccttctcaagcgggattccgtactctgtcgcctctttggctgtggctgcgacttcaagtggtgcgctcggattcgtcttcatgtaatctccgaatgcggtcgaagcatttattgaagcgtcaacctgtttgtttgccaccatacgaagagtatcggctaaagtctcaacgccctttaccgtggcgccgtatttctcaccgatctcctgataggtggagccgattgagtttgctgtggtctttcccttcaggtctttaaagctcttgatatcggtgtttcctttttttacgataagaactgtgtggtcgtaggcatacggatctgtgaaatcgtatttttgctggcgctcctttgtgatatcgacgccgtttacgaccatatcgtatctgccggaatccattcctgcaaaaaggccgtcccacgctgcctcgtgaatctcagccttaactccgagcctctttgcgatgttctgcgcgacctcaacatcgtagccgacaagcttgtcgttcttgtcatggtatgagaacggctgccagtcgccctcgagacctaccgagatctttccagcgctcttaatcttggctaaatggtctgctccggttccgcttccgcaggcgcaaagcagtgttgtcgctgcacacagtacaaatgccaataattttttcttcatcttgcattttcctccattctcaaaaattcccgggttctctcctctttcgggttattgaaaaattcctccggagtgccgctctctgcgaccactcccttatccataaaaatgaccctgttcgatacatccctcgcaaaggacatctcatgagttaccacaagcatagtcataccgtcagaagcgagctgcctcataacagtaagcacctctcccgtaagctgcggatcgagtgccgatgtcggctcatcgaaatagatgatctccggatccgtcgcaagtgccctcgctatcgcgactctctgctgctgaccacccgaaagctgcgaaggatactgctttgcatagtcggccattccgacacggtcgagcatatccatggcttttctgtcagccgcgtcgcgtggtacttttctcgcagatgtgaggcctaaggtcacattgtcgaggacgtttttatttctgaaaagattgtaattctggaagacgaatccggtctttttctggatcgagaggatctgtttctttgaaatttccttcagatcgtactctgctttgtcaaacaccatctgcccggaatcggcattctccagaaaattgatacatcgaagcagtgtggtctttccggagcccgaaggaccgagaatagataccacatcgcctttatttacatcgaagcttatgccttttaagacttcaaccccgtcaaaggacttctgtatattttttatagaaagtaatgacatcactgcctcccgtatgctccgagctttttctcaccaaacctctgcagaagcgagatcagtgtagagaacagcaggtaaatgactgcgacttcaaggtacagcgccatagtctggtaggtcctccctgcgattcgctgcgcctggaaaaacatctctgtcaccgtgatatttgcggcaagcgatgtgtcctttaccatagatatcagctcattgccgagtgcaggaaacgccgtccgaaaagtctgcggcatgatgacatgccacatgatctgcccgtagttcattcccacacaccttcctgcctccatctgtccggcaggaacactttcaagggctccccttattgtttcggcagcatatgctccttcgttaatagaaaaaaccagaactgccgctggaaatgcctcgacatttactcctactgacggaagaccgaaaaatataacatagagctgtactaaaagtggcgttcctcttatcacccagatataaaatctgcagatctcccgcagcaccggaatctttgaaaattgtacgagcgccacgatgatagcgataacgagcgctatcgcaaatgagatcagagtcagcggtatagtcatcgtaagtccgcggtacataaggactgggaacgaatcggctatgaccttccatacgttctgcattttttactcctttttactcactccctcccagcggtgccccgcgagatgagtcaggaacagtattcctcttactattagttcaatgcacatggcggtccagactccgcgaagccccattctcgacgagagaactgcggccatcggaatcctgattccccacatgcttattacatttctgttcattgatgcaagcgtatcgccggtcccgcggaacactccgcctgctacgatcgatgcgccaaacatcggctctgcaaatgcctcaatacgaagcaccgctgtgccaagctccctgatatgtctgttcggacttaagattcctatcatctgcggtgcaaaaatatacatcaggactcctgcaccggacatgaccaccattccgcttatcgttgtaagccatccgagttttctcgtaagctcatgccggcctgctccgtagcactgcccgataagggttactgcggccgactggataccataccccggcatgtagcagaggctctctgcggttaccgcaaaagaattcgcggcaatcgccacggctccgagcggtgcgactatcgttgtggatacgacctgagctccgcccattataagcgactcaatcgcagacggaatcgaaattcgaaaagccctcttgatcgtccgccttatatcgtgcattttttctccggctctgggacggaggagcttcgatatttttaaaacatagatgagtccggtcgccgcagcgacagcctcggcaagcgctgttccaagtgcggctccctgaatagtcatcccgaaaccaaatatccttatcccgtttaccgttctcgtcggaaaaataaatatcaggttaaatatcacatcgagaatgcactcgagcactcccagaaagctgggaagcttcatatttccggcagcctcgacaattcccgctgtcgaatacatcatctgcatcgtcgggagtgccgccgcatagatcacaaaatactgcgatgctctcggggctacgtttttgtctcctccgagaagtaccggtatctttcctgaaaaaataacacagaccgccgacagtactatgcttataacaagcgccgtaagcagtccgatttttacaatatttctggcttccttctcctctccggccccgatcctgtgcgcgacaaggaccccgaagccgatacatgccgaagtacagatacctcctataagccaggtcgtagacgaaacaagtcctatcgccgccgaatccgtggctcccaaaagtccgaccatcgatgcgtcgatatactgcatcaatatcgaagagagctgggcgattatcgcggggaaagcaagctctgctataagcataacttcctcccgcctcgaaagcgtctctccctggcgcattgcagccagtagatttttacgcactttcattcaattttactcctgaaaaatcagctttgctaattatataatacattgtgtacaatgtaaagcgttttttagcaaactcccctggggtatcactggcggctctgtctcaaatattttttataatacaaaagaggccgttgccacgacctcttaatttttagtatgtagtatggaaggatgtatgtgaaaaattatttcttaagtgactcgaagccctgctcgaggtcctcgatgatgtcgtcaatgtgctcggttccgattgaaagacggatcgtgttcggcttgatgccctgctctaagagctcctccgggctgtcctctgagtgtgtagttgaagccgggtggataacgagtgacttgacatctgcgacatttgcaaggagtgagaaaagctcaagatgatcgatgaacttcttggctgtgttctcatcgcccttgatgtcgaaggtgaagatcgatgcaccgccgttcgggaggtacttcttatagagctgctgctgcagatggtcctttgatgctgccgggtgagagatgtactctacctcaggtctggtctgtaagtattcaactaccttcagtgcgttctgaacctgtctctcgacacggagtgaaagtgtctcaagtccctgaaggaagatccatgcgtggattgggcttaaggtagcgccctcatcgcgaaggatgatggcacgaagataagtagcgataacagccggtgctgtgtcctttgcgaatgaaagtccatggtaggatgggtttggttctgtaagccatgggtacttgtctgatgatgcccagtcgaactttccgccgtctacgatgacaccgccgatcgtggttccgtggccgccgataaactttgtagctgagtgaactacgatatcagcgccgtactctatcggtctgatataatatggagtagcgaaggtgttatctacgatgagcggaaggccgtgcttatgagcgatctcggcccacttctcgatgtctaccacctcgctgttcgggtttccaagtgtctctacataaagggccttggtgttatccttgatagcgccttcgatctcgtcgtagttgaacgggtctacgaatgtagtgtttacgccgtagtctacaaaggtatgagcgaggtaattatatgtaccgccgtagatgttctttgctgaaacgatgtggtctcctgcctttgctaccgccttgaaagcgtaggtaacagctgctgcacctgatgaaacagctagtgctgcaacgcctccctctaaggctgcgattcttctctcgaaaacgtcctctgtagggtttgtaagtctgccgtagatatttccggcgtccttgagtccgaatctggcctcagcgtggtctgaattatggaatacatatgatgatgtctgataaataggtactgctcttgaatcagtaaccgggtctgccttctcctgtcctacgtgaagtgcaagtgtctcaaaatgaagatttctctctgcatatggtttagccatggtatttactcctctcgggtatatttcttaatagtctgatctggtcccttactctttaaagattactgaaagagcgctgtcgataagtacctgtctcctgagtctggaagaagtgctacgatgttctttcccttgttctcaggtctgcctgctaatatatctgctgcctttaaagctgctcctgatgaaattcctacgagtgtgccctctgtaactgcaaagcggcggccctcttcgaatgcgtcatcgttctcaatggtgatgatctcgtcgtaaaccttggtgtcaaggaccttcggtacgaatcctgcgccgattccctgaatcttatgaggtcctgcctggcccttggaaagtaccgggcttccggctggctctactgctacgatctttacatcagggttcttctgcttaaggtaatggccaactcccgtaagtgttccgcctgtaccaacgcctgctacgaagaagtctaccttgccgtctgtctgatcccagatctccggtcctgtggtcttctcgtgtgtagctgagttggctgggttatcgaactgtgccaggataactgatcccggaattgtcttctgaagttcattggccttctcgatggctcccttcattcccttggttccgtctgtaagaaccagctctgctccgtatgccttaagaaggtttctcctctcaactgacatcgtctccggaagtgtgatgatgaccttgtatcccttgactgctgctactgctgcgattccgattccagtatttcctgaggtaggctcgataagagtctggcctggcttgatccgtccgctcttctctgcatcctcaatcattccaagtccgatacgatccttaactgatcctgccgggttaaatgcctcgagcttggcgaaaatgttcgcatcagctgctcctgctgccttagcgtaacgatctgccttcagaagtggtgtatttccaatcagttccagtgtgctgttaatatacttactcataataaaaatcctttcatccaatatcatcgcggaaccctgatccgcaatttcaaaatctcttatcaataaaatgtcttatgcagaaagcctcatacaaactgtatctctcatgctccaacatcgaatgttcttaataatctcttccatcatagcctccttttttcttggccacaattcctatagacttaataggttttcttgactatgtttgtattatattcatattaaacctatttgtcaatagggtttttgatttttctcaaaaaaattatgggacagtagggacggttctttttgtcccatttttagattattcagacaattatgctttttttagcccaaagcagcgtcgcagatggccaggtctcgctccgtaggatttttctgttcgcgtgtgcgcgcctaattgcggccttctggccaatgtatggttttcatgcgtttatggtttaagcgggtggccacccaggccgcagctagcgcacacgctcacgacgaaaaatcctaaggtcgcgagcccgttccattctgcgtcgctgcttctgaggtgaagtcatttgtatctgcaatggcttatttttaaggaggtgcaatgggacaaagaagctccgcatgggagggatatggggtaagcacactgtaaagaattatcttccggctccgcggtagtggtactttcaatataggcttacatgtagttaaaaatcatcaaatgtgcctgcccgctgtgcagtatataagaattgatttcaatattgacatccgcggagctggaaatcttaaatgcattgtagaatattcagaagcaatggctgtatataaaaacttgaaatgtactctttaagatttttgagcattaccccacacgtcttgagaatacttgaaagttctttaagaatttgacttcctccccgatctatcttgatactggaagaaagccgttgtataaatttcgcaccggaagaaattatactgaaaacgtggacaaacagatttacgtgcaggcaaaaaaaggcagcgtcgcagatagagacggtctcgcgaccttaggattttttgtcgtgagcgtgcgcgatgttgccgcccgggtgaccacccgccaaaatcataaccattataaggccatacattggtcagagggcggcacatagacgagcgcacgcgaacagaaaaatcctacggagcgagaccgtccatccgcggcgctgcttcggactaaaaatacataatgtgtcagataattcaaaaagtgggacaaaaagaaccgtccctagtgtcccattacgtctcctctgtcggttacgatgtggtagcctcccgaggctgccctggctgcgatgcagtcggcgcaggccttagagagctcgccggtgcagattttattttcatagagggaatatagttttctgaatttcgttggggagaggtttggcattacgacgttggccccggcggagaggccgtactccctgccttttggatggatcgtgccgagcgctgttgttgcggggataagggcatacggaaacatcagccgaaggattgagataagccgcagagtcatggcaagagagccgttgcagcagtttttgaacggggtggcgtggtgagtcagatacggaccgatgcctatcatatcgggagcgagctcctgcaaaaaacgcaggtcagaaagaatgcactccggcgtctgttttaaagtgccgaccataaatccggagccgacctggtagccgatatcttttaagtcaaaaaggcactgctttctatgggaaagtgaaagctcagccgggtgaagtattctgtaatgctcttccgatgcggtctcgtggcgcagaaggtagcgttcggctccggccttgaaatatttttcataggattcgcgggacttttctccgatggagagtgtgatcgcgcagtcgggatatttctgatgaagggataagacaatgtcacagatccgctggtccgtgtagtacaaatcttcgccgccctgaagcacaaaggtcctgtagcctaagccatagccctcttcagcgcattttaaaatatcttcctttgaaaggcggtatctcgtaagcccggcgtcgtctcttctgataccgcagtaatagcagttatttttgcaaaaattcgtgaattcgataaggcccctgacatatacagcagtgccgtattcggctcttctgacctcgtcggcagtcccaaaaagcagctcctcgtcatctgtaaactgcagattcaaaggaagccttttcaccggatgcgcgccggcctccggtgtgttcgggaaaaggctttcatctgtgcctgtaggcatcgttaagagacgaatcatctcttcgtcacttaaatctctatttattttaagcttttcaataagttctttcattttaaaatgcctggtgctttacgacttcgtactcattgtccgactggtagtatgggcaggaagaatagtggcctccgtagagtcgggccatatcgtcctcatccatatccacatcacagacgtaagcttcctcgtcgtcgtcccagaccaggttgttgcaggtgtcacattgatttccgttcatatcatttaaaaataaaaaatctgatcagcccgccagcgacgcaggcaattacaattgcaaggatcatgataaaaacctgatacttcgtgtggcttttaccccacttcgtatgcatgatcgcaagatatatcaggactccaccgatcaggcagataaaacttgtgataactcctacccaatccataaaaattacctccttatgctccgacagctccgagaagaccatagcttaaggatgccacaatcaccgtagccatggcgattcctataaggatagcaatgcttgccttctttaaatccatatccagaagggatgcgataaggcttccggtccaggctcccgtgccgggaagcgggattccaacaaagagcatcagagcgacaaactcgccatttttcagcgagtcacttctttttgcggcgtggcgctcgacccagtctgccaggccatgcatcctcgtgcccttcatccagtgcaggattttcttgatgaaaagaaggataaaaggtatcggcaggatatttccaatgacacagagcggaactgcagtggtgacaggcactttaagaagcgccgaagctataaggccgccgcggcactcgagtataggaaaaagtgatacgataaataccgcaacttcctttgacattatgtgtcccagtgagcccgcaaaccaatttacaaatgcgttcattatttattctccagatatttctttaaaaaatcgaataggccgtccatctcttccggagtgccgatcgttacccggttaaagtcttgcaccctctcgccctcgaagtggcggacgaagatgttgttatcccttaaggccttaaagagctcctcaccggacactttattgtgatgcacgaaaataaagttgctcctcgaatccgggaagtcgaatccgagctctctaaacctcttcttcgagcgctcgcgctcatttattatcgcaaggcatctcattttaaaatagtcaggatccgacagggacgcgatcccgactttctgtgtcagagcgtctatcgtataggaattgaaagaatacttcacatcgtttaaatattttatcagcttcttcgaaccgaatgcgaatccaagcctgctgccggccattgcgcgggacttcgaaaaagtctgcgtcacgagaagattgtcgtacttatcaataagaggaaggaccgactcagccccgaaatcgacgtaggcttcgtcgatgatcacgacgcactgcggattggactttattatcttctcgagagccccggttcctgcgtcgagtcctgtcggcgcattgggatttgggataacaatgcctccggcagttcccctgcagaatgcgtctatgtcaagtgacatatcctctttaagcggtactgtctcgtatgggattctgaactctcctgcccagacatcgtaaaacgaataagtcacatcaggaaacagaataccctctcccgatgtaaaaaatgtaagaaagctcattgcgaggacatcgtctgagcctactccgacaaagatctgatcagccggaacagagtatgtatccgagagaactccaataaggcctgacgcagtcgggtccggatactttcttaaaagctcatagtcaaaatcagctatggccctctttactgccggcgccggcggatacgggttctcgttcgtattgagttttatgacatcaagtgccttaggctgctcgccaggtgtgtacggagtgactttgtgtactttttcttcccaggtactgctcatttctggcctcgaattcttattgaaaaattattggttgtagacgataacagggaaacccttcttgacttcgctgtagctgtagagtttcgcggcattctcaggcggcatatttacacagccgtgagaacctgcagtcttgtagatctgtccgccaaattttccgtgacgccatggagcgtcgtggaaaccgatatttccgttaaaaggcatccaccatgaaacaggtgaagcatagccctggccctttagcgtggcatcttttgtcttgtaggtgatcctgtaggttccggtcggtgtacgtcttccgtcgacgtcctttccggtaactacgtctgactccatgactctcttgccgtttattacaaggaacatatgctgagtcgcaatattgacctctgcatagctgttgccatagtcgtgggcgtaatcgccgtgatttgctgccctgttgcggtagactggctcacgggtcacatcttttccagcctgaaggtccttctttatctggtctttctcggcatcgtaattaatccaccagccgtagtttccgccggaaactgtgacggtctttccgtactgagtctttaacgtacgtggcaggcccatcgtgttgtacttgtagcccagcttcatcttgacatatgaatagatcgcattgtcgtcaaaggtgacgtcaccattctttgaaacagcaaaccactttgccttgtctttgctgtcagccctgaccttgcctttagagcccatgtcataggtgatattgaccttcatatatttatttaaattatcgacagtctttttaagaacagcgttagtgctcttgatcttcggatcgatatagtctccgctcttgcgaaggtttatcgactcgtcgagagacttcagggaattctcgatggtttttacaagtgccttcttatttatctcggtaccataaacttcctttacgatcacgaatttgtcacctgagagcttgtagtaggcattcctgcgcttgaccggggttgaagtgacagccgtaagagagtcaactgcgtcatcaagtgctttctcgtcgaaatgagctgtcatatccgggatctcgacattctttgactttttaaaaagtgcctgaatccattctcccggcttctgctgatctaaaattttctgtgcagcctgcttcgcagatgattcatcaagtgaaagagaaacgtctttgccgtatatagtatcttcagtcgaatcgccctttatcttaagatagtacgattctgacgcatcatttaaaatatctacaatgccgtctgcatctttgccctcagccttctgactggcgataagggtgttcggcatcacatgactcttaaagtaatatgccgttccggcataggcggctgcgagtgcagtaatgataataactgtgataagtaatcgcttatgtttcatttgtctgtcccttcagtaaaaatttcaatctttgcctatagtactacaaaaaaaccgctttttcaatgatacatttcaaattacatcttttagaccttctatttgcggattttttgtagtacaatagtccccatgagtaattcagctaaagactttatcaaaaaaagaaaaaagagaatccttcttctgatgtactggttcgtctacctgatatttttctatctgatagaaaatgtctgggtcgcgaggcactacgtgactctcgactctccgattgaccacgcgattccattcattccggcgttcgttctggcgtacgatttctggtttgtctaccatgtctgggcgcttcttccgccatttatcgacgaagatcctgaggaatattaccgggcttcacttgcgctctactccggaatgacagtatttatcatagtctcgatcctgtttccgaatcagcaggcgcttcgccccgcacacctcggaaatgatattttttcaatgctcgtgggttctatctacgccgccgacacgccgacaaacataatgccgtcgattcacgtctacaacgcactcgtcgcaaacacggcgatctgccgccgcgccaaagtccgccacaaacctcttgaggcagtgctttcgatcttcgcctgcgttatgataactctcgccactgtctttataaagcagcatacgataaaagacctgattggcgccggcgtcatgtacctggtattctattttctattctttaaaaaatttaagattccggattttcttaaagactgatgatctccggctggttttacccagccggattttttatgtcagaggctctctgcctcgtcaagccagatccttgccgaagcgtcggacggcattctaaggtcgcctcttggtgagagcgctacagttccaaccttagggccatccgggatcgcgcttctcttgaactgctgtgagaaaaatcttctgtaaaaagtcttgagccacttttttatcgtatcacagtcgtagacttcctcttcactcccgctcttaaacgcgttcttttcgagttcaaagatcttcttcggcgtaaagccgtatcttagtacatagtacaggacaaaatcgtgaagctcgtatgggccgacgaggtcctctgtcttctgggctatcgtgccgtttttctcaggcggaagcagctcaggcgagacaggagtatcgagcacatcgagcaggactctcctgagctctgtgtcgtcctttccatagaaatcagcatagaatctgacgaggtggcggacaagtgtctttgggacagagcagtttaccgcgtacatcgacatgtgatctccgttgtaggtggcccagccgagtgcaagctccgagaggtcgccggttccgatcacgagaccgccctctttattagcgatgtccataaggatctgcgtcctctccctggcctgcgaattctcataggtcacatcgtgcctgctctcgtcctgtcctatatcttcgaagtggattcttactgcctttgaaatatttatatcgcggaaagtgaccccgagcgtccttataagtgtaactgcgttgtcataggtcctgtcggtcgttccgaatcccggcattgtaacgcctataataccctttctgtcgagccctaagacatcgaacgccctgcaggtcacaagcagcgcaagtgtcgaatcgagtccgcccgaaatgcctattaccgcgcactttgaatgcgtgtgatcaaggcgctttcttaagccataggcctggatatttaaaatctcctcgcagcgctcacgaaggtgttccctgtcagatggcacgaacggatgcggatctaccctgcggcttagagtaatttctttgggatctaagtcaaatgtgaccttagtgtagacatcgtattcggtgttaaaagtagtcatctggctgcggcgctttacggactctgaaatgtcgatctcagccattgtctcctggcctgtaaaaggcttcgtctctgctatgatcctgccgttttctgcgatgatcccaccgccgccgtagactacatcctgagtcgactcgccgatcccggcgttcgaataaatataggaaacatagtcctttgcagactgcattgccacaagctgccttctgtaggctgcctttccggtaagttcatctgaggccgacagatttacaatgactgtcgcgttcgacatcgcggcttctgtcgacggcgaatcaggtacccataagtcctcacagatctccgctgccacatcgagtcccggaatatctttacatgaaaaaataagcttcgagcctataggaatttcatcgcctatgcctggaaggcttatagtctccgcttcctccggcccctcgccaaagtatctcgcctcatagaattcgctgtaattcggcaggttcatcttcggcacgaagcctaagacttcacccctgtttaaggcgcaggctgcatttcttaagtatccattgtaaaagagaggtatcccgacaaagatcagcgcatcgatatttttggtctgatctgctatcgtccttaatgcatcaagcgctccgcttatcagcgtatcctggaaaaaaagctcgccgcaggtgtagcctgtgatactaagctccggaaatactatgatctgggcgccctcgtctgctgcctttctgctccattttatgatgcttgaagcatttgccttcgtatcagccaccactgtctcaggggttatggctgcaactcttatgtatccgtttgacatcagatgatctcctctggtttataggtgtattttttaccgcagaatctgcagacgacctcgatcggaccgtcctctgctgctatatctctcttgtcctcttttgacagagcccttatcttctgaaggaaattttttctgctgcatccacacttaaactctacttcctgtttatctgtaaactcgacatcgaatccgtcgaggacgctttcaagcatctgctcaggtgttaagcccttttcaagcatctgcgtcacagaatctatatgagaaatattatcagagagcttgtctataactgaatcttctgtgtccggcataagctgtactataaagccgccggactgttttacagtaaggtctgtatttacaaggactccgaggccgacagatgacggtacctgctcactctctgcaaagtaatatgtcagatcctctgcgacttccccggaaatcagatctatagagccgctgtacggctcctttaagcccatgtcctttatgacacgaaggtagccgtgtcctatggcgccgcctacatcgaggtgtcccggacttttttcagggagatcgacatgcgggttatttacaaaacccttcgcgtggccgaatgggtctgccgtgactgtgactccgccggccggaccgtctcctatcagctggagcgtgatctcgtctttgtccccgtccatcatgaagcccatcataaatcccgctgaaagcgcgcgtccgagcgccgccgtacaaaccggccaggtgtcgtggtcacgccttgcgatctcaactgcctctctgtctgaaatcgcaaaagctcttatctgatcgtgcgctgcaatcgcgcgaaccatgtagtctctcatgtcattcctttccatcattaaatctgcggctgctttgtgccatccttgtaaaaaccaggtctgtcaggatctttcaagtgctcttttgcaacaaaggtgatcttctgggaatccggcttcggctctccgagtgaagcggtatctagaacttctataagctcaagccccgcgccctctatcatatcctctatctcttttctgctgtaggccttctcgacatgctgctcgaaaaatttatcgaagcggccgtcgtctcccctgataaaaagagtaagatcatagaggttcagttttttttctttgtcgtactcattttcccagataaagcttccctcgctgcggttctccgcaaatgtattatcggataaaatcctctgaaacttatactccgtatttacatcgaaaataaatacgcctcccggatgcaggaaattatttacccgccggagaacttccttaaaatcttccttttcagtcaggtagttcatgcagtcacagatgcttactattccctgataggtcccgaaaacgtcgaattcacgcatgtcctggcagaggtagaggatcgaatcgtcgctctccttcgatctcgcgatctcaagcatctcgtcagagccgtcgattccggtcatgtcgtaccccctgtcccttaaccttctcgtgatctgtccggtgccacagccaaggtctaagaccatcggtttttcagtgccgtctggcaggtatttcttcagtaatctgtcgattgaatcggcccagctgtcgtatggaacattgtccataaacaggtcataaacctcagcgaaagatgtatatgcgtcacacatcacattctgtcctgtatccatttataaataaaatcgtagacatccgcgcggtcggtctcctgaaggatctcgtgtctgtcattttcaaagagttttattgacaggtctttgattcccgcctttttaaacctggcatacgcagccattacgccttttcccatcgagcccaccggatcatctgctcccgatgcgaaaagtatcggtaggtcctttctgatccggtttacgttttcctgtgaattgtcgaagagcatcgcagacgtcattccgcggtatccgttcactgagaaaagataggtgtcgtacgggtccttgtaatacttctttacgctctcgacattttttgaaagccagctcttctcgggctcgcttccatccatgttgaatttgtggtagtcgcctgaaaacaggatattcgtgactgtctggctcttgtagtcccagccgtgaaaaagcgccgtggtctttatcacaagccttgctgtatgtataagccgatccggaactgttccggtcccaacgatcactgctcccttcaggccgtcaaccgctcccgaatagactgacaaaaatctgcggagcatgtagcttcccatcgaatgtccaaggataaaataaggaatatccggatatttttttcgtccgtatttgtagaccgaaaacatatcctcacacatcgtcttctcaggcgcactcgtgtgcattacaccgagctcgcttctgcttttcttcggaagcgaatggccgtggccgatatggtcgtgtccgatcaccacaaaaccgcggtccgtaagatacttcgcgaactcctcgtacctctcgatatattcgatcataccgtgaacgagctgcatgactgcatgtggttctccctcgtccggcctccactcaacgcagtggagctttgttgcgcagtcgtccttcgattggattgaaaaattttcctttaacattttgaaaatcctccttttataaccttaccctgtaattttttatcttagcctgaatgctctttaccccgttgtattcatttatatccggatcgtacgaaatgtcaagctttatacggtttttctgcccggcgagcgccctgtcgagctccgacgcaccaaaggcctcttcaatatccgaatccatctgctctccgttcccgaaatagagcgcatccaccgcgacatcccgcgagagaagggtcagctttctgtactgctgctctctgccaatttttctataggagatgactgaaaggccattctccgcaaaaaccggcttttcattgccgtttccgtacggctcgagcttcgcgagatcgcctatcagcgggatactcacgtagtatagcggcatcggaacgtctatcataagcttctgctcgagatcgtcgccgcttaagccgctgtgctgatttaaaaaatcccgcagccatccgatatcatcttcccgcattgaaagacccgctgccatcgggtgccctccgaacttcgtaaagactccgtctccgccatacgcctcgttggcctcgaccattttttcatacatcgaatagccctcgatgcttctgccgcttcccttgacatcgccgccttcggtcctgcacagtacaaatgtcggcctgtaaaaatgctctttaagctttccagcgaccagtccgcagaggctctcgtgaagttctggcagatacaatactataacatcagggatccgatcctctcccgagagcttgtcaaaagcgtattcgacgcccttctgcgtcatgctcttccgcttctcgttaagttcgacgagctcctctgccttttcctctgccttctccttatccgtttctataagaagggagagtgccttctccgcgctgtctatccttccgctggcgttaaagcacggccccaggacaaaccctatatgccaggacttgatgttatttttgtccagacctgccgccttgatcagggccgtaaggccgatattttctccctctgccatacgcttgaggccaagctttacgatcgcgcggttctcatctttaagctccatgatatctgtcacggtcgcaaaagccgcctcaggcaggtacttcatcgcatcccgcccttttccctcgatacaaaaaagctgcgttataagcttaaaggcgaccacagctccgcagatctcaggaaacgggtacgaatcatctgccctgtgcggatctacgacgcaggaagcatggggcagatggtaaatttttccatcccggcagaaatcccagacgccctgctctgtatcggcttcaggcgggtactttaaagtctccccgtcatcttccggcgtagaaaacggtatcgcgtggtgatccgtgacaataactgtcatacccttgtcccctgcgagctgcacggcatccgaggccgcgatcccattgtcgcaggttacgatcacatcgactccgtcgcctgctgcccgctcgaccatcgaatcattgagcccatagccgtcttttatcctgtccggcagctgatagtccacatctgctccaagcgccctcatcccatcatataaaatataggacgagcagatgccgtctccatcgtaatccccgaaaatgcggatttttttattctgatgtattaattcaaatatagtctccgcggccctttcgaggtctttcatcaaaagcggactgtgcaggtcacggggagtcggcgagagaaattttcccatcgctttctccggtatatccctgtttaccataactctcgcagtcacctggtcaacgccgtatcgcgccgcgagtcccttgaaatccgcctttttacagtaacattcccattttgccatatcaatgtattaaaaaggagctgtgtacagctgaagaactgtttccagtccgccttagtcagcctcacagctccttaaaaattattcacaattacaattattgtccagaaatttgtacagcagcctgtacagctctttcgcctcgtccttatcgagcttgacgcacttcgacatctcgcgcggcaccgcaacagccttgtcccttagcttcatgccctcatccgtgatagaaataaggaggttcctctcgtcggccttgctgcggtgacgggaaatatagccctttgactccagttttttaaggagaggcgtaagcgttcctgaatcgagatacagacagcggcctatctccttcacattcatctgcttcttctcccagagcaccatcatcgtgatgtactgggtatatgtcagatcgagagccgaaagatacggcttatatgcccttacgacctctttggcgcaggcgtagagcggaaaacaaagctgatttttcagttcaagacatgagtatttattatcttccattgctaaaaatctccaaaagctaaaatacaattacattgtacacaatcttttggaaactgtcaacggaattttgtgtttttctggctttttcagatgtttttcagcatgtactcgactacggctgcgcagtggcgggctgccttcttttcaaatgtcgggtagtcctcagatcctgagttgtcggccttgtctgaaatagcgcggataatgacgaacggaaccttgttcagataagctacctgggcgatcgctgtgccctccatctcggtgcacattccgccaacgagattatgaatggcttccttcttatcatttcctgcaacgaactggtcgcccgatacgactctgcccgaaaatacatgaatatcagttgctgcctccttaactgcctttactgcgcagtcgtgaagcatcctgtctgccgggaagcttatcgttcctactcccggaacctctcccggcttatatccgagcggtgtaacatcgaaatcgtgatatatggcatcctcagataccacgatgtccccgatgtcgatcttcgcatccatagaacctgcaacaccagtgtttataacgtgtgtcacatcaaacaaatcacagaggatctgcacgcaggcagcggcatttacttttcctacgccgcactgtactactacgacgtcggtgcttccgatctttccctcgtaaaatttcatgccggccttctcaaccgtgcgctctgtggtcatctcagccttcaggtgatctacctcgatctccatggctccgattattcctactttcatgttgtatttcctttcatttcgtgtggactttcttcggcttgcttcaatgctgtgttggagctatatagatacatctctgcctcactccggatacaccagattctcctcagtggcgttgtttaagacctcgagatattttctggcctggtagtgcgccatgttcagattctgatcgagatagttgccgcagtccctggctgctgcgcccggtacatctccctcgaaatcgcggataaattcaaacatctcaatgacgagcggaagtacgtcctttgaatcgtagtcgccagcgaggagcatatagaatccggtgcggcatcccatcggtccgaagtaaacggtcttgtccgcccatttttcatgattcctgagaaatgtcgctccgaggtgctctatcgtgtggacctcggctgtattcatgaccggctccctgttcggtgcagtcatcctgagatcaaatgtcgtaatgactgcatctttgtatttgtcctttctcgacacataaacccccggcagaagcttcaggtgattgatcgtaaagcttgttattttttccatgtatttttcctccatacaaaaaaccttgaaaaccagtcatcaagcggttttcaaggtttcaaaaataaatgcggataacaggacttgaacctgcacggtctcccaccagaacctaaatctgacgcgtctgccaattccgccatatccgcctgctgcctttaattgtcttcgtcgtcatcctcagaaatcgagttcaaggcatttaagatgtcctggctgtccacctttgaaaaagcatccagcatctgctccatctttccgaagagcggttcctcttcttcgtgatcctttattccaaggtgctcgcggaacttcataatctcggcctctgtaacaccagagtcctgcttcgtctctttcttctcatctgccataagcgactcctttcaaaaatgcctcggagcgttcagtaattactgcaactcatatatgataacggatttgaaaacccgtgtcaagcttccgatgtccgaatacgctgctgccgcaaaggaaatcggcacacttaactgggttggaatggaaagcgatgagacctttgagcagatctgccgtgagggcgctgacctgccttttgtagtaaagggagttctctcagtatcagatgccttaaaagcccgtgacgcaggtgccgctgccatcgtcgtctctcatcaccacggcagagtaccatttggcatcccaccagtttacattcttcctcagataaaagagtcccttgccggaagcggagtcgccatcttctgcgactgctctatcgaaaccggatacgacgcctacaaagcccttgccctcggcgccgacgcagtctcagtcggccgcgggatcctcggaccacttctcaaggaaggacgtgatggcgttgtgaaaaaagtaaactcgatgaacgcccagcttgctgaactctgcatgtacaccggcgtccacgacatgaagtccttcgatccaacagttctgcactaagtcaacaattacatacatatcgaaaaaatctgcacgtaattcctgttctgggatcacgtgcagatatcaaaagatcttcccgtccttcataaaatccatcagattcacatgcaggatgccgtttctcttttggagcaggtagtcggttgtaacgacgtacttcggataattatcccgaatcatttcgagcggcctgtattctctgtcttcagtttccctgctgagcgcaattgtataagcgacctgaacatatgcataatccatcgacgcattacgcatgataaaatcacattccagctttccaattctccccacactgaccttgagtcccatacttttcgcataaaaataaactatgttctcaagtaccggaccgaaatttatcctgttatcagtatttaaggcaaaataaaagctcaggtcactcaggtaatattttttctcgcctgccaaagactttcgtgacttcatatcaaaacggtcgcattcataaataaccttagcatccaccagcgcctgaatgtattttgacagagtaagcctggttattttctgaccgttcttctccaaatcacgcttgagattcgaaatgcttgtcgtggcaccgaaattattgataatatactggcgaatactctcaaaactctctttatttttaatcttcacccggtggcgtatatctttttcaaaaatctcctgtacaacactctccgtatagctccgcttatcctgcaggttctcaatcagaaccgtccttgggaacccgccctcaaggataaaactctgaagctcaatcagggaattcgaatttaccggcacatgatagaattctttcatctgctcatactcatcaaaggtcaaggtgtacatctcgaattctatatacctgccagtcagtttcgtggccagctcgccgctcagcagatatgaattcgaacccgtgataaaaatagaacagttcccgtcttcacggaagccatttaatacctcttcaaaaccgtcaacattttgaatctcatcgatgaacagataattctgcccgtcagcctttatcccggaatcaatcagtttctccatctgatcagctgttttgatattcctgtactcccgcttatccaggttgagatagacaatcctctcctccggcacaccctgctccttcagctcctgcacgatcatctgcataagagtcgatttgccgcaccttcgcacacccgtgataacttttatcaggtcattactatcgtagaaacctctgatcctcttcaggtatttttcccttttaaaaatatccatgacagcgctgctcttcctgcatattccaacgacttacacgtatattttaacacatattctttaaaaaatatacgttatcgcatcagtttttgagtttttatcaatatctgatgcgataaatcctgctatttcgtaaaatcagctcctaaaaaagcgtaaagcaaatggaatttgaaatcagtttgtggtattctactaatgattagaaacgttttcactttttgaaatatcagtaattacgaggtgattaggatgtgtacatgtgctatgtatcatacaaaggaccattattttggcaggaacttagatcttgaattttcttatcaggagtctgtgacgataacgccacggaattttcctatcccgttccgtcaagaaggttcgatgaataaccactatgctctgatcggcatggcatttgtctgcggcggatttccgctttactacgatgcgaccaacgagttcggtctctcgatggcaggactcaatttcccgggaaacggttattttttcaagccagaatcagatggcaaagacaatatttcgccgtttgaattcataccatggattcttgggcagtgcaaaaatctgaatgaggcaagggctcttctggacaaaatccgtcttgtcgacattcctttcagtaaggagcttccgatcacgccgctccactggatgatcggcgaccagtccggctccatagttgtcgagtcggtgcgcgacgggctccacatctatgacaacccggtcggcgtcatgacaaacaacccgacctttgacaagcagctgttcaggctcaacgattaccgcggcgtatccgcagggccttctgaaaatacctttgcaaaggggctcgacctcgatccttacagcagaggcatgggtggtatcggtcttcctggtgacctctcctctggctcacgcttcgtaaaggttgctttcacgaagatgaattcaatctcaaatgacgatgaggattcctctgtgagccagttcttccatattctcggctccgtcgaacagcagcgtggttgctgcgacttaggtgacggcaagtacgagatcacgatctattcctcctgctgcaatatggaccgcggcatctactactaccgcacctatgacaacagccagatttccgccgtcgacatgcaccacgaggacttagatggcagggacctggtttcatacacgcttgtgacaaagcagcagatcaaccagattaactaagtaaagtataaagtattgtcgtttcgtcaaacaaatgtcagcgacacataaatttctttcaaaaagcggctcctttcggaaccgcttttttcaaattctcatctgatgatcttttttgccgcaataaatacaatttcttctagaacaacatttttattttcacccgataatcttctggcttgcgaacaaatattctttcttttataacaattttttcttaccctatgatctcctgttctgccaaaaaatacgattgcttttagaactacatcttttttctcatccaatgatcttctgagctgcgaaaaatacgattgcctttagaaccatattttttctcatccaatgatcttctgagctgcaaatactgcgcatacgccgcagatgatgcttgcaattacatagaaaaatgccacagcgtttttaccactcgcaatcagctggtctgtctccagcgcaaagcttgaaaaagtagtgaagccgccgcagataccgacctttatgaatgtgacaagtctcggatttacctgatggcttcccgcaagagccgcaataattcctatcaggaaggcgccactgacattaataatgaaagtttttaccgggaagccgttatcaggtgcaagcggcagcagccctatcaggtatctgcctaccgcgccacacgcgccgcccaacgcaacaatcaagcaattcaaaatcataataccacctcagattcctctgtgtttcccacgtctgtttcaatatggcgttgttcctagtaattaaaatacaacgcggagcctgaattctttgggctccctctctcctgtttcaatatagcgttgtctcctgtaattaatatacaacgcgaagcctgaattctttgagctcttcacgcctgtttcaacatagcgttgtctcctgtaattaatatacaacgcggagcctgaattctttgggctcttcacgcctgtttcaatataacgttgttcctagtaattaaaacacaagcgcgctccgcgagtttcaacacagcgtgcttttaagctgggaaaatacaaataaagatttctagttgcaacatagctggctttcttttctataaaatacaagtatttgtattttataaatttcaccccatcatatgttgcaactggaagaaagcgtttgtatcttatcagaatttttccgtcatatagtgaaaattctagataacgtttgtattttcttatcttcacctcgttatatgttgcaactggaatacaacgtatgtatctttttgcagtttttccgctgtatgttgaagaccacgaaagattttttccgatacaagacttcatttacggactttgctagaattttctattcgagtccgtaaatctccttgctattttacggactcaggtcagctttttctttccagtacgtaaatactcgcttccttacggactcacactgaattttctgttccagtacgtaaatatttagctctctttacggactcagatcagttttttctctccagtacgtaattcccaagctctctttacggactcacactggattttctgttccagtacgtaagtactcagctctctttaccgactcagatcagttttttctctccagtacgtaaatcccaagctctctttacggactcacactggattttctgttccagtacgtaaatactcagctctctttacggactcagatcagttttttctctccagtacgtaaatcccaagctctctttacggactcagatcagttttttctctccagtacgtaaatactcagctctctttacggactcagatcagttttttctctccagtacgtaaatcccaagctctctttacggactcacactggattttctattacagtacgtaattcccaagctctctttacggactcacactggattttctgttccagtacgtaaatactcagctctctttacggactcacactaaattttctattacagtccgtaaatactcagctctccttacggactcagactgaattttctgttccagtacgtaaatactcagctctctttacggactcacactaaattttctattacagtccgtaaatactcagctctctttaccgactcagatcagttttttctctccagtacgtaaatcagattcctttcgagcgaccatagtagaacatgtactgctggatcacacctgcatacgggctgtactgcctgtcgtcaaaagttccgccgtagacttcatcaatcacacgcttgatccagacatcaatcgggaagaaatcgaggcggtggaaaccgaaaagagcggtgcagttggcaactttctttccgacacccttgaagccaagaagctcttcgtataaagcctcatcatccagctgacacagatactcaatcagatcaggattcataagaagcctgctcacagtttcctggatgtatggcatacgatagcctaaagagcagctgtccagaccagccttcttataggaacagaactcaccaccgcatttttggcatgaaagaccgctgagctccacaagagacgggaaagcaaagacctgctccccatcaaactcaccaataaaagaccctgcagcctggcacagcttctcaacacatgattttatcgccggaatattctttctctgtgaaataataaaagtgataagagtctcaagcgggtcctggcgcaggattcttattcccctgccgaattctccggcctttgtaagaaaagaatcatgcggatcaatttttgcaattataccgtcataattcgtatcggcatccagatacgatttccagactgtattgtactcgtcttttccacaatcgatagagatcgtatgcgaatcaatctgtgtaaaatatctgactctgtcaaatgcagtgactctgaaggttccctcttcagtttccttccagcggaagcactgcccgctgtctgctgttttcttaagatctatgctgtcgcccagctttgcaatatatttttccatatgagccattataaatgtctgaaaagaagtctgcaagtgataaataagcagtagtttaaagcctgatttagtacatgtaaatacagataaaatagcttgaagtttccactgaaagaaaaggtacaaacaactgtcggcaggttatgcaccagttatccacatttctatcaacaatacctgttttcttgacataagcttctgcatttaagtttttgatatttctttcaactacacagctgtgggtacaaattgtcgataaagttcacaacttcgttgataaaccgctcaaaaccgtattttacgggattttagtccacaaaattcagtggatatctgtggataaattacctgctgtgaatctgtgcagatgtggataaaggatttttgcagttaatttgatttacgtttcaactaatttttaaacatcattactgcaataataggtcaatagtctttaggctcctctcctgtacgctgctttcacagaattcccggtaaatattttacaattattaaaatgtacaaaaaagtaaccacgaatgtgactgctatcctgtttgagccattctattaattggctctaactgtactatatacttattctatctgttcagtatatttaatcaaattgttccatatacttttccatgtacttatcccaggcttcgtccacactcttgtccagtgagaacgcagccaggttcgtgcccgttgttaccgtaagccctccatctttaaatgtcgctgtaaaagtcagtgaattgacgtcacgcattgtaaatcctgtgtcagcttctgcgagaatctgctctgtcaattgccgtggcgcatgaaataccagcctgaaaaatacaggtgttctttttcccttaatgatttcaaaaagaatgtgcctgatttttccatattttataaatggttctctataaaattcacccgaagcattgcccttggcagaagaatcttttgctgcagaaacagattcctctgaatcacttccatcctccggcaaatcaggatctccgccaaagaaatccctgtttattttcccgtcaatcacaaatgagaccgcggttttcaccgtggcctcactaatagtaaacttatcaaacgtctcatgaattagagcgtctgacataaattttttgatatttttaatctggatactcttcatatcgtccccttctattgataaaatttcgagtcaaaactaaataactatgtattgatctaaaatgctcaattacaatacagtatcaggcaatacttccagctccgcattctggccaattttcaatataggcaaaaattctactgaatcactccagcaaccttagacaatttcttattataagtaagtagttttcaacatagaatgattttctaatgatccgggactcaggcctttgaaaaaacttcactatagatctgtgatgaagtcatttgctccaaacaaatttcagggttctcaatatacatgagaagctgttagatttgttacaaatctgatttttttcttctcaacatacgtcgaactatctttaattagctccaacgccttggagcgagtcagtttaatataattctatgttgataaatcaatatttttataatgtgtcaacaactaagctcttttgggacaattaaagtccgcggcagtctatattgataacaaagtatttatatctccgcgcatctcaatcttcgggccacccttgtgctctaagtagtcgcgggtgatcgtgactttgccaatgtccgggtccttagggatctcgtacatgatgtccatcatatactcttcaatgatcgaacggagggcacgggctccaagcttcttctcctgggctttcccggcgatccactcaagtgcatcgcggtcaaactcaaggtctacctcgtctaaggaaagaagttttttgtactgcttgatgatagcgttcttcggctttgtcaggatgttgataagcatctccttcgagagctcctgaagagtcgcaatgatcgggagacggccgataaactcagggatgaatccgaattttctgagatcctcaggcgtcaccttagagagcaggtcatcttcatcgtcgtactcgtcaccgaggtctgatacgaaaccgatcgagcttgatctcttaagcctctcctttatcacatcggtaagtctcgggaacgcaccaccgcagataaacaggatatttgtcgtgtctacaagagtcatcgggaccatggcgttcttcgaggacgctccgaccggaacctctatctctgcgccctcgaggagcttcagcataccctgctggaccgactcaccgtttatatcacggttcgtcgaagaagtcttcttcgcgagcttatcgatctcatcgatgaaaataataccgtgctctgcttcctctacgttgttgtcggcagctgcgaggagcttgcttacaacagactcgatatcgtcgccgatgtaaccggcctctgtaagagtcgtcgcatcggtaatagcgagaggtacgtcgagcagctttgcgagagtctttaccatgtaagtcttaccggaaccggtaggtccgatcatcaggatatttgacttctcaatctcgatatcgtcatcgtttggatcgtcacgctcgagcagattctctgagtcaatgactctcttgtagtggttgtagacagctacagacaggatcttcttcgccttttcctggccgatgacatactggtccaaagcagcctttatcttgtgaggaggcgggatgtttttgatgtcaaaaaccggtccgtctgtcagaagaccctttttcttttttttcttctcacggcgcttcttaagcttctgattctccgggatcggaggcgcgccacggaaaagattagaaatatcctcgagatctagggtcgtaagattcgtaaaattattcgagcccttgtcgtcgttgttattctcagacggtttgtcgcttgtgttgtcgtcatcagacgcactgttcttcggacctggggttaactggccaaaccaggaattcacatctgaaaatccggacatatttgtcatcgcattgaatgtcttctggagacagtcgtggcagatcgacagctttcccgggatatgtatcattttgccggcgacactctcaggacggcggcagatatagcagatatcctcgtagtcgctgtccttgtctgaatcgctggtattagtgtcactgccactcacactcgtatcctgtggcgtgtctgtaacttctttaaaatcgtcgttattcattaattctcgtcgtcttcaagcgggtttacgtgtatatggtccagatgccagatatcgtcgacatactgctggatagttctgtctgatgagaactttccacagcaggccgtgttcatcatagccattctggtccattttttctcatcccgataggtttccatcagcttgtcctgagtctcggcgtaggagcggaaatctttcaggttgaaataggtatccggatactgtgtctcgttggtattcaggagagaattgtagattggtctgaagagctctgaattgtcagggctgtagaaaccatttaccatctgcatcaggacttttctgatatcctgatcctggttgaagatgtccatcgggttgtagtctctcttctgctcgtgctcgataacttcgtcggcactcataccgaagataaatgcattctctctgcccatctcctcaaccatctcgactgtggcgccgtccatcgtaccaatagttacggctccattcatcatgaacttcatgttcgaagtgccggaagcttccttcgatgcagtagagatctgctctgagacatctgctgcagcaaagatcatctcggcattagatactttgtagtcctcgatgaatacaacttttaacttgttgttgatggaacggtcgttatttataactgctgccacattatttataagcttgatagttagctttgcgatcttgtagcccgcagctgcctttgctccgaaaatataggtcttcgggatcacatccagctccggatgctctttgatcctgttgtactcgtacatgacatggataatatttaaaagctgtctcttgtactcgtgcagtctcttgacctgtacatcgaaaatcgagttcggatcgatctcgatgccgttgtgttcctttatgtagcgggccaggcgcagcttattcttgtacttgatgctcctgaactcctgctgggccttttcatcgtctacgaagactttgagtctgctcatctgggagagatccgtaatccagccgtcgccgatcttgtcggtaacccaggatgcgaggagcggatttccatggaggaggaaccttctctgtgtgataccgttcgtcttgttgttaaacttctccggatacatatcgtagaagtccttcagggtctctttcttcaggatctcggtgtgaagtttcgcaacgccgtttactgagaacgctgccgcaatagcgaggtaagccatgcggacctgaccatcgtaaataatggccatgcggtcgaccttgccctgatctcccggatatttcttctcgatctccagacagaagcggcggtttatctcctcgacaatattgtagatacgagggagaagtcttgagaatatctcgataggccatttctcaagagcctcagtcattatggtgtggttcgtataggcgacgcagtgggtggtaatgtcccatgcctcatcccagcctaagccttcgacatccatcagaagcctcataagctccggtaccgtcagtgtcggatgggtgtcgttcatctggaagacaaccttcttcggcagatcgtggatatcgtcgtggtgcttcttgaatctctggatagctctctggagcgatgcggaaacgaagaagtactgctgctttaatctgagctctttacctgaaatatggctgtcgttcgggtagaggacttctaccagagatctggcgaggttctcgtcctcaactgcctttacataatcgcccttgtcaaatgactcgagtgaaaatacctgtttcggctgggcgtcccagatcataagcgagttcacgacgttgttgttgtagccgacgatcggcatatcgtaaggaactgcgagaactgatctgtagccctcctggatgaaattgagccttccgtctttgccgacctcggtgcggacatagcctccgaattttacctcgtaggtatattcgcttctcttgagctcgaaaggatagttttccttgagccagtcgtcagggacttccttctggaaaccatcctcgatcttctgcttgaacattccgtatctgtagcggatgccgcagccgtaagccggatagccgagcgtcgagagtgaatcgagaaagcaggcggcgagccttccaaggcctccatttccgagggccggatccggctcctgatcctcgatcgaagtgatatcgagtccgagctcatcgagtgcctgcttgaattcgtcgtagacacagagattaagcatgttgttgccgagagcacggcccatcagaaactccatcgacatgtagtagacagtctttggatcctgctcgtccatcgcattctgcgtggcaagccagtcatcgatgatctcatcttttacgacaagtgatactgcctggaatatctccttctctgtggcctctttgaactctttacgatagagtctcttgacgtttgattttatctcttctttgattttgtccttgtccagatccttcagattgcccattgctgcctcccgcctttgaaacaggcttcttcttgtcttctttcttcctttagttctttctgactgaaagcgtgacattctctccgttaatgttccattccttcgtatatgcagaagaaagatctccttcctcaatgctgtcggccagtacctcgtggctgatcgtatcgctgttctttgtaaaaatctcctttatcttatcattagacgagtatccgactttgatgcggtccatgacctcaaaaccggcctcttttctcatggtctgaatctttgaaataagctctctgacaaagccctcttcgacaagctctggtgtcaggttcgtgtcgagtacgactgtgacactgccattggtatttgtcacatagccaggctcagcctgctctgaaataagaaggtcgtcctttgtaagctcaacgccatctccgatctcagggaacttaagtactcctgtctcgttaagctctgccatagccttgttgccatcgagattcttaagtgctccctgaatctttccaaggagttttccatacttaggacctacagtcttaagctgtggcttaaatgtgtaagtcgtaagcttcgaaacatcgtcagcaaattccgccttctttacattgagctcatcagcgatgatatctgtatagaacttgtcgagcttctggtcagcctttataaacatctgcgccagaggctgtctgttcttgatgttgcctgcgtttctgcatgcacgtccggctactactactttaaggagctcgcccatctttgactcgaggtcggcgtcgatgtgagcctcatttacctcagggaatctgcagaggtggatcgactctggtgcactctcgtcgacttttcttacgatattctgatagatctcttctgtcatgaatgggatcatcggagctgcagcctttgaaatatttacaaggcaggtgtagagagtcatataagcgtttatcttgtcctgctccattcccctggcccagaatctctgacggtcacggcgaacgtaccagtttgatagctcatctacaaatgagtcgagtgctctgccggcctccgggatcttgtaggaacctaagtcttcgtcaactgtctttatcgcagtgttgagtcttgaaaggatccatctgtccattacaggaagcttgtcgtagtcgagtgagtacttagtcgggtcgaagctgtcaatattcgcatagagtacgtagaaagcgtaggtattccagagagtcgataagaacttcttctggccttcctttacagcgtcctcgtggaacttgttcggaagccacggtgctgagttcgtatagaaataccacctgatagcgtctgctccgaatttgtcaagcgcatcgaacggatcaaccgcgttgcccttgctcttcgacatcttctgtccatttttatcctgaacgtgtcctaagacgatgacgttcttataaggtgccttatggaacaggatcgtggactctgccatcagagagtagaaccatccacgtgtctggtcaacagcctctgagataaactcagcagggaactgctccttgaacctgtcctgattttcaaatggatagtggtgctgtgcgtatggcatagctcctgaatcgaaccagcagtcaagtacctcagggatacggtgcatggtctttccgcacttagggcacttcatcgtaactttatcgatatacggacggtgcagctcgatcttcgcatcttcaggatttccgcttttctcagcaagctcttccctgcttccgatggcttcctgatagccgcagtcgtcgcactgccagatgttcatcggggtgccccagtatctgtttctggaaacgctccagtcctttacgtcctcaagccagttgccgaaacgtccggttccaatagttggagggatccagtttacagtcttgttgtttgcgacaagctcatcctttacagcggtcatctttatgtaccatgactcgcgggcatagtagataagcggtgtatcacatctccagcagtgaggatagtcatgaacgaacttcggtgcatcaaacagaagatgcttggcacttaaatcctttaagacttccggatctgccttctttacaaagaggccggcgaacggtgtctctttggtcatattgcccttgtcgtctacgaactggacgaacggaaggtcgtagtttctgccgatacggctgtcgtcttcaccgaaagctggggcgatatgaacgattccggtaccgtctgtcatagtaacatagtcatcacaggtaacgaaatgtgccttcttgtgctgccttgctgcaacctgacctgcgcactcgtaaagtggctcgtactctctgtactcaagatcactgcctttataagtctcaagaacttcataggcctttccgcccatggcttccttgaactcatcctttgtaaggagctggcctaagactttgtctgcaagagcctgtgcgatgtaatatgtgtatccgtcgcaggcctttactttgagataggtttcttccggatttacacagagtgcaacgttacttgggagtgtccatggtgtagtcgtccatgcgaggaaatatgcatcctcatcctttgccttgaagcggacgatagctgagcgctccttaactgtcttatagccctgtgcgacctcctgtgctgaaagcggggtgccgcagcgcgggcagtatggtacgactttaaagcccttgtagagaaggcccttgttccagatctcctttaaggcccaccactcggactcgatgaaattattatcgtaggtgatgtaagggtgcttcatgtctgcccagaagccaacctggtcagagaatttctcccacatacccttgtatttccagacgctctcacggcacttcttgataaatggctccatgccgtatttctcgatctgttcctttccgttgagtccgagctctttctcgacctcgatctctacaggaagtccatgtgtatcccagcctgccttacgaggaacatacttgcccttcatagtctggtaccttgggatcatatccttgatgacacgggtcaaaacgtgtccgatatgcggcttgccgttagctgtcggcgggccatcgtaaaaggtataggtgtcaccttttcctttattctctacttctgacttctcgaaaattccttcatttctccagaactcttcgacctgatgctcacggccgacaaagtccatgtcagtgtttacgctgtcatagattgttttcatttggggaatcaatcctttcttattccaattaggcaaatgccttgaatatttattttatgtgctatactttcgattgtcaaggcaaaagctcatttatcgtaaaatgcagctccccttccctgtcgacatcgatcacagcatatgtcggaatcctgcccggctgacgcggcagtgagattgaaccgggattcaatacagtcataccgttatactgcgtaagctccggaacatgagtgtgtccgtagatcgcaacatcgcagtcgcgctcctccgccgcttttataaggtctgcattcgagtagtcgacaccgtatctgtgtccgtgcgtaagaaatatcctgtggtttccaagcgtagtaaccctgtacagtggctcgttcccccagtcgcagttgcctctgacgtaaaaaagcggcactccaagacctgtgcgcaggacgtcctcagactgctgggcatcgccaaggtgatagatcagatcaggtctgacctgaagtactacccgatttaaattttcatttctgccgtgtgaatcacttactaccagtactctcatttgtcaagcctctttttaagttcctctgccatcgcgcgcattgcctttccgcggtgcgagatcgcatttttctcatcgggtgaaagtgatgccgtcgagtggttctgcggttctacgaaaaatataggatcgtatccgaatccattctgcccctccgcgtggtctccgatgtagccctccatgactcctgtctttgtaaaggagcttccatccggaagtatcgctgccatcgcgcagacgaacctcgcggtgcgcttttcctttgggactccctcaagcctctcgaggatattcgcattcttaatatcgtaggaagtatcttttcccatatacctggctgaatagactcccggctctccgtttaaggcatcgatgcagagacccgaatcgtcagcgataacgaggtcatccggagcgagcttgtgaactgcctctgcctttatcatcgcatttttctcaaatgtgtcgccatcctccgcgatatccggatcgagtccggcatctttcatagaaatgatctcgtcagccacgctgtccaggatttcatggcactccctgactttgttctggtttcctgtcgcaaaaataatcctcatgatcttctcctaagattttctactgcttttgtgaccgctgtcacttagatattctgaaactgcttcaacaagcgctttggcagctttcttctggtaatctgctgttacaagcttttttctctcggccttgttcgttatgaagccgacctcagcaatggcgaccggtatctttgaagcgcttacgatgtagtgctcgtctcctgctatcgagccacggtcttcgcatttgaggcctgacaaaagcttctttaaaacggtgtctgcgaattttctggacctgctggtcttatcagagcctctgtagaggacctgggctccgtttatctccgactcgcgtcccgaggccgtagaacctgtctctaccgataagaaaaggtccgctccaatctttttcgcttcttctattctgtccttatctgaaatggtcttatcggataatctcgtgtaaaagaatccgacctttccgacgccttttatcttcatcgaagtaagattagttccatattctttaacttctgtaacggcttttttgtctgtaaaatgcttaaaatattttactatcgaaagtgagatatccttctcacttactcctccggccaccgtacccctgtcgcttccgccatgacctgcatctactaaaaccaccttgtcaaagcacttgcgcggttctttaaaatcaaagaaaagataagatgagtcggatgatttttttatgaaaagaggtttagtcgtcgtaagagtaaggaccgcccctcttcctgacatctggtacttcaagcttttaatgctcctgccgtttccagagaccggatagtccgcaaaatacgaagacgagacagatggtatcgtgatatgatactctttaaaacgcgaatccgactttattgaaacagcggattgtgacaggctctttggaagtcttatacagagtgaatgaagggaagtaatggcgttttcatgcttgttttcccttccgatgtatttcatcagtgagccgtttttcgacttcagacggtacctcgccatcagatccgtgccctgcctcgtccagataaacgaaatcccggtcacggaaatgatgataagcagtaccgagatgagccttactgctcctttttcaattcttcccatcggaggtcaccttaggaggcttcgggcccatgtactgataaaaatatgtcttaagcattccattgtaaatcttgcggttctttgacggcttaccgccgagacagcgggtggcatcttcccatgccgtgataacgaaaagcgaccacttgtcaagtcttctgtacgcttcaaagagcttcgaatagagctccgggagttcgtccttttcggagagcctctcgccgtaaggcgggttcgttatgataaatccgtagggatccttcatccgaaaatctccggcttcgagtctcttaaaagaaataagcttctttacgccggctctccgggcattctcatttgcgattcttatcatatcagggtcgatatcggagccgtagattctggtatctacatcagtatcgactgcctctctgagccattttctctcgtcggtccaaagcttcttatcgatcagattcgtccagccctcggctgcaaagtgcctgtaaagtcccggcgctatatttgcggcgataagagctgcctcaatggggatagttccgctgccgcagaacggatcagctaagatccgatccgccttccagggcgtcagcataataagtgccgctgcgatcgtctctgaaatcggggcctttccggtctctttgcggtagcctctcttgtgaagggcatcgcccgaggtgtcgatcgttaccgttacctgatccttgtaaataaagatcctgacagggtagtcgcttcctgtctcagggaaacggtccatgtggtagatgccctgcatcctcgcgaccatggcgcgttttccaacacgctgcaggtcagtcgtcgagtaaagcctgctctttaccgaagtggccttcgtgacccagaaagctgcgtcggaaggaaggtacttctcccaggggatatttttcatcccctgaaagaactcctcgtaagtcttagcgcaaaagcgtcccgtcacgataaggaccctctccgcagttctaaggcataagttagagaccactatgccgtcctcgtcagcctcatagaagacatggccatcctcgacctttttgatctcgtagccgaggtcatatatttcccgtttgagcaccgtctcgataccgaagtggcacggtgccatcagttcaaaattcatctgtcaaaaaaagctgcgagaataacccgcagccattgcttctccttatacaaattcgtcgtagttcctgccaactactgagtaactatatgcgctccccgcgctgtcgtaaccgccagtcttaaaagtctctgccaggtcattatatcctgcctcggcttccttatcagcctgtacctggcctctggcagctgtagcgtacttgaccggatctgccggagcaacatctgtcgcagcgtctatgcctgatatacgctctgtgtatgccttcgaaacttccgaagtgctccctaccttaaaggcataatttcgggaaccactgatacgaccaactctgccaatcgataatcccatatattcctgtcctcaaaaaatactctctaacgccacaagtataagatatctgccgcattttttcaagcaatttttattctacaagaggcggagtgtcgactccgcggaaaacctcctcgagcatacctatatactcctgataagccctgagatacgaaaggtcctttaaaacataggcgacgctcttgtagtaccatgcctgctgcttaacgtctttcatgttaaacttcgcccagatatctcctccgccctcgcggaagtcacggacagatgagcgcatgttgctgaccttgtcggcaagcattatcatcttcgactccacaggagcgccctctatccgttttaaattctccacttttctgatgtgccaggtctgatccttcggctgtccttttctcttgttctcggattccgtgcagaccagctcagttatatgctcgccaaagttctctcttaagatctcaggtgtacattccgtatcctctatgacatcgtggagtgctgccgcacagatggtgtcggcgtcgtctgtcatttttgagacaatgcccatagtctccatcggatgcacgatatacgggatattatttcccttcctgacagctcccttgtgccactctgcagcgaaccttatcgccttctcgatccggagcctgtcttcagtatcatccggctccacaaactcaggaaactcggccgcaagcccggctcctttcagagaatcgaccctggtcttctcggtctccggagtcaggataatatcgtcccatctgtccttcgggatcgcaaggccaaaataccgacactgattaaacggaatctcccctttgcacagagggcagtccttgcagaacgatatcccatcccagagcaccgtatcggccgccctgcaatagtagtcgcctgtctcatcagttacgatgcgatggtcgagcagctgataactgcaggtatcatttttttcaataatctgctgcatatattcctcctctcgtgaaaggggctgtatggattaaaaaatctgcttatttagatgtaattttagttgttttaggctgcaattgcaactaaattattgcctccgctcccgaaaaaaaactttacaaagacttcaaagaagagtaacgtaatttgcggatggtattcgaaagaaactgtacccgcattgatcccgcattcggaatcacttttttgcggctgactcataagagcagccagcatatatcggaggtgatgggatgaaggcaatgatcgtgcaatacgcagatttttatgactatacaaggatactgcccagaatggcggtatcatttttttcggttccgggcgcggaagatgcaggagtttctccatcagacactttaatctttcaaagaaatggagatcactcaaatgaacacgaaaaagaaaactttaaaccttgtgcttacagcacttttcacagccattatcgtcctgatggcattcagtccactgggatacatcccgcttggagtcatcaacgcgacgataattcacatcccggtaatcattggagctattttccttggacctggaacaggcgccttccttggatttgtattcggtcttacgagctttatcaaaagcaccgtgacaccgtctacagtcagcgccttcgtattttcacctgtccttgcagcttcacagttcggaatcagcggagtcttcaagagcgcatttatctgctttgttccaagaattctcgtaggcgttttcccttactacattttcgtacttatcaagaagctctcttccggaaacggctcgaaggtaaagatagccgtactcgacgccattatcagcctgatcgcattcgcaggtctttcacagctccttggaaggcagatgaagagcggttcagtcgtactcgctgtcgttatctccgcagctatctttgcagcacttatgatcatctctgtcagaaatgactccggagtcatcggatacgcttacgccggacttaccggtgcgctcacaaacactctccttgtaatgccttcgatctatattctctacgcagaagcttatgcaaaggctacaaatgtggcacagaacgcccttctcggagtcatcatcggaatcatcggtttcaacggagtcatcgaagcagtgcttgccgctgttatagtatcagctgtttccggcgctctcgtccacgtcactccgacctacgctgtcagaaaagcttcaaaaaatctcagacagcccgcctaagcattgtaaatttttccgccttgacatataattatcattaaacattcttttaggaagaaaggtatacgttatgggcgcattagaaaatgaagaagtaaaccagcttgtacagaagctgttatccgattacggcaagggccgcgacattgataaaatggcagtcttcaatcagcccgacagagagaaagtcgttctgatcacgaacaagcttcttcgcctcgttttcccgggatactacagggagaagttctacaagagctacaacctgagtggaaaccttacggttcttatcgaagatgttctctacaacctgagtcagcagattgagatcgtgctctgctatgaagagatcacgaagcgcggagactccggcaaagatgctgctctgtctcctgaagagagcgcgaagttcaaggatcaggcatactgcctggcgcttacatttttaaacaggctcccggagatcagagactatgtcgagtccgaccttatggccaccttcgatggcgatccggccgcttcaagtctcgacgacatcatcctctcctatcccggcatcaaggccacgacgattaaccgcctcgcacatgtactcttccttttaaacgtgccgctgattccaagaatgatgacagagtatgctcactctgtaacaggtattgatattcatcccggcgcccagattggcaggtatttctgcatggaccatggtacaggcgtcgtggtcggctccacaacgatcattggagaccatgtcaaggtttatcagggcgtcacgttaggcgccctctctaccgccgctggccaggctctgcacggcataaagcgccacccgacgataaaggacaacgtcacgatctactccggcgcctcgatcctgggcggcgagaccgttatcggggaaggttcagtaatcggctccaacgccttcatcaccaagtcgattccggccggtacaagagtcacgatcaaaaatcaggaactcgttatgaaaggcaaggacggaagcatcattgaaaaaaatgatctgacccagtccgatgcctggttctacgtcatataaaaacacacaggccccgctgcaaagcggggcctgtgtgtttaacttgaaaatataaatgaaaagactatctactgataaattcttcgatcctgttatcagtctttgactttgcaagcttcacatagatggcagcattctttctattgctctctatctcttcaggtgtcatttttctgatcagcctgcatggattgccgaaagccatgtaaccgtctggtatcaccatttttccagtcacaagggagccggctccgacgatgcagtcgcttccgacttttgcgccgtttaaaaggatggcgcccatccctataagggaattatctcccactgcagagccgtgtacaatagcagagtgccctatagtcacaccctttccgacatgtaccgtaaaaccgttcccacagtgcagcaccgcgcagtcctgaatgttcgtatcagaatccacgaaaatactgccctcgtcgccgcggacgactgcgttcggaaacacagagacattttccttaagtgtcacgacatcactgatgtatgctccaggtgccacataaactgacttatctatttccataaatttcctccattttttattagattatagtcccagtgagggcaatcgtcaaattcaactggtcataatattttttctaaatctggatattttcttatcctcagcaatctgatataactctttgcaacggaaaaagaaaattttaataaccagttttacaggaggaaaagagaaaagatggctgaagaatcaaaagacagagtacagttaaacagaggactcgcccagatgttaaagggcggcgtcattatggatgtaacgacgcctgaacaggcaaagattgccgagagcgctggcgcctgcgctgtcatggcacttgagaggatcccggcggatatcagagcggccggcggagttgcgaggatgagcgacccggcaatgataaagagcattcagaatgcagtttcgatccctgttatggcaaagtgccgcatcgggcatatcgccgaagccgagatacttcaggcgataaatattgactacatcgatgaatccgaggttctctcccctgccgacgacgtctaccatatcgataagaccagattcaaagttccgttcgtctgcggagccagggacttaggagaggcactccgccgtattgccgagggtgccgcaatgatccgcactaaaggtgagcccgggaccggcgatgtggtacaggctgtccgccacatgagaaaaataaacaggcagattcacgagcttacagccctccgcgacgacgagctcttcgaagccgccaaagagcttcaggttccatacgaccttgtgaagtctgttcacgacaatggaaagcttccggtcgtaaacttcgctgccggcggcgttgctacgcccgcggatgctgcccttatgatggaactcggagccgagggtgttttcgtaggttccggaatctttaaatccggaaatcctgccaaaagagcagacgcgatcgtaaaagctgtcacaaattacaaagataaggagatgctcgcaaagctctccgaaaatctcggtgaagccatggtaggaataaacgccgaagagattaagactataatggaggagagaggcaaatgaaaagagtcggagtcctcgcgcttcagggtgccttcatagaacatgaaaaaatgctctcctccctcggcgcagatacggtcgaaatcagacagcttagggatttagacggaatagatgcgctcgttctcccaggcggcgagagcacgacctgtggaaagctcttaaaagacttagggatcatgtctcctttaagagagatgttaaataacggcctcccggtctttggcacctgtgccggcgagatcctcctcgccgaaaagatcgacggaaaatcgtccgattacctcgctactgttccaatcgacgttaagcgaaacgcctacggccgccagctcggaagcttcaacacggtttctgaattcaaaggtataggagaggttccaatgacttttatccgcgcgccgtacatcacctcagtcggcgatggcgtagagataaaagcctgtgtcgatggaaaaatagtcggagcagagtacaataacgagctcgctatctcatttcatcctgagatttcaggagagacttcaatccacaggtactttcttgaaaaaatggtcagataaaaaattacgaagcgctctcctgcctctctatctcgcttttaatatcacttactacatccgaaaccctgtacttcttcagatcgttctcgaaatcctgctgtgcttccgcgagctttccgtcgagcgccgtgtggatgtttctcccgacagggcactccgggttcggattttcgtgaaagttgaagagatggtccttgttcttctcgaccgcctcgtagacgtcgtagaagctgatctgatcgagaggcctctttatcacgattccacccgggccgcgcttcgtctcgataatgcctgctgccgagagatccgacataatatttctgatgatgacggggttgctgccgatgctcgatgagagcaggtcgctcgtgactttctgcgtagcgccgaagtagtcggcagctgccagtatatggattgctatagtaaattttgttgaaatctgcatattatcttctccttaaaaatgtaatataaaacatttcatccattttgtcaagccgcttatactaccttttttaagctcctcttttgtgataaactatttagaaaagaaggacacgacgaaaggagcatccatgaatatagtatttttagacagaaaatctctcggcgatgatctggacttcagcccgtttgagggacttggaaatgttacatattacgactttacagatacaagtgatccgaagcaggctgccgagcgctcagccgacgccgatattcttatcgtaaacaagactctcgtaaatgagcagaccatcggagctgcaaaacatctgaaggtagtctgcgtcactgctaccggcaccaataatctcgacatcccctacctcgagagccgcggcatccactggcacaatgtggccggctattctaccgactctgtcgcccagcatacgatagctatcgccctctatatgtatgagcacctgccttactacgacgaatacacaaagtccggcagatacgcagacgacgtgctcttcacacatttcgcaaagacattccatgaactaaaaagcaggcagtggggcatcgccggcctcggcgccattggacgcaggacagccggaattgccgctgaactcggctgcaaagtcgtctactattctacctccggcatagaccgccctgaaaaatacccgcgcctcgactgggatgaatttctcgcgacatccgatatcatttcgattcactctccattaaacaagcacaccgaagggctcttcgacaaaagcgccttcgccctgatgaaaaaagattccctgcttgtaaatgtggcacgtggccctatcgtagtcgagcaggacttagctgacgccttagacagtggagagatcggcggcgctgctctcgatactctttcgattgagccaatgtcgcctgacagcccgttccttaaaatgaagcacaaggacagaattcttatcacgcctcacatcgcctgggccgccaccgagtcgagacagaggcttatggatatgatctacgaacaggtaaagagcgaagtaagtaaactatgacaacgatttttctggcacttcagcaggaggccgcaccactgataaaaaatctcgggcttaaagcttcctgcgaaagcccttttaaaatctacgagtcctctgagataaggctcataataacaggcatcggaaagctaaatgccgcttccgccgccggtttctgtctgggaagattcgggactgattcacattacattaactacggttctgccgccggcccatctgtcctcacagggcggagtgtctttgcagctcagataagagacttatcaagcggcagagaatatttccctgatatagcggagaaagtctttcctcacgtctgtcttattacttcggacaccccggttgaaaatgtaagagactctcgggctgtttttgacatggaagcctccggcattttttctgcacttcagaaggcagtgactcctgacaggattacaataataaagacagtaaccgacagcggaaatccggatttttcaaagactaaggagctgctttccaaagcagcagctgatgtcacctcatacattaaaaaaatatcggagtcagattcagaaaaatcctgtgaaagatcatcgaattcagattctttcttcgatgcactctgttctgatctctgctcttctgagtccatgagactgcaactcaggcagtttctgcgctacagaaaatccgcaggtgagctcgacgaatttaagcttaagataaaagaactgtacgaaaaacacctgctccccgcgccggacaggcggcacggaaagcaggtgctttcagtattaactgaaatctgatctgaatttacggacggcagaggaagtttttctggcttactccatagtaggcgttgtcgtctcctcctgtcgccttattggcgaagttcaaacctaaaaccggctttcccttcgaattgaaggagtcgaaggtgtatccagcaaacatctcgacatggtatatgcctttatatctgcgattatttgctcctgtctcaaacagaaggtctcctacctgaaattttctcgcctgaaagttcttgtacgaagcgcttgcgactttcttgtgcttttttacaaggtattcggcgaggccagcggccgtcggcgcatatttcttgtatagcatccggattcccctgctcctgtaggctctccagaccagtgaagagcagtcataatagcccttcttcattctgttcttctggctgtatctgttcttgttggagtaatttctatcccacttgtagactgcgtatcttaacggtgtggtgacatttacagcagtgccgtatctgcaggtagtcttcccgtacttcgctgtaactttaataactgcggtacctgtttttttggcttttacttttccggtctttgaaaccgaggcgatcttcgggctgaggctcttgtatgtgatctttatgccttttttactcttgctgcccgaaagcttaagctttacagtagtcgacttacctttgacaagcatgtaggatcttttgcttaatgacagtcccattattgtcagcttaaacgagagcttcttcgttccgatcgtgacgtttaccgtcgtagttccggtaccagaagcctcaaaacacagcttattgttctcaatataaacatcgtagacactgatcttctttcctgtgtttgaataatccagatcaatgtcgtctaagcttactccgtcaggaacgccttttaagactgtactcccatttacactgtcatatcccaggtaagaattcgaagccaaaaatgtaaaagaagtcttttcaagggtaatctttgaataatccacctgcggttcaaccggtacatcacctgacgctgaagtctggcttggttcatctgctctcgccgttacagcgggaactgcagtaagaagcatagcggacgacaacagtactgtaaaaattctaatgggtttcatgatcttccttgtttttttattattctttaaaatattctactgaacgctttaagtcttcggcaaggttctttaaggaggcagcagcgtcgtttatgatcgtaaaggtgcttacaagctcctgcatagaggcattcgtctcctctgtggatgcggcgttctcttcggaaatagccgagagatccgaaatgatctcggtgagggacttctttgaagtgttgaggccatctatacgtccggcaatctcatccactgcgtccgcaacaccgtttaccttgtctctcatgttacgaagctcttctcttgtagtattgagcttctcttcctgggcgctgaaactgtcgttcaacctgcccatcgtagccactgaagtcttggaatttgcgagaagtctctcaacgatctcagaaatctgatctgccgacttcttactctggtctgcgaggtctctgatctcatctgctacaaccgcgaatcctctgccggcttctccagccctcgcggcctcgatcgacgcattcagcgagaggaggttcgtctgcttcgcaatatctgtgatagcgcctgagaacttcgaaatctcctgaactgaatcattggtcgaaccgatagtgtcgccaatatcgttgaccgactgtgtgacatccttcgactgctctgcaagaagccttatagcatcgactgtcttgctgcagctgtccttcatctcactggcatagtccttgagctgcgtgatattctctgaaatctggtcgatatcggcgtccatactgctcgtatcgttcgctgcggtctgtactgagtcagcctgattagtggctccctttgcaatatcacctacagccgaagatacctgatttgaagcactgttggcctgatctgaagagtttgaaagattggtgctcgactcatcaagttctcccgtcatcctcttcgtctcaccgatgatagagataagtttctcgtcaagagtattaacgtttctcgaaatagtgccaagctcatcatttctgttctccatctttttatcgaacctgatagaaagatttccatcggccagtgtcctgatctggtcggagagctcgttcatattcttagattcacggttcgttacacgaatggcgataacagtcagtacaacaaggaagcagagtgcaatggcgatcatcatcaaagtagaacccagtatctcgtgatcagcggcattccgatcctctgcaaccacgatatatcctaccgcgtttcccttcgcatttgtcaaagtcctgaaatacgcgcagtagtttctcccctcgatagatatcgaagactcgaaataaccgttgcccctggctgccttctttaaaatatcttcagaaaaagtggcggtgctcctcttctttttgtcctgcgcgttctctatagtagagagggcagacttcttatcgaggatgatagtgtagtcaaatgcgctggctttcttcgcattgtcaaggatcttcatatccttgtcagtaacatcgactgccccctgatagaccttgccatcactgtcgagctccatcgtatcgtcggcgctgctcatcatggtctgattcatcagatagcccgcagccgaaagcgacttggagacattcgtgtaaaagacggcgttgatcctgttgagagacatcaatgtgaggaccgctgaatcaatgaccagggcaatgataaacagcctggcgatgtaccctatcagtttcttctgcttctttgattttgatactttcataattttttcttccttttataaaaatcaagttttaaccctctaatcaaaaattttaattcattacatctggcttgtcaatcactctttaacccgctataatgtcattgttatggaggtttttttaaaatgaatgaagtcattaagaaattcacagaagaccatatagacgagctgaaaaaagacatctccgagctctgctctatcccgtctgtactctcagatgcaagggaaggtgccccattcggagaggactgccgcaaggcacttcttgcagccggctctatctgtgagaagtatggatttaagacaacaaactacgacaactactgtatcgcagcagactttgacgagtcactgccgaagcatctcgatatgcttggccacaccgacgtagttccggccggcgaaggctggactgtcaccgatccttttacagtcatcgaaaaggacggccgcctctacggcagaggaacaagcgacgacaaggggcctgtcctctgcgctctctacgccatgcgtgcgataaaggaatccggcatccctctgaagagaaatgtccgcctgatcttgggaagcgacgaggagacaggttccatcgatatcacgaagtactatgcgaaggagccggaagctgactacaccttctcaccggacgcagagttccctctgataaatatcgagaaaggccagttccgcggcacttttaaagcagatgctcctgtatcagacactggagtgcagcttatttcactaaatgccggcgtcgcactcaacgccgttccaaaccgctgccgtatggaatttatcggaacagacagacagatgcttgaagacgcctgtgacaaattaaagaaagagattccggtagatgcagagatttcagatgacacccaccttactataataggtgagagcgcgcacgcctcaactcctgagatcggcgtgaatgccggactcgcaggcatcaccctgcttaagttcctgcctctttcaaatgacaggagaaatacccttctctcgaaagtccttacgctcttcccttacggagcctacgacggaagcggactcggtatctctatgacagataaggaaaacctttccctctcagccacactcgacctgttctctgtcgacagagacggcatgtcattctcattcgattcgaggactccattaaatgccagcgacgagaactgccttgcagtcgcagggaagaagtgcgaggatgctggctttaccttcgagacacctggcatcgtaccgcctcactatgtcccatctgactcagcctttgtaaaagacctgctcagtgcatataacgatgtgacaggtcaggacggaaaggccatgggaatcggcggcggcacctatgtccacgacatcaaaaacggtgtcgcattcggagccgttcttccaggaattgatactcatatgcacggtgctgacgaatttatcgacatcgacaatctgacgacagctgtcgaagtatttgccgaggcaatacttaagatctgcggctgatacgatatttttacatgaaaaaaagctttctgcggcgtgacaccgcagaaagccttttttattttaatcagtcttccttctctgagaggatcttgtcaatacttacaaggcgcacgcatacagtaaatatctgtgctgcctgctttaactcctcaagtggcggataggatggagcgatacggatatttttgtcgtccggatccttgccatacgggtaagtagcgccagccggagtcagtgtaactcctgcctctttgcacatagcgacgatcttcttggcgcagccgttcaatgaatcaaatgagacaaagtagccgccgttcggctttgtccactcgccgacatcgaggcctccgaggttcttctcaaagatatcccaaacagcttcaaacttcggacggagtatctcggcgtggcgtctcatatgctgcttcatatttgcaagatttccaaaataacggacgtggcgcagctgattcagcttgtcgtgtcctatcgtctgtactctcatataggatctgacatcgtcgaggttcttcttcgatgctgccattgcagcaagtcctgaaccagggaaggtaaccttcgatgtcgagatgaatttatagacaatatcaggatgcccggctttacggcactcatcgaggatctctaatatcacatcctgattctccggctcatcatagagatggtggatggaataggcgttgtcccaatagatacggaaatcaggagctgccggtgtaagggcggcgaatctccttacagtctcatctgaatagctgtagccctgaggattggaatactttggaacgcaccagataccctttacttcagggtcattgttgacatactcctcgaccatatccatatccgggccatcaggtgacatcggaatatttatcatctcagcgccgaaatactcagtgaccttgaaatgtctgtcatatccgggaacagggcagaggaatttccagttgtcaagcttacaccacggagtgtttccacagacgcccttcgaatagcttctcgagatctggtcaaacatgatgttcagtgaagagttgccgaagatgatcatatcatccgggctcacttcgctcatctcacccatcagggccttggcttctggaataccatctggaacaccatagtttctgcagtctgtaccggtctgatcgttgaaataactattggaatccaaaacatccatcaattcattggagagatcgagctgtgccttagacggctttcctcttgccatgttaagtgaaaggccctttctcttccatgcatcgtactctttctggagattctgtctctcttctaagagttcttctttgttcatctctttgtaagtcataatttcctccaactaaacaaaccagtctacagtcttttttagtctagcacttgtcaaattaataagcaatgcgattttctgaaaaaatacactgaaatacggctttatttctgaaaaaaaacacagtaataccgttttatatgatagaataatataaagtttgtatttgattttaaaggagacaaagtatgtatgctgatgagggtgttataaaaataaagcacgacgtcatgacgtctgtcgcgaagctggcgtttgaagggactttggaaacggagaaggaatttatcccgtttgagatgatacctggaccgcaggcacagtttcgctgctgtatctacaaggagagggagatcataagggagcgcatccgccttgcctgcgatcaggcaccggggcctgtcgacgatggcaatgtgatccaggttctccatgctgcctgcgaggactgcccgatctcatcctatgtcgtaactgacaactgtcagaactgccttggaaaagcctgcgtttcggcctgccgtttcgatgcctgccatccaggcgagcagagaagccacatcgacccgaagaaatgcagggagtgcggcaagtgcgcccaggcctgtccatatcacgctatcgccgcgctaaagcgcccgtgtaaattttcctgcccggtagacgccatagaatacgacgagtatggcatctgccgtatcaatgacgacaagtgcatccgctgcggtcgctgcattcacagatgccctttcggagccatcgattcgaggagctacatcgttcctatcatagaggctctgaagtctgacaagcctgtttatgctatggcagcccctgctactgagggacagttcgggccgaagatcactatgaattcatggaagaaagccatgaaagaactcggcttcaaggatttcgtagaagtaggtctcggcggagacctcactgcgaaggctgaagcttgtgaatgggccgaggcctacgccaaaggagagaagaagtccacgagctgctgccctgcctttgtaaatatgataagaaagcactaccctgagcttgccgacaatctgatatccaccaccgtctcaccgatgtgtgcggtttcaagacttatcaaggccaaagaccctgatgcggtctgtgtcttcatcggaccttgctttgcgaagaagagcgaagccatggagcatcacatcgagggcaacgccgactacgtcgtgacttacgacgagatttcggctatcatggaggcgaagggcgtaaagctcgaacctgacgacggatacacctatcaggaagcctctatctttggaaagaggttctcacagtccggcggagttacggcggcagtcctcgaatcactgaaggaatcagacatgcacattgacgcaaaggtctgcgttgcgaacggcgccgcagagtgcaaaaagcagcttcttatgttgaaagttggccgctttaccgatgacttcctcgagggtatggcctgcgagggcggctgtgtaggcggaccgtcggcataccgcgagaggatgctctttgcgaaggaccgcgagactctgctgtccgaggccgacgacaggactctgaacggaaatctcgaaaattatgacttgaattcattctcaatgcacaggtgatatgattaaagaattcagattagatgaacttaacagcggcgataagacagtggcggattttttgcgaaagcatgaaatccgccttattctgccatgcggtggaactggtgtctgtggaaaatgctctgtgaaagtcctcttttttcatcgagaaaaaattctaaaaaccttcgacttccccgcctgccagtatactatggataagcttcttaaaagcatacccgctggatctgactgtatccgattcgatattccggaagattctgtaataaaatctcaaaagctgcaccagtctgcctctgatggcagaccttatcttgccgcagtagacttaggcagcacgactatagagacagctgccctctccttagatggagaagtgataggaagcgaaaggtgccgcaaccctcaggtaagctacggtgccgacgtaatctcacgcataaaggcagcgagcgagagcatgatagccgcctccgatatgcagcgtctcgccgagagcactataagaggctctctcgaaaagctctccgccagatacagcctcgccggacttcctgaaaaaatcgccatagccggaaacactacgatgggacaccttctggacgggcaggatgtaagtccgctcggacaggcccctttcgatcctggtgatatttctctgaaagacatctcgaaggtatttttcacagataaaaggcctgtaatactgcttcccggaatctccacctatgtcggcggcgacatcacaagcggcatttttgatctggatatagacagatcagataaacctcagatgcttatagaccttggcaccaacggtgagatggccttaggtgaccgaaacggcatctgggtcacatccaccgccgcaggcccggccttcgaggccgcaaacataagctgcggagttcccggaatccctggcgctgtaaaaagagtcacatttaaaggacagactgcgcatcttacgttaatcccgtgggataaggaactctcaaagcttccaccgggtgtcaggatgcaggaagaactccgccttagagcaaagcggcctgcagggatctgcggaagtggccttatcagcgcagtttcaggcatgaaaaaagccggcatcatagatgataccggcgcatttacgagtgatgagtggagaaaatacggttttaagctctggaaaccatctcctgccacaagaggtgaatcccctgtcgtgataactcaggacgatatccacgagcttcttctcgcaaaatcagctgtcaggagcggaatagagattcttataagatcatacggcacaacccctgaaaaaattttcctcgccggaggcttcgggagcgcccttaccatagaagatgcagtctctatcggaattttcccggaagagctctcttctcatatagtcgctgcaggaaacacctcactgaaaggcgcgatcaaatttttaaaaaatgattctgatgaaaccaggcatcgccttgcggcgataaaaaatctctcacacgaaatcgttcttggagacgactctgacttcgaagacctttttatcaggcatatgagtttctagcgggacgccttgcggcgtttcttcatctggtacatcctgttgtcagcgagctcatataccatatctggagtcatgttgctaagctcatctgacgatgaaactccgtagctgaaattgatatcgtattttcttttagtactgatacctgcttccatttttttcattttgtggagagcttttctgacaaatctgccttttcccgcatttataaggattaagaattcgtctcctcccatccttacaacgcttccgatatcttcaaagcaggttgtcaatatatccgcgcagtcctgcagcaggctgtctccagccgcgtgtcccatcgagtcatttacggtcttaagcccgtttacatcgaggcttatgacctgatactctgattcggattccttcagcttcttaaacctcgcatcgatccaggctctgttgtggagtccggtcagcacatcagtatatgccagttttttcagagcctcctcctgtgcctgctctgagaagtaggtattcacctgattcaggtagataaacatgataagaattataaatacaactgctatatacggcattatcgaatgaaacagtatcctgttgtctaagatcatgctttttttgatgttgaatcggatcacatcacagacagctccagtcagaacgatataaatactgcagcgttcgagcagattcccccgtgtcctctcctgattctttgtaccatagatcagcaggcaggtatcggcaagcatcaccatctggaacaaaaaatagaagtgaatcggattgactatcgatgtgtattctacgacaaaagcagtcgcaaagaataccgccatgatcacaaagcttaaatgcgcacagaaattacgttttttatcgggatttacccccctgataaaaatgcagagttcaatgaacggcaatgtggaaaagtacagtatcagatgttcaagccttgtattggcctggtatgcagttgaaaaaagctctatgacgccgactctgcagaatgtccatactccgattgaaaaagagagaagggatgccgcaagaggcttctcccaccttctcttcaaaacgaaaagaataaaagccacgaaaagcattataatcccattcataaagaggaaaaatcctgcgagacttgaaatgagatctatgcttatgtaactcgaggagatctgacttgccgggataacgtgaaactggggaaggctcacaaaagcatcgtcaagccccggactaatgataatcctgcattgttttcctgccgcatcctcaggaaggcttaccatgtgtgtcgctctccctggtactcctttcgatccgtcaggttccttcagatacgagtatgtgtatctgccgtttatatacacttcgacatgggcatagtccgtttcaaacacgaggattaaattctttccaaatgtagtcggaatcgtattattcagctcgatcgtatcacccgcctcaattcgttttgggaagcggaatctgtttaagttgacattcctgtacgttttgtcgttatagtctacactccagccatctttgaataagataggcctgcttgcgctaatctttcctagtccgaagacaaaaagcataaccatcattaaagagaccgcaaaagccattacgcccctgactggagagactttttccctgctgtcttctaacattcgcccctccctttcctcgattcaaacttcatctgatacattctctgatcggcgagcctgtagatatcctcacctgaggcatctttcagctcatccgaatatgcatagccataggctgcatccacagtgatattgataggaagactggcgcttgtctgtctctcgagatttttcattctctcaaatctctcttcaagcagaccctcgtccatgatatttttatcgtagacaaccatgaactcatctccgcccatcctgcagatgatgcccgcatctgagaatacattccgaaggatctttccaaaagtcttcagatacagatctccaccggcatgtccgaacttatcgttggtttttttcaggaagttcaagtccatgttgataatcaggtaatcctcatttaccgagtcgagtgcggaaagcgtctcttcaccgctgtttctgttcgaaagccctgtcaggtcatcgtgataagcaagagcacgaagtttcgctctctcctcatagttgtatctcttctcgtataatctcaggacatagccaatcaggataaggaccaccatcgtaatgagttctaaaggtattataatcctttctaaaatattcggacccatgccattcgtctttgaaaaatagaaataaatcagatatgcaagagtcgccgcaattattacaatgacactgccctcgaaaaattttcctgaaagagacgactttctccagtatttgatggacataagttcgagtacaataacatcaaacaggataatcagatgaaaaggaagcaggaaaacgtttacatttgcaatatagagtctctggcagataatagccgcgataaatagggaggcatccagaagaatagataatgaaaacgatatcttatagaatgcagaaatcttcttaaaggttctgagcacaagagcaaggagtggaatagaaaatatgtacagtgataataattcgaccagactgtcgactctgatatcctgcgtaaacagctcgatagacttcatgctgcagaacgaccacataccgctcgtcccgctgaaaagcccgatcagagccaggtccacaaagccgggatcaacaaaacaaagaccgctggcagcacaggttaatacagcacccgccaggatcagaaacagtgagataaatgtcccgaccgacctctcctgcacgaagttctccatcgtattgttcgacggtgtaatctgcacctccggaaggcttactatagcgccatcctctgaagccatctccatgatcttcagcgtcacgccatagtttctctgtggaagctgtataaagtgatatccgctgcccagaaagtctttagtcctgtagttgtcgctgtcgtagccataatagtacagaagctcttcttttccacctggctcaatgacactgacacgaagagatgacaatctcgaatagactctaagagtcagtctgttctggaaattctgcttcgatacgatgtcaatctttttcttcatcgtgatcacatcattcttcttagaatccagattgataaagcgtttgtcatctaaagatacgttgctgtaagtcctgccctgaaactttatctgccagcccttgtcaatcgggaatacagagtatccccctctttttgacaaaaagaaccatatgacatttatcaccagaaatgctgcaaatgcaaacagaaagacagcgatgattttttttgtatatttaaaaattcgtgtattcttcttaacagcacttttttccattaaaaatcccctgttataaaactcctattgtgattttaccacagacaggggacttttaaaagctttaattagctatagcaaacgaaaattcgcactttacagccattttatctcccacataggcagccccctctgctatccccacattttttttaagatttataagtctgcactcgattctcaggatatccccaggccttaccggtgcccggaatcttgcgttttttatgccgccaaacatagggattctgcccttgaattcatcagaagtcattatcgcgcaggcgccgcactgggctatagcctcaagagacagtacccccggaaacaccggatactctggaaaatgtccggcaaagaccggatcattcctgctcataagtttctcacctacagcccactgcttcggttcgtagtcaagtatcctgtcaaccattatcatcggctgcctgtgcggcaggatacgctcgatatcatcacaggtcagaatattgggattttctcttacaaggagtctttccataggatcacacctttctcatcaggatgcaggcgttgtggccgccgaatccgagcgagtcgctcatcgcgatatttacatcctgctttatacccttcttagccacatagtcgagatcgcagtccgggtcggccttatctaagtttgcggtaggcgggatgaagccctcttctatcgtctttgcagtaaagacaccttctacaccgccggctccgccaagaagatggcctgtcatagattttgtagaggagatctttaatttctctgcgtgctctccgaaaactgcatggattgcctttgtctcggtcagatcgtttaacttagtcgaagttccgtgcgcgtttatatagtcgacctcttccggcaatactcctgcgtcctcaaggcagagcttaaagacatctgcagctccctctccgctcgggtcaggcgatgtgatatggtaggcgtcgcagtttgccccatagcctgcgatctcgcagatgatattggcgtggcggtcataagcatgctgatactcctcaagtacaagcagtccgcagccctctcccattacaaatccgcttctttcggcgtcgaacggaatcgacgccctgtccttatcatccgacttcgtaagcgctcccatatttgaaaagccgcccatcgcaagagctgtgatgcagctttcagttccgccgcagatcatcatatctgcatatccatcccttatcagatggaagctgtctccaatagctaaggttcctcctgcacaggccgctaccgggcaggttgccatgcctttaaggccgtatcttatagccacctggcctgctgccatatttgctatagacatcgggataaaatatggtgataccctctcgaatcccttgtccatacctcttaaatgctgctcttcgatcgtcgtaaggccgccgattccactcgaaatatcggtgccaaacttcttcggatcaactccatctgcgagcgagccgtcttcatcgataagccctgcatttttcattgcctcatcagccgcagctaccgcgtactgtgtgaagatatccatatggcgagcatcttttttcttcatgtatttaagcggatcaaagtcctttacctcgccggccagcttaacagaaaaatccggctccgaaaatcttgtgatcggcgcgatccctactctgccgttttttatattttcaaagctctcctcaaccgaaaggccacacgggttaactgttccaagtcctgtgattacaactcttctgccggccttcgccttgtctcttatctttccactgtccattacattcctccatcgactgtcaaaacactgccggtaatatacgatgcatcttctcctgccagaaatgctgcagcagctgccacttcttttggccttcccattctcttcatcggaatctgtgaaagcagggctgtctttgccttttcagggatcgcttcagtcatctctgtctctatcatgcccggcgcgatgcagtttactgtgatgccacgcgatgcgacctcttttgcaagtgacttcgaaaagcctatgatccctgccttagatgccgcatagttcgcctgtcctgcgttcccatagatgccgcttacacttgccatattaataatgcgtccccatttgcgctttatcatgccgcgcagcattttgtggctcatcaggtaaacactcctcaaattcgctgcgatgactgcgtcgaaatcatccggcttcatcgtaagaagcagaccatctcttgtgatcccggcgttatttacaaggatatcgatgtctcctgcttccccggctatccgctcgacgtcttcctctttagaaaggtcaccagagacaaggattgcatcctgcgtcaggtgactttttaactcttcaagcttagctgtatttttgtggcagtggaggacgagttcatatcctcttctatcaaattctccggcgatcgcgctgccgatcccgccgctcgcgccggttatcagtactcttttcatagattaaattttcctctgtgttaaggcgcggcactcttctcaaaggttttcaatatcgtacgccgtatttatggttcttatcgaaatatccttgatatcaagcgcttttgcgcatttttttacaaagccggaaagtgtctttccaggtccgatctcgataaaatcgtcgcagccctcttttaaaagtgtatcgaggctgtcttccaagcggacaggattctgtacctgccttacgagaaggtctgtgatcttcttatgctcgtcgcaaagaagctttactccaccgtcatcacccgtcgcgttgaaaagtacccggcacctcaatggtctgatgtccgccttcggcaggtattcggaaagagcgtccccggcgcttttcatatacggagtgtggaacgggccgcttaccttgagagggatcacccttctcgcgccggcctcctttgcggcagcgcctgctgcagctactttatccttctcccccgatattactatctgtcccgggcagttgtagttggtcggatagcagccgctctttgagcagatccgctctaatttataaggatcaagtccaagcactgcggacattccccagtctccgccttcgcctgcttttttcatagcttctcctctgtacgctgccgctcgaagcgcgctctcggctgaaaacgcgccggctccatagagcgctgagtactcgccgagtgagagaccaagagtagtctccggaaagatgttttttgcttcgagaagctttgttacgccgatcgcaaaagccacgagagccggctgggtattttctgtctgagtcagcgcatcatctttatttaaaaaaataacatccttaaggccaggttttatgcggtctgccgcgtcgtagacttccttaaacaccggatatttttcatagaggtctcttcccattccggttgcctgggctccctgtcccgcatataaaaaagctgtcttcatgccttacctccattgcagatgtcttcaatgatctcacgcactggtcttatcgatctgatctgtcctgcagactgtcctgccataaggcttcccgtctttgtgtcgccatcgaagaccgcacgtcttaagctcccgagcgtgaatttttcgagttcttcgactgaagctcccgccttctcgctctttatgtactcgcgtgtcatgtggttttttaagactctgaccggtgttccgccgatccgcccggtaaccacagcatcagtcccctttgcctttatcagcgcatttttatagttttcgtgtatcgggcactcgttcgatgcgagaagtgctgttccgacctgcactccgcaggctccgagatcctttgccgcaagaaactgcctgtggtctgcgattccacccgctgcgatcacagggatatttactgcgtcgcatacctgcggcacgagcgtcattgtcgccatctcgccaatgtgtccgccgctctcgcttccctcggctatgaccgcatccgctccgtcgcgctccatcataaccgcaagcactggagccgcaaccactggaaataccttaatcccggcttccttccattttttcatgaaacgggcaggattcccggctccagtcgtaacaaacggtacatgcatcttggccacgagatccgcgatcttttcaatctccgggtgcataagcatcagatttactccgaatggcttttccgtaagacttaaagccttttctatctcctgctttatgcggtcacatgaaaagccgcctgatgctataagccccagcccgccggcatttgagacggccgccgcaaactctcctgtcgcaatatttgccatcccgccctgtatcagcgggaattctgttcctgtaatatctcttaaatccatctgatttccttccctcacttgtaagtgacaagcacactgccccaggtgagcccgctgccgaatccgctcaggagcgccgtatctccgggagaaagcattcccttctgctccatttcatcgagcaggataaaaatcgatgcaccggaggtgttcccgatgtggtctacattgcagtagaacttctccttcggaagcttcatcgcccttactacatggtctatgatccgcttgttcgcctgatgacagacaaagtagtcgatatcatctgtactaagtcctgcctttgagacagtctctttgatgcagtaaggcaggatctttaccgcaaagcggaagacctcttttccgtccattctgatgtatgatcttaaattctttgcgcccgggcagtttatcgcaagcgagctctctgcgccaagagtggaggcatatggcccctcttttgtcgtcattacgactgatcccgccccgtctccaaacaggatatttgtagtcctgtccgccggatctaacagctttgaaagttcctctactccggtgaccagagcgtacggcttctttttgtcctgatttgcaacaagatacgaccttgcgatttcaaccgcataggcagcgccgctgcaggccgcattgatatcgatatatgggatgtcttttgaaagtccaagtgctgactgcataaaagatgcgacagacggtgtcgagtagtctcctgaaagtgttgcagtaagcacgagtcctatctcatcctttgaaataccggatttttccagtgccctgcctgctgactcaacggccagagaatttgcactctccccctctgctgtgaagtgccttttttcaatacctgtcctcttttttatccactcgtcactcgtctcctcgatctttgacaaatcgtcatttgtgacgactctcgacgggagagcggatccggtggatattatttttactcctgtcatgattaaattcgtctgaactttctgtgtctgtctgcaagaagctgcgacggcgacatcttttgaagctcctttaaattcctgtaaattgccctgtcgagttcatcgtagactgtcacagggtcaaacgacgccccaccgagcggctcgtcaattatctcgtctgccattttattctggtagagctcgtcagccgtcagatgcatcagcgagcaggcttctgtttttttcgatgtgtctttgaaaaggatactgcagaacccttcaggtgagagcaccgaatagactgcgtattttaacataaggattctgtttgcgactgaaagtgccagcgctccgccgctgtttccctctccggtcacaactgatatcacaggaactttcaggtggctcatcatcgcaagtgacctcgcgattgcctcgccctgtccgtgcgcctcggcctccattcccggatacgctcccggcgtatcgataaaagtgatgatcgggcggttgaacttctcagcctctttaaacattctcatcgccttgcggtagccctcgggagacggcattccaaagcggcaggccacattttcctcgaccgtgcgtcccttcctgtgtcctaagactgtgaccgggattttatgaaaaagtgctatgcctccgtagattgcctcgtcctcgtcgcagaggtgatctcctctctgctcgaagaaatccgtaaacagcgccccgataaaatccttgatatgaggtctgttcgaaagtctcgcaatgtagacatgatcctcaggtgtcaggtcacggcactgatctaaaaggtcgctcctcagttttttcagatggtcgatcttctcttcgttctcgaagtatttatcttccttcccggaaacgttgagctccttctgctccgattgaatgtcctgtatctttttatcgattctttcggtctgctcgaaaatcttatctaccatggcgtgcctcccgtgactttgcagccgtgaagcatcagaagcttcgtaagcgttttcttaagctcgcttctctcgactatcgcatctacgaatccgtgctgatagaggtactcggctctctgaaatcccttcgggagttttttgccgatggtctgctcgattacacgcggcccggcaaatccgataagcgctccaggctccgccagtgtaatgtcgccaagcgtcgcaaaagatgcggtaactcctcctgtcgtagggtgtgtcagaacgcttatgtagaggcctccgttcctcgaaaactcctccaccgcgtcggccgtctttgccatctgccagagtgaaaacattccctcctgcatcctggctccgcccgatgctgaaaaaatcacgagcggaagcttatgcttgtccgcggcttcgattgctctggttatcctttcaccagccgcctggctcattgaacccatgaaaaatctgctgtcgaggactactgcgactgtctttacacctgatatctttccgaccgctgcaacagctgtctcattcagatgggtccgctcctttacactccttaatttttccttatatcccggaaaattcagcggatcatcagatgtgatgccacggtttatgaccttaaagctcttgttgtcaaagatcagcgaaaagcggtatcctgcagagacgtttttgtactttccgcagaccgggcacacatagtagtggctctcccactggctccttctcgatctcctgtggcaccctttgcacatctcaaaagggtctgtgtcaatgtattcttctgtcatgcgttcttacacttctcaatctcatccatgatatcctgaacagtaacaagcttagggatatcctcatcaggaatctttactccgcactcatcttcgatcgccatctgaagctctaccactgcgagtgaatccgcgtcgagatcgtctacgagctttgcctccggctttacgtcctccttatcggcatcaaggttgtcagcaataatttcctgtaatttttcaaaatccatggtaatctcctttcaaatagtttaagataatttagtcaagttttttaaaataaaaacgttttaattaaaacagtatgaagtatatgtcatgtataaaaaaaagtcaaggaaaatttaactaaaaaatagtttacaaaatctttgcattttaatcagctcaatggtacaatagtttcaaaagtttttattttttagtggaggaaatatgctgcaggaagttcttcataacgtatataataagcttcgtctgcatttttatacgcaggtatattctaagtttgctgatcgcgaggccacgcttactacggtcgagacattttcgatggaggctataaataccttagaccatccgactgtagcgcagttcgcgagcgcgatgaagatttctgcgccaaatgctgcttacagagtctcgagccttatcagaaagggctacctgaggaagattcagagcaagaaggatctgcggacatattatcttgaaccaacaccaaagtatgaaaagtataatcaggtaaacgaggcctatatcaaagtcgtagcaaaccgtgtcagggagcgtttttctgaagaggactacaacaagttcacagagatgctcaatataattgacactgaattgatgccagatgtagattttattggaaaagggggtaaggccgatgccggaacagaagaagaaacagacagtaagaacacagattagtactgtggtaaatgacaagccctgcggaaggataggtgtgatcttttacactccgtccacatccatcggcccatccagggatgcttttttcaatgatgtttataatggcatagtgatggaggccgccagatttgacgagcacatagaagtagtcagacatttttcacagatgaacgccaccgaccagtccagggatatcgaagctatggcgaagagcggtatcaagggtcttatcgtcgcgccgattgccgatcccctggtcgcagaaactctgcggaaagtgtctgagaagggtattcctgtagttaccgttcacactgatattgaaaactcagggcgtattgcctatgtaggcactgacccctacaaggccggaaaagccgcagccgcccagatgtgccagatctgcgatgcagataccgaagtcggcattgtgacaggtttccgccgcatcaaagtacacgaggaacgtattaggggctttatggattatcttaaggacaatccgaagaacctgactgtggattcgatcggcgaatgccgtgatgaagattacaaggcttacgagatcgttcagaagatgaagacagaccacccgggcatctcggcatttttctttgccaccacgaatggcgtatatggaggatgccgtggaatatttacgatgactacgaggcttaagttccacgtgatcactctgggtgtttacgattccacaagagaatacatcagaaaaggactcatagactgtgcagtctatcagaatcctttgagacagggtatagatgctgtaaggattttagctgataaggttttcgagggacgtgaaccggagaacgagatcacgtacgaggagctcgccataaagacacctgagtgcctttatttgtgagagttctctacgatctgatccatcagatcgatcacatcgtcccgtccctgtcctgtcacggatgagaatggaagtattattatgccagatggagcatgggtgttcgcacttatgctcttttttatctggctgatatttttttgaagctgactgcgcttcagcttatctgcctttgtagcgatgatcactgtttcgatctctaaatatgcgagatagtctatcatctgaaggtcctgtgcggtcggctcgtgccttatgtctacgatcagaaaaacagcctcaagctgctcagatgcagtcaggtacatctcgatcatcctgccccactgctttgacgtctcccttgagatcttcgcgtagccgtatcccgggaggtctacaaggtagagttcactgtttatattgtaatagttgactgtctgtgtctttcccggtgacgaggaagtgcgggcgagtgactttctctgcatgaggcagttaataagcgaagattttcccgcattagaacgaccggcgaacgccacctcagggtgaacgttcgccggtaatttactcgttattccacagacggtctctaattcaaccgactttattttcatgcgctttccttttcagacttcttatcctcgatagatacgaccttatcggacttgcgctcctgaaggataagatgctcatctacaatgtcctttgtgatgttgagctcatgtacgccatcctctgaaggcatgtcatacatgtaatccatcatgactgtctccataatggcacggagtccacgggctccggtctttctctcaagtgactttctggcgatctcaaccagcgcgtcatggtcgaaagtgagctttacatcgtcaagtgcaaaaagtgcctggtactgctttacaagagcgttctttggctctgtaagaattcgtacgagatcgtcctctgtcagaagatccagtgaaacatcgataggaactcgtccgatgaactcagggatcagtccgaacttgatgaagtcctgcggaagtgcgagctttaagagctcactctccgacttctcggaattgctgacgtctgattcacctgctgcaaatcctatgcgtctcgtatcgagtctcgactctattatcttgtcaaggccttcgaatgctcctccacagataaagaggatgttcgtagtgtttatacgaagaagctcctgctgaggatgcttccttcctccctgaggaggaacagatgcctctgttccctcgaggatcttgagaagggcctgctgaacgccctcacctgatacgtctcgggtgatggatacgttctcgctcttcttcgtgatcttatcgatctcgtcgatatatacgattccaagctctgctctcgggatgttatagtcagctgcctggataagcttcagaaggatgttctcgacatcctcacctacatatcctgcctcggtaagtgtcgtagcatctgcgatggcaaacggcactccgagaactctggcaagtgtctgtgcgaggagagtctttcctgagccggtaggaccgagcatcagtacattactcttctgcagctccacgtcagtcttctttgcgcttaagatcctcttgtagtggttatagactgctactgagagaaccttcttcgcctcatcctgtccgataacatactggtcgagaaaagctttaagttcctttggcttctgaagatttatctcgagtgtgtccgatacatctatgctcttgaacggggagttctcagtaccgagctcctcgtcaatgatctcattgcagatatccacacactcatcacagatataagtaccgttcggtccttcgatcatcttcctgacttcggacgccttacggccgcaaaatgagcagcgaattggttcttcaaatctcttgggcatgtgtttacctcctgtatctcctgtcatcaggcctcacggcttgtgatgaccttatcaataagaccataatcgcgggcttcctcagctgtcaggaaatgatcacggtctgtgtcggctgtgatctgttctatcgtctttccagtattctcagcgaggatctgatttaatctcttcttagtctttaaaatgctctcagctgcgatctcgatctcagtagcctgacctctggctccgcctgaaggctgatggatcatgatctctgaattcggaagagccattctcttgcccttggctccgcctgccagaagaaatgcgcccatagaagctgcaagtcctacacagatcgtagaaacatcgcacttgatatactgcattgtgtcatagatggcgaatcccgatgtaacttcaccaccaggagaatcaatgtagagatggatatccttgttcgggtcctgtgactcaaggaaaaggagttcagcaacaataacagatgctgaatcctgatttacctctcctccaaggataatgatcctgtcttttaaaagtctcgaataaatatcgtaacttctctcgcctctggacgtctgctcaatgacgtaaggtactaatgccatactttagtcctccttatcagctgacttctcgtctttcgtctcgtccttcttatctgctttcttggtagttctctttgctctctcttttacattgtccatgacgaagtcaatggccttctccatcctgatctgctctttgagtgaatcaagctcgtcaggctgtgcgttcttctttaaatcctcagccttcatgttgtactgcttggccatgtcttcgattctcttatcgacatcctcgtcagtagcttcaagattctgctcctcagcgatcttctcaaggcagagagaagtcttgatcctcttgatagcctcaggctttgtgttctcacggaacttctcgatagtctggcctgagtactgcaggaactgctggaatgaaagaccgctctgtgcaagatttctggagtagtcattgatgatgttgtttacctgggtatctaccatagcatcaggcagatccatctctgacttctcaatgatcttcgttaaggcttcgtcctctttagtacgcttagcctcgttctcttttctgacttcgagctgctttctgacatctgccttgtactcgtcaacagtatcgaaatcagtagtatctgatacatactcgtcatcaagagtagggatctcgtcagtctttacctcgtgaagagtgacagcgaaaactgctgcctttccggcaaggctcttctcctgatagttctcagggaatgtaacattgacatcgaagctgtctccagccttgtgtccaacgatctgatcttcgaaattatcgataaatgagtgtgagccgagctcgagattgtagttctcagccttgccaccgtcaaaatgctctccatcaacagagccgtcaaaatcgataacgaccttgtctccgttctcagctgcgccgtcctttgtgactgtacgtgcgtttctcttcagctgagcctggatgtccttctctacctcttcatctgaaactgaggtatcgatctttgtgactgtgactccctcatatttgccaagtgtaacttctggctttgtagctacttctgctgtaaaaatgaagtccttgcccttctgtatctgagtgatctcgatcttcggtgatgatacgatatcgagctttgactcgtcataagccttaggatattcctgtgacacaaggatgtttgctgcgtcctcataaaatacatcatcaccgtaaatcttctcaactacctgcatcggtacgtgtcccttacggaatccacggattgagattcttgacttctgtctgtcatatgcctgctttatagccttgtcaagctctgctgccggcactgttacagtgatcttcgacatattctttgtgtctaagttttctacctttacgctcatttgtgttttttcctcctaaatatccgggcttttggcgaaagagacaatacgcccgtgcaatcgaatataaattataacacacagatatcctgtttgcaaggttgttttggaaatgggagcgcgaacagcgcaggaaaaatggcgactgtaattgctttatcggcgctgggcacaaaatggtggctcacttgaatcgttcgccacacatttgtgctccggcgccgtattgtcatttatcaatgaaatctgactagaggcctgtgtattattgcataagtatgtgaacacttcccgatggatgtgtaaatgaacattgtgttaaaatccaccagactggtatgctcgggctatcacatatgagggttcataaaatgcactgcaattataattatcaattacatcacatattgcattattatacacgcgaattatagcatctgaataatcttcttttgaattcatcgtgtctacaatcaagcgctgataaacatctcccatttccagtggtgtcggaattttttcagctaaattcttgtccaccttagttatatcacaatctccagtttgaagattatattccccactgaaaccacgtcaagttataaattatcagcatataaccagatgtatgcaaaaaaactccccaaccgctttcgcggccggggagcgtggttttttatttagagaatatattagttctcgtggttgattgctgcctgtgctgccgcaagacgagcgataggtacacggaatggtgagcatgaaacgtagtcgagaccgatctcatcgcagaactcgattgatgaaggatctccgccgtgctctccgcagataccgcagtgaagatctgaacgaaccttcttaccattgtcaacagcgaacttcatcagcttgccaacaccgtctgtatcgagacgagcgaatggatctgactcgaagatcttgttctcatagtaagaatcgaggaacttaccagcgtcatcacgtgagaaaccgaatgtcatctgagtaaggtcattagtaccgaagcagaagaactgagcatccttagcgatctcatcagctgtaagagcagctcttgggatctcgatcatagtaccaacttcatacttcatgtctgaaccagcctcagcgataagcttgtcagctgtatctgtaacagtcttcttgacgaacttgagctctttctcctcgcaaacgagtgggatcataatctcaggaaccatgttccaatccggatgagccttctgtacagcgagagcagccttgataacagctgtagtctgcatctcagcgatctcaggatatgtaacagcaagacggcatcctctgtgacccatcatagggttgaactcctttaatccagcgatgatgtccttgatctgctgaactgtcttgccctgagtcttagcaagcttctcgatgtcttcctcagtctgtggaacgaactcatgaagaggtgggtctaagaatctgatagtaacagggtcgccttccatagcctcatagagctgcttgaagtcgtcttcctgatacggctcaatctttgcaagagctttctttctctcttcaactgtatctgagcagatcatctcacggaatgcatcgattctgttgccgttgaagaacatgtgctctgtacggcagagaccgataccctgagcaccgagctcacgagctttcttggcatcacgtggagtatcagcgtttgtacgaaccttaagtcttctgtacttatcagcccagcccataacacgagcgaaatcgccggcaactgaagcttccttggtagctacatcgccctgatagatgtttcctgtagaaccatcgagtgaaatgtagtctccctcgtggaatgtaattccagcaagagtgaactccttcttctcctcgtcgatatttgtgatatctgagcatcctgatacacagcaggttcccataccacgggcaacaacggctgcgtgtgatgtcataccaccacgtactgtaaggataccctgagcagcgttcataccctcgatatcctctggagatgtctcaagacgaacaaggatgactctgtcgccctttccgccgataccctgctccttagcgtcctcagctgtgaatacgaccttaccagctgcagcaccaggagatgctggaagagctgaaccgatcttcttagctgccttaagagctgccggatcaaataccgggtgaagaagctgatcgaggctctttgcttcgatacgtgtaacagctgtcttctcatcgatctgtccctcatctacgaggtcgcatgcgatcttgatagcagcctgagctgttctcttaccgttacgagtctgaaggaaccaaagctttccttcctcgatagtgaactccatatcctgcatatcgtggaagtggttctcaaggccggtagcgagctccatgaactgcttatatacatctggcatagcctgctcaagagtgctgataggctgcggtgtacgaacacctgcaacaacgtcctcaccctgtgcattgaggaggtactcaccgaagatacccttctcaccagtagccgggtcacgagtgaatgcaacaccagtacctgatgtgttacccttgttaccgaataccatggtctgaacgtttacagctgttccccagtcgccagggatatcgttcatacgacgatatacgatagcacgtgggttatcccatgaacggaatactgcgaggatagcgcccatcagctgatcctgtggatcctgtgggaaatcttttccaagagcatccttgtagatcttcttgaatctcttaacgagttcctttaagtcatctacatccatctcgacatcatacttgatgcccttcttagccttaacgtcgtcgatctccttctcgaagagagacttggaaacttccataacaacgtctgagtacatctggatgaaacgacgatatgaatcgtaagcaaatcttgggtttccagtcttcttagcgaagccctcaactgctacatcgttaagtccaaggtttaagatggtgtccatcataccaggcatagatgcacgggcaccagaacgaactgatacaagaagcggatcgtccggatcgccgaatttctttccgtttacttcctcgagccacttaaggttctcctcgatctgatcggtgatctccttagtaaggcccttaccattgttatagtactctgtgcaagcttctgttgtaatagtgaagccgtgtggaatcggcatatgcaggtaatgtgtcatctcagcaaggttgcaacctttaccgccgagaagattacgcatgtctgctccgccttcttcaaacttgtagacccacttctttgccattttatttcctcctatatgaaaatagtttgatttcggtgcgtcctctaaaaggggtctgggcgcaccctttaaaattatatcacaatccagccattatgcaagtattatcaaaccttaaagatcgacattgcttcgttgagtaccgtaagctgatcctcgaggtccttgataagttcgcgtgacttgttgacttccgactcaagttctgcggccatactcgatgtctcctcggtcgatgcggcattgtctgtggcatcgtcgttgagtgactcgatgttattcttgatgcggtctctctcgccttccatcgtgtggatattttcagagatgctgtctgccgaggtagagcagttgtcgagagaagtctctaatctgacaaatgtctccctcgttctgttgaacgcgtctacctgttcctgggaaacgctctgcatcctcttcatgatctcaacctgctgcgtcgagttctttacgagctcttcgacaatcgagttgatagtctttgcggattcgtcagactggtttgcaagattaccgatctcttcggcaacaactgcaaatcctcttcctgcctctcctgctcttgccgcttcgatagaagcattgagtgaaagcagattggtctgcgatgcgatatcagatatcagatttgcggcctctgcgatctttgcgaccgaatctgaagtctgctgtgtctgtgccgacatcgtctggatatcgtccatagtggccttgttcttttcgacgagttcctgaagagtattcttagactcctttgagcactccatcatatcagatgcattgctgtcaagtgcagcaacattgcttgacgaatcatcgatgtttccagaaagtgtctcgatctcgcttacagcatcggctgctgccttagcctgatcagtgttgttctctgcgatatcatttacagcactcgagacatttgaaatggcatccgacatactcgaaaaattatttgaaaattcttcgatggatttcttcagtgactcacaggcattcgaagctctcaagatcatattttccatgttcttctgagcttcgttcaggccacgtccggtatctccgaattcgttcttcgtttttacttctatgctctccctcaaatctcccttcgccattctctgggcaaatttctggatatttgtaagaggtgccactgtcttctttcccagggcatatgataagaaaccacttacgacaatacaaatagccatgacgataaaggtcacgagtgtcataatcctgttcaggctgcttaaggatttctcagtagctgccatctctttgttcatatcgtctgtgtagtttcctgtggaaagcatccatccccatggttcgaacagctgtgaatatgccagcttcggagcgactgtctttccatcggccttagtgaagtagaactcgttgaatccacccttcttggatgaagtgcaggactttctgatcatctgtatgatcatatttcccttcttatcctgcagattcttacggttctttccctgctgttcggtcaggatcgggtgcataacgaggttgtagtcgagatcgtcgatccagaaatatccgctctgatcatcacgatatctgaatctcttgatatcctcctctgcttccttcttcgcctgctcctctgtcagatctccgtgcctgtaatcgtcgtaatccttctgcacgatagagatcgccgactgagtctcagaaactatctcacgcttgtagccgtcgagctttgccttgtgatatacatccatcgaacgcttaaacgaaacattcagcgaaatgatagatatcgcactgactacaactgatacaatgatcacgatcacaaggttcatcatcatgatcgatcttccgacactccggtagccctttgtcttcttggccaacccctcctgtttactcattcatttttcctcctggttcccaaaaaacttttctgcgcaaaattgcgctacattctatattgtatatcatttcacgcatgaaataaaggcctcccgccaaaaaacgaaaagcctttaaaaatttattttatgtatcagatcagttctctgagtttcagatagtcgtagaggaaccgggcactcctctcgacgcctaagtccgatgaagacaggatcagctcgtagttgtcagggctctcccactttccggtcgaataggcgttgtgataagctctcctcgtacggtcgtggcgggcgactgctttcttcgcctcgctgtaatccatgccacggacttccatgatccggctgatgcggttctcgatatttcccgtaataaagaagcggacaaggtacggatagtcttttaggatctcgcttccggctcttccgataaggacaaacgactttccttctatggccttatctcttatgtaccggaactgtgcacgggttatcatctcctcaggagaatttgaaattctcaagttcatcgcctgaaccgaacgcgatctcagtgggtttgggaccttctcgtcatattttctgtatttttcggcatcgattccgagctccttcgacatcgagtcgagcatcccgcgatccagaaaatctatgccgagcatctcggagagcctttttccgatattgtgtccaccgctcccgtaagtacggctgatagtaacaagaagctgtttgttccccataattgacctccttttacatgtatcttacaaaaataaataccgttgaaaatgcaagcactataacagtagcaactgcagcatatctgcagtactgcccccagcctatcgggtgtccggcctttgcagctgcagaagttccgactacatttgcggaagcaccaataggagtagccgagccgccaatgtcagttccaagcgaaagtgcccaggcgagcgtcgttacaggtattccctgcgaatgcgcgagtgctttgatgaccgggaccattgtagccgagaaagggatattgtctataaaagcactagcaactcctgaaatccagatgattatcgccaccatcgcatagcggttgccacctgatacctttgcgataaaaccggcgacagtctctaggattcctgtctcctcaagtcctccgactacgataaagagtcctacgaaaaacagcagtgtcttgtagtctacgttcttaagaatctccttcgcatactttatctgtgaaagaagagtaagcgccgcgataaatactccgatgaaagccacagtaagtcctgtacttccgtgtgttatcagaagaactacagccagtgcaaaaatcagcgcactttttataaattcgcccttatcctttatcgcgctctccggcgaaggcagtttggagtagtcgatctttttcttatttgacctgagctcttttcgaaacgagaggaaaaagaatacgacagttattccaaggcttaatactgctataactcctgtgtttgaaaggaatttaaaaaatgtaagtccgagtgaggtcccgattataatgtttggcggatcgccgctcatcgtggcgcttccacccagattcgcacagaagatctcggatatgatcatcggaaccggatcaaactccagcatttccgaaagctctacagtgacagtcgcgaggaaaaggataacggtgatcgaatcgataaacatcgaaagtccgaaagacatcagcatgaacacgacgaatatccgcatcggcctgtattttacgagctttgccagcttcatgcaaagccactggaaaaatccgactctcgccatgcctgctaccattatcatcatacctgcgataaaaattatcgtagaccagttgacaccggttgaagacgagccgctctccgatgagacatgccagaaatctgtcgtaaatacagacgacaggtttaaagtccgaaggagtgccgccccgtttctcatttcaatgccaaaaaccagcactatcgtaagtgccgcacagcttaatgtaacgatgtagtgctctatcttgtcccagaggatgagtccaaacatcaccaggaaaataagcattgcagtaatttccgctgccattgccattacctccttactaaaaatacatttacaccccgcctcttttattggatcatcatccaaagttttattatatttttacattttactactttaaattctaaaaataaaataaaaactgattttttgtatagccaaaattgttaaattgttgttgtcctttaatgcgcgggtgtgctataatcaatttgataatcttttagattaatgcttcatacaggaggtgttatgaaaatattttccaagaaactcacaaaggacgacctggctgatcttatcaatatcaataagctgaagagcattgttgataaaccattcggcctcgtcagatcgagaaaagaaatcttgcagcagaagaaggagaaaacagacatgaaaaaatttatcaagggacttcttatcttcgtcggtgttgttgctgttatctgcggcgtagcttatgctctgtaccgttacttcacacctgattacgacgacgctttcgatgatgacttcgatgactctttcgatgatgacgacctcttcgaggatgacgctgacaccgaaaaggcctgagtttactgatctttagtttatggatgacgagccttcgacaattttgccgggggctttttttattactgcaaagtgaattatgaaaaagaatgatatagttaccggaaacgtgatcgacaccgtcttcccatgcactggaaaagtggcgatagaaggaacagacagagtcgcctctgtaaaaggcgtcatacccggccagacagttgagctccgtattaccagaagctctgtagacaatacgaagggcgagctgcgccgcatcattaaagaaagcgatattgaatcaagctcactctgcccccacttctgctatccaggtgaagacggcgacaggtgcggaggctgtgtctaccagactatctcgtatgaggatgagtgccgcattaaagaacaccagatcagaaaactctttgaaaatacagttccttcattcgatcaggtcttcgagggcctgactccgagtgattcgtgcacaggctataggaacaagatggagtacagctttggaaaccgcgtctatggcggcgggcttgaagtcgggatgcacaggaagggagctttctacgatatagtatcggtgccgggatgcacgatctgcgatccggattttgggttgataatagattcaacgaggagatattttaaagatacggccttttaccgcaagggaactcatcgtggatacctgcgtcaccttctggtgaggcgcgcccatttcacggggcagatcctaatcgaccttgtcacggccgactatctgcctgaaagctggtctgacgactcgaaagactccttgcgcttctcaccttttaccgataaccgcggcgggcttaccgaagagcatcctaagatgacttccgaagagatatgtgatgaaaaagagcttctcttgggctatgtatccgtacttagatctttaaatctatccggagagatcgcaggcatcctccacactagaaataactccttgtcagacgctgtaatagatcaggggaccgaagtcctgtacggacaggatcatttttacgagaagctctccgggctttcgtttaagatcactccgttctcatttttccagacgaactctgccggcgccgaaaagctctacgagaaggctggcagatacctgcttgaagccttaggcggcagaaagccacgcgaggtatttgacctctacagcgggacagggaccatcacccagatcatctcgccttacgctgatcacgtgacaggtatagagatcgttaaagaagctgtagatgctgcaaaggaaaacgccgccgcaaaccacatcacaaactgcgattttctctgcggagacgtatttaaagtgctcgatggcatcgacgaaaagccggactacattatcgtagatccgcctcgcgaggggctttcgcctaaagccttaaggaagatactctcctacgaggtgccttcacttatctacattgcctgtcagcctgcctcgctggcgcgcgatatcccggcatttttaaacgagggctacaaggtaagccatatttcctgcgtcgatatgttcccaaggacggcaggagtcgaagtcatcgccctgtttacaaaaaaataacagctcttccgccaggaaaagctgcttaaaatgcattataaaatcttcttcccgttcagatacacttctgtgatctgggcgggttttctgcccgcaagggtcagggtgatgccattatctatatggtattcctcccttgtcctgttctgctttaagactttaaggaagtcgataagcacagacggcaggagcaccgcttcaaagtgctccgctgcctgttttccctttattctctgaacttcttttatcagatcttcacgccacattttttaaatgatccagttattcttatcaagtgtaacagttgaatatgtcgactggaatatcttagcagaaatctggtcagatgtcacgtctttatctgaatcgcgcagtacgctccatgtcttgcagtgctcattcgatgcgagactgtcgttttccttctgatcctcgtcaagtactataagaactataagtcctgcctcgaagaggttctttacgacattggcgtagtcctcaccgctctgcgggtgatagaaataggtgtggcggcctgaacttgtcagcttaaattctgcctcttctatctcatcgaccgaagtgccgtcctcaaaaggcctgaactcaacgacaagaggtgactgccagttgagggcgctccttgccgcgcggtctgctgcgtaatggcgcttcttcgtgccatcttcgagcttcgtaataacgccgcaggctgatgtcatattagtgatcctgtcgataaggatcagctcacccatggtgcggtattttgaaaactctgatgctatgacaggctcggtcacagcgatcgttactactgcgatctcgttctttttcaaggtatcggtgctctgatgctctccggtatttatgtcgatcttgtactttatctctgtaataagtcctggaataagcttggtgccaagttttacaaggaagttctttccaagtgtcaggctgtcgtcgtccatccagaggacctcggtctcaaagctgtcagctgcctttaggtcagttcccgattctataacgcagcctctcgatacatccacttccctgtcgagctggatcgtaacaggctgtccttctactgccgactcctcactgtgatctgcgactattattccctttacatgggctttctcaccgcttggaagtgagcgtacctcgtctccgatctttactgtgccgtgttctatctggccctggaaacctctgaactcgtggctcggtctgcagacacgctgtaccggcatatagaagcccttttcattctccgtggcctcgtcgatatctactgtctctaggtagtcctgaaggacaggtcccttgtaccagtccatattcgaagagcgcttcgtgatgttgtctccctcggtagctgataccgggataatgactgcactgtaaagtgagagctcttttttgagttcttcgatctgcttctttatcttgtcaaatgtgtcctcagagtaatctgccagatccatcttgttcacagcgaagacaaaatatctgatgcccatcagtgcgcagattctcgcgtggcgtctggtctgtactaaaacgcctttcgtcgcatcgataaggattatcgcaagatctgcaaatgaggcgccgcaggccatatttcttgtgtactcctcgtgtcccggagtatcggcgcagatgaagcttctcctgtctgtcgtaaaatatctgtaggccacatctattgtgataccctgctcacgctcggcctgaagtccatctaaaaggagtgagtagtcgatatcgccgccacggcttccgaccttagagtcgagcttcagcgcgtcctcctgatctgcatagaggagttttgcgtcatagagaagatgtccgataagtgttgattttccgtcgtcaacgcttccgcaggtaataaatttaagtaaaccgctcattagaaatatccctccctcttacgtttttccatgctcgctgcaccgccatctttgtcaatgatacggctcgttctctcggattctactgcaccaagtgtctcttttacgatcgcatcaagagtgtctgcgtcggattcaaaaccgcctgtaagagggtagcatcccaaggtacggaaacggatcttcttgtgcattatgtcttccggctttaaacctagcttctttacgatccgatcgtcgtctaccatgataaggtttccgtcgtgctcgatgcacgggcgctccttcgcatagtagagggaaacgatctctaagttctcacgcttgatgtactgccagatatctttctctgtccagttcgagatagggaaaaccctgatgctctctcccttgtgtatctgcgtattgtagagcttccacatctcgggtctctgattcttcgggtcccaggcctgcgctgaatttctgaatgagaaaattctctctttggctctcgatttctcttcatcacgtctgccgccgccgaaagctgcggtaaatccataggtggtaagtgcctgctttaaggcctgtgtcttcattatgtctgtataggaagcaccgtaatcaaacgggtttacccccttctttactccgtcctgattgatccactcgatcatgttcagaccatattttttggcctgggcgtcgcggaattctatcatctcatggaatttccatgtcgtatttacatgtaaaaatgggaatggcggcttctcagggtaaaatgcctttaaagccagatggagcattaccgtgctgtcttttccgattgaatagagcattaccggcttttcacactcggcagctacttcacgaattatatagatggcctctgcttcgagcgcatccagatgtgataacttactcattgatatttcctctctgaaaaatttctaataggcgtttgaattccggctgtcaacgcttataaccttttcaccgccgtccggtgtctttatacgccagttgtaaataaagccgtttctctccactgtcatctgcgagccgcatcctccgatgtctgcaccgagataaaagcttatcgccgttaccgggcaggctttgaggcatgaggtacatccccagcagtctcttacgtctttaataaatgccttgttttccttatcaagccacagcagattgccaggacaggcgtcgctgcatcgtccgcatccgatacatttatttctgtcgatccttatgctcatgtatccgcctccatttcctgcgcttcggagtgtaagtatccgctccttttcaccagcggcctgtagatcacctttatctttttgtcttttaagactgagtttacatagcagagaaacttcgcgtcctgtacagggtgatctgcattctccccgaaaatatgccatctggtctcttttcttgcagagaggtgggcgataagtgccctgcagaccgtaagccggtcctttagttcaaatatttttaaaagatcatacatgtcatctgccctgagacgccccgcgagtttttcaatctcctcgatgcgcctttctgcgatcttaagccccgcttcgttgtagcggtaatcgcttccgatgcctccggcgtattcatccatggtcttctgcattgcctcttcggcctgctcacaggtgatcgtcgaatccgtccggttgaaatgatccaagtagcttttaaaaatatccgcggactttaaattgtctgacggcttgctgttttccaagtcacttatcactgtcttcgcagcgatctctccctctgcaagagctccggtaacatatttctgtggcgccccgcctgccacgtctcctgccgcatacagtccttttactgtcgtgcgccgccctgtatcgacccagaagcctccggccgtgtgtccgcctacgacgtacggctctgtcccatcgatctcgacgttgtcttctgatgggccccgtcccgactctatccacttaagcgtctgggaaggtgccatgttaaggtatgccttgtagaggtcgctttcagcttcctttgaaatgccttttgtcttaaggtaacacggacctcttccggccctcttctcttcgactgttccgtaaattctctcaggagttgtaagtccgtattttgtctcgtagacttctccgtcggaatttacctgcttcgcatgtacgccctgtgcaatagtgcctgtcggcgctatcgtatccttacatcgcagggccacgaatctgttttcaagagtcgtcatctcggctcccgccctgattcccatcgcgtatcctgctccggtgttaaatggcggataccacatcttatgccttgaaaatccgggattattcggccgatagagccctgctgccccgccagtcgcaatgatcacagcggacgcatcaatttcaaagaatttcttctccctcacggaaaagccatacgctcctgtgacagagtctcctgattttttaagatcagtgatatttatatggttgatgacttttacatttttctgccggcagacgttttcagctaaaatcggctttatgttctcgccatttatctttacgtttctccagcctctcgtgacgtaattgccatccctgtcttttaagatcacaagtccctttttctcgagatcgtgcgttacggcatttactttctctgctatcgtaagcagaagatcgtctcttactatgccctctgcgtcttttctcgcgtactctacatagtcccccggagtatgcccatccgaaatataggcattcagggcgtttactccggcagcgaggcatccgcttcgcttaatgtcagccttctctgccacaataaccttatatccggaattctccccaatataggacgctgcgtagcatccggcggttccgcctccgattatcaggacatcggtatttagtttttcaattttaatatcacttattttcatctgctgcttcttttccaaatcaaaatgccataagtgcgagaacaccggcgactgctgatacgagaagtggaaggaggtttccaacctttttcctgttcataacaaatatatctgctgcttctataacaaccgtcacgataattaccagtccttttccgaatccaagtgccgcgccggctgcgacgttagtcttatacatcgtaaccattactcccaggagcaggccggcgatcacaggatttatccacctgcttacaaacttgaaaaacgaaacattttcaaaggtgcgcatgatccagtagactactccgaatacgatcccggacgctgcgacgcttatcgcaaatccggcgacggctccggctgcaccggcagctgcgccgccgcttctggccccgatcagatagccgactcccgagaggatctttgtaagtatagaacccggaagaacattggcgatcggaactaaaatcccatagaagtcgttttcatttacaagtccggtatttacaaagaggccatcggcaactgagagatacgcgtcgccgcctccaaatgacataaaggatgaaacatacccgcgcaggatgtactcaagtcctcttccaatgaaaagtactgcgggaattgttaagactgctgcaaagacaagccatacgatattttcttttataagagaaatgtacgcaccctttgtaacctttgcctttgctccccttgaagctgactgatcttttttactaaaaaaataactctgaactgcgaaaactacgatcattactgcaaacgcgagcatcaggatctggaaggtcgaaagctttatcatatggtctgagatgctgttaaatcccaggaggcttacgaggctcttcgatcctgtcagcataaatgaggctgtgattataagtatgtttgcgataaagttcctgctgccctcttttctggcttcctttgatactttgaccgcatactctgcaagaaggcttgctatgaatgctccgatgcctattgaaagaatccttataacattgagtgatgagacatcgtttccggaaagaagagctaagatagtcaccgtaagagctgctcccggaagagccatgagaactgctgaaagaagcattcccctgatcccaaatgacctgcgtccgactcctgcggctatctctacaggaagtgcaccaggtgtggcacaggctgaaaccactgcttcgtcgtaatcttttttatctacgatctgctggtcgtcaactacttcctgctcgatcacaggaatcagtgcgctgccgccaccgaaaccgacaagtccgatcttgaacatagaaaagagaagttttgcaatgccagtcttctctttgaccgaacttccggccgctgtaatggctgtctgatccatggtgtacctccttttctttattcatataaatcctacttgtttgatatgctttgtattatatcttatttcctactaatcaggtaatatttatatgttatatctggttagaagtttttcttataacactcgtgcgtgttttcggccagggcaattcatctgcaaaaaaaccgccagtggaaatatccaccagcggttttcaggatttatataaggatttttattattcgtcgtcttctacttttcttacgagcagatcatatgtaccatcgttgttgtctataagctttaagatctgatgtccctcttccttgacgcttctcggtacgttctgtacgggctcgccatcgttcatgtgaactgagagcacctgaccgtcatccatttcctctaaagccacctttgtctttacgaaggtgacagggcagacaacatctgttatatcaactgtctcgtctattttaatatctgatgtatcagccatcggcttcctcctttttattctcactttcgttgtaaactttctttatcatgtcgtcgaacttgtcctggccgtatctgtcgatagcgaactggagtctgtcgccggctttcgcattatttttgaagaaatcgatcgtggcgtcgcagagcttgaagagtgtatcctcgctctcgaaaaatggaacgatcggctttcccttgtggaaatgatttccatagaggccgccccaggacataagaaatcccggatgctcctcgtaagcatcgaccgggcaggccttcgcgcatctgccgcagtagttgcagaggtctctgtcgatcgtgatctttccatccttcaaggtgatggcattagatctgcaggccttgacacagacgccacaggagatgcacttgtctgctatccactcgacacgctcgccgcctttgataccgatatcgttctcctcagtcttaaggcagttgttctggcagcctgtgcagccgaacttgaacttgcccggaagctctctggcgaaatacctcttgtcgatcttctgcgctatatcctgggtatctatgcaggctgaagggcaggtgcagcttccctggcaggctgtagtcgttctgacacgcgggccgcagactgaaggcgatacgccgtactcggccagatcctttttaatgttttcaacgtcttttatatcaagccacgggatttcaagcgactgtctcgcagtcagatgtacatagcccctgccgtatttgtcagcgaccttctggatacctgtcagctgctctgccgtaagagttcctccaaccacatgaattcgaagagcgaacttgttcttctgcttctggcgcatccagccgccttttttcagtgtagcaaaatcaatctgtgtctctgctgccataaacaaaccttctttccaaacatgcttttcttttcatcatacgatctcgagatattccttcgtcgagactccatcctcgacatggaaagaattgagaaccggattgttatcatccatcagtgatagtatcagatatgaggccttcttgtcaaaagccagccttatatcctcctgtgatgaacgcgaaggtgatgccgggtgtgaatgccagttgccgagcggtttcaggccgtttgctctcatatcctttaccgccgcaagctgctccttcggatccagcgaaaaatgttcgcttgtatggtctacattcgtaagaagatatacttttctgatctcgcgcacgccgtcttctctgtcgactcctccgatcagaccgcaggcctcatccgggcgctcttttctggcgtgtgagagtattttttcatagtcgctttttttaattgtaattttcataagaacacttcctgtctttcagactggatgctttggatcaaaatcgcaggccacctgctcatagtctacaagctttgtgatcgtcggatgatcggagcatactgcgcatccgtcacctctcggcggaagctttacggtgtggaagctcatagtaagcgcatcgaatgtcagaagctttcctgtaagaagctctcctgcacctgtcaggaactttacagcttcaagcgcctgaagggatccgatgacacctgccatggctcctactactcctgcctctttgcaggacgggatcgcgttcttcggaggcatctccttgaatacgcagcgatagcatgggctctcgtgtgggataactgtcatcagctgacctttaaacctgagtattcccgcatgtgaaaatggcttgtctgccatgacgcaggcatcatttataagaaatttcgcagggaaattgtccgtgccatcgaggacgaaatcgtagtcctttatgacatccataatgttatctgatgccagaaattcctggtatgtctttacctcgatgtcaggattaatggccttcatcttctcagccgccgactcgacctttggtctgccgacatctgctgtcgtatgaattacctgcctctgaaggtttgaaaggtctactacatcagcatcaactattccaatttttccgacacctgcggctgctaagtaaagtgctgcaggagctccaagtccaccggccccaatgataaggacactgccgttcataagcttcttctggccctttacaccgatctcctttaaaataatgtgtctcgaatatctctcgagctgatcatttgtaaacggcattactgtccacctcccatgaagtacaaaaactcaacaacgtcgccgtccttcaactgtctcgctgcaaaattttccttcttctcgaactcttcatttacggagacgctgacatactcaggtgtctcgaccttctcctgctcgataagctcactgatcgttattccgtctttaacttcctttgtttctccaccaactgtaatcttcattttctgcctccaatgtaattatctgctctcgtcagttatttgtctgcgagctctatagctcttgtgaaatcttctataagatctgtcgcatcttcaattccggtgcttactcttatcgtatcatcaaatacgcctgccgcggccatctgttcctcgctgcttctgatgtaaagtgtcgatgccggatgaatggctaaggtcctcaggtctccgatgttgcttgcctttgtgacatactgcagattatttaaaatcttaaatgccttctccttcgagccggcgcggaatgtcaggattcccccgccctttcctccgaactgtctgtcaacgagtcctttgtaagggtttcccggaagcgtcaggtaatttaccctgatgcccggaatctgatcaagtgccgtcgcaagctttgaagcgttagaacagatccgctccatccgaagtccaagtgtctccattccgatgatattcataaacgcattaaacggcgaaagacagcttccgaggttctcccagatgtctgtccgaagccttatcgtataggcgagaggcccgaacttcctgtagccgtctagtgccttgaacttgtcaaaatcccagtcaaatccggctccatcgacgatcactccgcttatcgaatttcctccgccgtttatgtacttcgagctcgagtgaaccacgatattggctccgagcttcagaggatttataatgtaaggagtggctgtggtcgaatccgtcataagcggaagcccatggctgtgcgctaagtctgcgactgcctttatatccatgacatcgagtcccggattcccaataacctcgccatagataagcctcgtgtgctcatttatcagcggctcgatctcctccacattcacatgtcttacatatcttgtctttatcccgagcttcgtcaagtcttcgaacaggtcgatgctgcctccatagaggccgcttcctgctatgatctcatctccggcacagagcatatttaaaagtgcgagcgtaatggcactcattcctgatgaacacgctatagctgcatttccgccttcaagctcattcatcctctgctcaaacgctgcaaccgtaggatttccaaccctgctgtaggcaaagcccgctgccttgtggtggaagaccttctcctgctcctctgccgtatcaaacttaaaagcagtaacctggcttatcggcgggaccgtcgcaccgtacgggtaatccgtaactgtttttccatgcagaagcttagtattaaattccattcaagcctccatttctttggtctcgtttaattactacttatcatactattttagtatgaatttgtataacagttttgtgttataactggttattgattttagttatagcggggaattgacaccagagcggacacggagggcgtaaacgaagacgcggaggagcagatagggcggcgaagctcattaggatttttctgtccgctctggcaggacttcattccactgaacgcggtgtctcggagtgtccgctctggctgactcctcatttcgtaagattctcacatgagtgtcgttcctgggtgaattgtatcaaaacctacaaatctggtaatttcgcggagctggaaattttcacacataaggccttcggaagtcaaatgtgtcaatgaatatggaccgtctcttatttattctttgtgatacgacttcaaaagttcgatgtatctcttcgccagatcgctcagtgggatatttttccttctgatgtatcctatcgtcatcacatcatcgctgtcgaatggcactgccgtgaatcgcccgtcattgatgtcgtctacgatgattccggaacagagtgtatagccattgaggccgatcatcaggtcgatcatcgaggctctgtcgtttgcacggacgatccgcggataatgtttggtgctgaggacttcctccgaaaggtaaaaagcgttgttctcgccctgatcgaatgagaggcatgggtagtcagcaagctcgtcgaaacttatctttttttcttttgcgagtggatggtctttatttaaaaatacgtagaccgggcagtcgaagagcggtgtgaattcgaggtcgtactccttgaaggtcttcgtcagcggggccctgttcgcatcgtcaagatacatgacgccgagctcgcttctcatgtcgcggacattttccatgacgcgcgctgtcatagtctcgtgcacagctaagtcgtagctgtcgatatcgagctccgcggcgagcttcacaaaggcctcgaccgcgaacgaatagtgctgcatcgaaacgctgaaataagtctttcgcttttccctgctgaaatgctcgcttaccatatcggagagttttactatctcttttgcatactgcaaaaatttctcgccgtcggaagtcagcaccatccctctgttcgacctgataaatatgtgcgtgcccagctcctcttcgagcagttttattgtgcttgagagcgcggactgggtcacaaagagttccttcgcggccttgttcatggacttggtctctgctatttttaccacataattaagctgctgtaatgtcatttgtcttgccttcataaaaaatgattgatttcgtaaaaaatctgaagcctattattgaatgtcaccttcaccagaaagcatcgtgataagttcctttttatagagtttgcttctctcgtgctgatccaattccggatatttttccggaactgtcttcctgagtttaagcatcttttcaagtatttcgtctatgttctcaggaattatttctgcgatctgcttttttaaaagagctgcataagcggggcttgcgccgcctgaagaaatgcttacggtaaggtcgccttttttaatgatggctggaaaaataaaatcacagttcggcgtgtcgtcgacagagttcaccgggatgtggcggtgcctgcactcggcagcaatgcgtccattcagggatttgtcgtccgatgctgccacaacaaaatcgacaccacagagattgtccagctcgaagtctctttcaataagaaccgtctgagaacccgccgacttttttatctcgtccgcaatctccggagcaacaactgttatctcgtcagtaaactgcagaagccgcctgaacttgccagccgcgactcttccaccgccgaccaaaagccatctcctgccctctatatcacaataaaatggaaaaaatgatgacatctgttttcctcttttctgcgaatcattttagcagaaaaacggacagaagtcacactgatttactattgtatgaattctatgataaaataatctgcatgaaaaatataacactcgaagccgctccgatggagggcatcacaaactacatattccgcaatctgcaccataagtatttcggcggggcagactgctatttttcaccgttcattgggatatattcaaataacaacgtgaaaagaagagacctgtgtgacatttatccggaaaacaacagcgggatcagactcgtgccacaggtacttacgaacagagcagagaatttcatctggatttttaaaaaattgcgtgagttcggctatgaagaaataaatttaaatctcggctgcccgtctggaacagtaactgcaaaaggccgcggagctggatttctcatctatccggacaagctcgaagaattttttgaccaggtatttgatgcactaggtgacgaggcaaaactcatatccgtaaaaacaagaattggattttcaaatcccagtgagatggagaggctgactgaaatctacaataagtttccattcaaggaactgatcattcatccgcgggtcagggaagaatactacaatggttctccacatctcgatacctttgaaaaggcgctaaacgcctccaccgtaccagtatgctacaacggaaatatttttaacttaaatgattacaaccagattacaatcggatttcataatttatcaggtgtgatgattggtcgcggtcttttagctgacccatcacttgcgcgacagatcaaaggtgggaaagcaatgacgattgacgaactaaggacgtttatcaacgaactcgaagcagcttataccgagcacctcaaatctgaaagaaatgtactctttaaaatgaaagagctctggacatatctggcacgaaatttttctggtggggataggtatatcaaaaaacttttgaaggcgaagacgctgacagaatacagggtgcaaaagaatttgattcttaatgatgatatgatataagggtcaaaagtcacactttgtattactgctgggaatcgtgggcactgtccttctctccttcgcctgttatgacctggtcagcgtgctctaagcactcttctggcagtacagtcgcatgcatgccgcccattatgactctggcactgctcttttcatggaccatatctgcaagctcgtaggcgcgcagtgcattcgatgtcattattgaaaaacagaagacatctgtatcttttaaaagttttctgtaatttacgcctccgttcagctcctcatagactgaaacgtcgtgtcccgcgcgttttaagataccgcctaagatcagcggcccagtaatcgaattggactgtccgtaaatttttcctcctgcacggtatatcggaaaacggcgaagcgcagtagtcggagtaataaaaacgatcttcataaagcacctcctgcagttctttattaaaaaattgtaactttttgcaaatcgtttttattgtccgttattttacgggttctatcaatgacacaaaatcacaggcgttaaaataactatacacatcaatatggtgtgtatagttatccgaaagcttagctcttatctgtttttcacgctctcagttcttctctgttcagtttcttctcaatccagtgcagcagtttcgaagtgtattcaaagagtggtatcgcgcagatcgcaaacagtccgaacagcattgcgcacctgtaggttatcagcttgatgtcgaagaggctcggcagtacgaatgaaaatccgataagtccgaccacacacagggcgattacaaaaatcctgaaggcattgaatggcctgctgatgcttcctaagatcataaatccgacgatcgcaagaaggaacgtggcagctaccgaaacatcactgtcaggtatcttgaagacattgcagaagatcaccatgccaacgataatgaaaaattcggtgactgacgccgggaacgctgtgaatatgacatgccgcaggaagtgcctgtgcggcctgttctgatttggctccatcgccagtaagaacgccggcagtccgatgttaaacatcgagatcagcgaaatctgattcggctgaagaggatactgcatgacatgccagattgaaaacagcgcgaggaagaatgaaaacaggttcttcgctataaaaagtgtggccgagcgtgagatattgttgacgtctctcctgccctcgtagacgatatttgtcatgtgcccgaaatcgttgtctaacagcacgacctgcgaagactgtctggcggcgtcagagccgtttcccatcgcaatagagcagtcggcctctttcatggcgaggatatcgtttacaccgtcacccgtcatagcaacgatgtgcttctgcttctttaagatttttactatcttcatcttctgctcgggtgataccctgccgaaaacgatcttttcgtttaccgcctgctcgagggctgcatcgtctttaagagcagaacagtcgacatatctgtccgcgtcctttatcccggcagtattcgcgatacgcgaaaccgtgcgaggattgtctccggaaataacccggatcgtaacatcctctttctggaaaaatgcaaacgtctccctggcatttggccttataacgtcctttatcgcgataaacataagcggcttgaaaatattttctccgtccttcttttctttatcttcttcgccactatcctttctggcaaagaccaggactctctcgcccctgtccgcatatttcccgatcagattgctgtatttactgatatcgcttccgaggatcatctcaggcgcaccgaggcggtatgtgacttcttttgcagtgagctcactgtacttgtttttggatgaaaaagggactttgcttatgacttcaagctgccctgcttttttaaaatatttcctcagtgctttcatcgtgacattctggtccggcatagcattaaggtacgcgccaaggatcggcttgtactcccctatatcacttccgtccggtgaaatgcactctgtgacgtccatctcccctgtagtgatagttccggtcttgtcgacacagagtgtatctacgtgggccaaagtctctattgacctcatatcgtgaagaaccacatgatttaaggcgagccttgcagcgctcattgcgagagctatcgagagcaggaggtagaggccttccgggatcataccaactactgctgcgaccattgaagagacactcagtgaaaatgaaagtccctgtatcctgtagctctgcaggaacatcgtgattccaatcggaatgataaggattccggcgatttttacgaacaggtcgatagcgtgaaccatttcagagctgtttttgccctttttcatggtctttgcgcggttcgaaagctgggtgatatatgactccccgccgactttagtaaggcgggccagtccttctcccgatacgacaaagcttccgctcctcagatcattatctccgcccacaggaatcttttcgatctcatcagcttcacctgtaagaagcgactcattgactgaaaccgcaccatctactaatacagcgtccgccgggatctgcgttcccgatttgatctttatcagatcgtcttttacgagatcatccacggacagtgttttctccccgccgcttcggataacgctaaccgtactctgatccatcaccgagagtttgtcgaggattttcttcgccctgtactcctgaatgattccgattatcgtattaaggatcacgacgatcatgaatgtcaggttcttaaaagaacctgccgcaatgactaaagcagccaggatgaaaaagataatattaaaaaacgtgaagacattttttagaataatcgttcctagtgtttcagtcttctggtcacctgtcctgttgaccttaccctctgaaatacgctcagctacttcttcctcattaagacctctgataccgtattgctccatcagcccaatctccttaaatcttttcaagtctggcaaatcctgcgaacatcttcttgcgtccggcagtgtcgaactccactgtaacctggtaatcgcggccgccgtcttttatctctgtgacagtgccttcgccaaacttcgtgtgctttacgcggtctcctactccgtaatcgaggctgctctttaccatgtcagcgccctttgtataaagtaatgagatatcttccttttttttacgaggctttcgcttctgtccctttgcgtttccggaataaccgtaaatcccgccgtaagccaggcttccatagtcattttcctttggaacatacgccttaaatccaaagtcagcccgctccttatagtcagctctctcgtcaaaagaatagcttgtcttttcgactctgccgtcaagaagttctgcagggatctcctttacaaatctcgagacaggcatatactcagtctgaccgcgcaccatcctggcctttgcacaggtaagggtcagcgtatccatcgcacgggttatcccgacgtacataagccgacgctcttcctcgatctcctcgtcgctgtcatcagaatttatagaaagctgcgacgggaagagtccgtcctcgagacctgtgatatagacgtgcgggaattcaaggccctttgccgcgtgaagcgtcataagcgtcacgtggttctctgcatcatcgcctgtatctgcacttgtcataagagatacatcctgtaaaaacagtgagagtttctcatcggcaggcaggtctttcgtctcctcgtcttcatttatttcgtgctcaaagagcgcagctttattaataagctcatcgaggttttcaagccttgccctgctctcgtcggtatcctcaagttttagttcctcggaatatccggtatcttcaataatgtcctttacaaggccaactactccgtgaaacgagagcttggtccgaagcgtatctataaatgacatgaagtcggaaagcttttttccagatctgccaaacataccgttttccacgccgagctgcatcccgtcgtaaaatgatagacttctgccggcagcgtactctgcgatctttccctcagtcgttgctccgattccgcgcttcggcacatttaaaatacgccggatggctacatcattgtctggattttcgattgccgtaaggtaggcaaggatatcctttatctcgcgcctctgatagaaattgattccgccgactatccggtaagggattcccgccatcatcagtttttcctcgagggtacgcgactgggcgttcgtcctgtagagaacagcaaaatctttataatccgctgtcaggctcttttcacgcttcctgatatcgtctgcgataaaatctgcctcttcgtaggagctctcaaactgcctgaagcgcaccttttctccctcgccacggttcgaccagagggacttgtcctttctgccccggttattttttatcacagcgtttgcggcattaagaatcgaggtgtaggacctgtaattctgctcgagctttatgaccttagcccccggaaaatgctcttcaaagcttaaaatatttgtaatatccgctccgcggaatttgtagatcgactggtcgtcatctccgactacgcagaggttctttctcttttcagacaggagttttatcagctcaaactgcgcggcgttcgtatcctggtattcatcgaccattatatagtggagcctgtcgttgtagtaagcctttacctctttatccgactttaacagaaggacagcgttcataatcaggtcgtcaaagtccatcgcgttgttggatttaagtctcgcctgatactccctgtagattcctgcagtaagtctgccctcggctccttttagatatttctcagcttcgtcgcagtcgataaggttgtttttaaaatctgagatctgtccgaggaagcgcttctccttgtacttcttgggatctaagttctttaattttatgatctgcttcatcagactcttcgagtcgtctgagtcgtagatcgagaagctgttcttatagccgatcctgtctgcaaatctcctgagtatcctgacgcatgccgagtggaaagttgagatccagactccctccgatccctctcccgcaatcctgtcgactctctcccgcatctcggctgcagctttatttgtaaaagtgatagccattatgttccatggattcacatttttttcagcgataagataggccaccctgtgcgtaaggactctggtcttgcccgagccggcacccgctaaaatgagaacagggccctcagttgtgaggaccccttcgagctgctctttattcagtaatttttcaagattttccatcgtcaattctcttctaatctcctgatcacgagttcgtaaccgtcgtcaccgtacataagtgagcggttcacccggcttatagtagcagtcgaggctccggtcttctcggcgatctccgaataagtattcttgttgcggagcatagacgccacctcaaatctctgctgcatggcttcaagttcccccgccgtgcacagatcctcgaaaaatctgtatgcctcttctctggtcttaagagtcagtatcccatcaaagagcctgtccatctcctctgtgtgaagatttctgctcatagtaaaatcaccccatgttctctggctgtctttctgtcttcctcaggccagagtgaaacctgtacttctccgatatggcatttcctgaggaaaagcaagcagatacgcgactgtccgattccgcctccgatggtgtacggaagcttcttctccatgattgccttgtggaacggaagtgaaagcctctcctcacagcctgctgctttaagctgctttggaagcgatacctcatcgactctgattcccatcgaagagagctctaaagctatatcatttacaggatagtagacgatgatgtcgccgtttaaattccagtcgtcgtagtctggtgctctgccgtcatgcggcttgccgtttgagagagcgccaccgatcttctcgaggaaaatagccccgtgctcttttgctgcgttgtactcacgctcagactgtgtggcatccggccacttgtcgagaagctcctgacttgtgacgaaagtgatctcctctggaagccagcaggtgatgtactcatagaggttcgacatatgcttttcagttatgcggagtgcctcgtagacgctctttaccgtatcccttaaagtcttctcatttctgtcctcgtgagtaatgaccttctcccagtcccactgatctacgtagatcgagtggatattgtcagtgtcctcatcacgccttatggcgttcatatctgtgtagaggccctcgccgactgtaaagccgtatcttccgagtgccattctcttccactttgcaagggagtgaacaatctcggcctttctctcgttctgctctttaatgccgaacgagacaggacgttcaactccgtttaaattatcgttaagtcccgactcaggcgctacaaaaagcggtgcagttactctgtgaagattaagctccgcagagagctgctgctggaagaaatccttgacctgctttatggctatctgcgtctccttgagatttaagaccgatctgtagccttccggtattttaatctgtgacatcttttctccttttttctataaaacagcgattgccttacgcgcttagatctcgcagttcccaactgttctcgggaatgggataacgtctctgatgttgcccatgcctgtaagatacatgacgcatctctcgaatccaaggccgaatcctgcgtggcgggtcgaaccgtattttctaagatccatgtagaaatcgtactggctctcatccatgccgagctcgtccatcctcttcttcagaagatcgtagttgtcctcacgctgtgaacctccgatgatctcgccgattccaggaaccaggcagtcgacagcggcaaccgtctttccgtccggattgagtttcatgtaaaacgccttgatctccttcggataatcggtgacgaaaaccggcctcttgtagacctgctctgtcaaaaatctctcgtgctctgtctggagatcagtgccccatgaaaccttgtaatcgaacttgtcgttgtgcttcataagtatatcgactgcgtctgtgtaggtgacacgggcgaaatcgttgtctgctacattgtgaagtcgctcaattagtcccttgtcgacaaatttattgaaaaattccatctcagccggtgcgttctcgagaacgtagttgatgatgtatttaagcatgctctcggcgagctccatatcgtcctcgaggtctgcaaaagcgatctcaggctcgatcatccagaactctgctgcatgtcttgtcgtatttgaatcctccgctctaaaagtcggtccgaatgtgtagatgttcttgaatgcctgcgcaaatgtctcgccgttcagctgtcctgaaacagtgaggtttgtctccttgccaaaaaagtccttcgagtagtcgacctttccgtcctctgttttcgggacatcgtttaagtcgagtgtcgtaacttcgaacatctctccggcgccctctgcgtcacttccggtgatcagcggagtgtggacatagacgaagtttctctcctggaaaaatttgtggatagcgtaggctgcaaggcttcttaccttaaaaacggcctcgaatgtattcgtcctggccctgagatgcgggatggtgcgcaggaattccatcgagtgtctcttcttctgaagaggataatccggtgtgctgtcaccctcgatatctaccgatgtggcctgcagctcgaacggctgcttcgcgtccggagtagctacaagctttccctctgcaatgactgcggctccgacatttatcgagccgagcttgtcaaaatccttcgtatctgccgaataaaccacctgaagcggtgtaaaatatgtgccatcgtttactacgagaaatcctacgttcttggaatttctgttgcttctgacccatccggccacttttatcgtcctgccggtgtactgatctgtgttcttaaaaagttcctttacatctacaaggtcctgtctcattgctttagactccttcatttctttacgatgttttcctgcaatggtcttcaaatgccatgcttttatagtttaacgcatgacagtgaaaaatacaagacgttatgatataatgatttgtgctttcgcttccccctgacaggaaggcgatggcacaaaaatataccgcaaaaattacgaaagggaaaaaatgaccaaaaaggatattttagaaataaaaaggcgctacaagaaggaatcgcacaatttcacccgtattgccggctgctatgtcgacaacgagaagaataagatcctaagtttctcggagagcccgctcgaacttgaggacgaggaatttttcaagtacctggagattgcgaacaagtgcctctccggaaagctcggaaacaacattctgcagctgccgttcccaaatgatgaaatcatgggcggagaaaagtattcgcttcttatgcagcttaaagccaccggccttaaggacgagacagtcctggatgaattttttgacaacgtgatcgagaactacctgatcaccgggaattttcttatagtcctgttcgacgacatctacgatatcccgatgaagacgactgacaatatagaccttggagattcggaggacgtcttcgagtatatcctctgtgctatctgccctgttaatctttccaaatccgctctcggataccgggaggatgaggacaggatcggagcccttgtaagaaactggacagtcaccccggtcgagagcgcatttatgttcccttcattttccgaccggaatgccgacgtaaataccgtcacagtctatactaaaaatgccaaggctccgcacaaggaattctgggaaaacggcctccatgctgaatcccgccttacatccaccgagaagaaaaacgccttcacctcaatggtcgaaaagtcagtcggctccgacaccgatgagagcaaagaggcgatgtttaatatcgcggattccctgtccggatttatcgaaaagcagaaagaaactctccctgaggatgccgaggtaggcatcaccggggacgatgtcgaggacatctgtgtcacagcgggcgttccggaggagaaggccgagcgcataaaagagcgtttcaacgacagcttcgagggtactcctgacgcacctgccgccggcgagctcctcgacagcaggctcttaaaagatcaggagctccaccacgaaaaggccgccttacagcgcgaagtcgcttcattaaacaaagtgctctcagacagcggcatagtctcttccgatggcacaacttcggatatctacgtaaaagtccctgaagaccgcgaagctcaggtcaccactgcttttgtagacggtgaaaagtgccttataatcccactcgatccgtcagataccgcctccgtaaatggcgaggaagtttcactgtaaaaaaatgaccctcagtcatcaattggtgactgagggctttttgaccgcaagcggtcaacgcgtgacttttgacctttatatcaaactactttttcttaatgagctttactgtgacgctcttctgataccatttcttttttctcttgctgtagaatgacacagggaatttcttgttcagattctttacaggaatattgaaagctaatacttcctgattccctacaacaactttctttccatttatgatcttcgcgccttttttctttgcgtctttcgcagttcctgcaaaggcctttgtaaggccgactcccttcatcgggacataaacactcatctttccgcctttgacagtgagagtcgtctttccattcagcgcatcgtttaacccaatcattccaagcttatcagctgtggcaaaactaacagtatatttaccgttcttcagcttggaactcttttttgagcctgctttcttagaagtcttcttagagatcttcttttttgaagtcttacttgagcttgttttcttagagcttttcttttttgagttctttttagatggcttctttgcgttgtggagcgcattatttgacacatcaagagttacagtctgggtcacagcctgtgccttggaagcttctccatctgtcggtgcatctgtctttccgccaagcgcatctgaaaggtggtttacgtagatctgctcgatatcagctattcttccgagaccagctatctcgcagcttacatttgtcttcccgaaagccttcgcaaactgagacttccaggaatccttatcacttcccgccatatcgttgttcgcatggtcgccagcgactaccatcagaggacggaggacgacctttttataacccgctgcctttatcttcttaatgacagctttgcagctcggatcaaactcgtccgtctttcccgggtttaccttgataccctctacagttccgacgaaaacattcttgtaacccaggtcagtcatctgcgactgcatctgagcgtaggtgatatttgctgtatgagaagtaccatgtcccatgaatacgaatgcacatccatctgctgcggcctcatcagtagtcttgtatctgcctttctgataatctgcaagagcctgggatacaactgcttttgcaactttctccttgtcggaatttacagtcgtagtattctttcccacttctcccagaagcggctcagagaaggtgatggtcttgaacttattcttgtaggcatttacctcttctttaagctcgtcgtactcttttccgtgcatcaggtgtgtaggctggataacgaggttctttactccattctttacggctctgttcagtgcctgatcgacattgtcgatcttctcgccatcgcgggcctggacatgatttataatgatctgtgaagtgaacgcacggcggatcgaccagccattgttggaataagccttctttaatgctctctcaacgccaccgatatcttctcttctgctgtcattgaacgaagtaccgaatgaaacaacgagtatctcattctcaccgatatagttccaattcagtgggttatcctctgaagcatctccggtatttcttccaaagtattcagggtctgcattctccccggaaaccagtttcttctgtgctgcggtaagcttgtcccattcaaacttagccttctttaaatccttgtcagtgacttttgctttggcattgtcctgcacatagatcttgtctataagttttgcaaccttatcagctgccttctgattcttctgctttgtagttagcttctttgttgtctttttcttagtagtcttctttttgcccgacttcttcgttgttgtttttttcttagctgtcttctttttgcctgactttttcgttgtcttcttttttgatttttttgccggcttctttgtcgacttctttgtgttcgtttttttctttactgtcttcttagtccctgcctcggcaactacagctgttgaatccgtgactggcggaactaatgtcgtagttgcgatcatgactgcagaaagcagtgcaagaagtacttttcgcattttaatactgctcctttcgcaaaaaaatacatatcctcgtgtttttatctgcttcggttcaggcaggtctcctggcttggaagccatgcagaaaggccgccttcccaccctgccgggcagtgacttaatggcctgtacttcttcacagtgacgggatcgcacaggatttccacctgtttcccttttcaccggatctttcatcatgggaaaataaaaaatccgacacctgaaccgatggacagaagaatcataccacaatcaggtgtcggttaacaataatatttttttagatgcgtttttgtatctgcctttacataggctttccattatacgaactggtttgattcgggatcatactcgtatcctatagatgcgagcttctcttttatctcctcctcactcgtctgaaactttccagcgagcatagagagagaaggctccttgtcgcgaagctgcatatttacgatagagagcagcatcgctggatcttttggtaattccatagtctgatttaagcctcatcaatagcatgaccaatgtcatggcgcatatatttgttatcgaagctgacccactctgtggctttgtatgccttgacacgggcatcttttaagtccctgccgacagctgtgattccaagtacccgtccaccgttagtgaggatcgtcttcccatcatcagcaaacttagtgcctgaatggaagcagaagtactctttcccatcgaagcggggatcgtcgagtcctgtgatagggagtcccttttcgtacttgacaggatatccgtcactcgcgaggatgacgcagacagccgcattttcttcgaattcaaccttgatctggtcaagagttccatcaacacagtgctccataacatcgatgatatcagtcttctgtctcggcagaactacctgtgcctcaggatctccgaagcggcagttgtactcaagaaccttcggtccgtcagaagtcagcatgagtccaaagaagataactcccttgaacggtctgccctctgctgccatagcgtctactgtcttctgataaatatgcttccagcagaaatcatcgacttcctttgtgtaataaggtgacgggctgatatttcccatgcctccggtattaagaccttcgtcgtgatcctttgctctcttgtggtccatagccgagctcatcagctggatggtctttccatctgtatatgagagaactgaaacctctgggcctgtcatatactcttcgatgacgatcgtatccccggcctctccgaactttttatcctccatgagagtctttacaccctcaaaggcctcttccctggtcatgcagataagaacacccttgccaagagcaagtccactggcctttaagacgatagggatcttcgcagtctttaaatactcgagcgcatccttcggatcatcgaatgtggcataatccgcagtcgggattccatattttttcatcaggtcctttgaaaaggccttgcttccttcaaggatggcggcattctttctagggccaaagacctttaaaccagccttttcaaactcatctaccacgccaccgacgagaggatcgtccattccaacaatagtaaaatcaatggacttttcctttgcaaaagcaacaagcttgtcgaaatccatggcagaaatcggtacacactctgctatagacgcgataccggcatttcccggtgcgcagtaaatcttatcaactctcttactctttgcgacagctgtgcagatggcatgctctcttccgccgcttccaatgactaataccttcattctgactccttgatactaactactctgttttcaacggtcaacatatcatgtgctatcaaatctacagctcccggcagaagtttccactccgcctgctccatgatccttctctgaagcttctccggtgtatcgtcgtctcttacatacactgccttctgcattataatagggcctgtgtccgtcccggcatccacgaaatgaactgtagcaccgctcaccttgacacccttaccgagtgctccctcatgtacatgaagtccatagtaaccctttccgcagaaagctgggattaatgccggatgaatatttacaacgcggttcggataggccgaaacgacctcaggcgggataacgactaaaaatcctgccagaactaccagatctacattctcagctttaagcttctcgagcagggctctattgtaatctgctctgctgtcaaatgctttaggtgaaagacattccgccttgattccatgggcttcggcacgcttcagtgcgtatgcattcggattattgctaataacgatgccgatataagcatcatttatagctgcttccttctgcatcccgcagatctcagaaggtgtgaggtcatctttgttctctctgataagtcttgtaagacccggctgcccctgctttcctctgtcaatggcatccattatggcctgaaggtttgtccctccgcctgaaaccaggactgccagcttcagcatagcgtaactcccttctcgcctgattcgatgcggccgatcacataagccttgtcgccggtcgactcagctgccttgataatggcatccgtatctgacttcccggcagcgatcaccatgcctatgcccatattaaaggtattgtacataacgtgctcgtcgacatcgcctttcttctcaatcagagggaaaataggaagcatcggatacgaatcctttacaatgacagcccgtactccctcaggaagcattcttggaacattctcgtagaatccgccacctgtgatgtggcttacaccgtggaccttaacgcctgctgcctttatggcctttaaggcgtgtacgtaaattctcgtaggctcaatcagcacatcgccaagcttctttccgccaagctcgtcataaggagtatcgagagactccttagtcatctcgaatacatttcttacgagtgaaaatccattcgaatggactccagtagacgcaagccctatcagaacatctccatcgtggatgttctcaccagtgataagatccttcctgtcagcgacaccaacagaaaatcctgccagatcgtactcatcctcaggcataagcccaggatgctctgcagtctctccaccgatcagtgcgcagtcagactgcttgcagccctctgcaacaccttttacgatctcggcaatcttctttggatagttctttccacaggcaatgtaatccaggaaaaacagcggctcaccgcctgcacaggcaacatcgtttacgcacatagcgaccgcatcgattccgatcgtgtcatgcttatccataagaaatgcaagcttaacctttgtgccgcagccatctgttcctgaaaggagaacaggatcttccatatctttgatcttatttaaactgaaagcacctgagaaacctccgatacctcctaaaacttctggacggacggtctctttaacgtacttcttcatcagctcgactgacttgtatcctgcctcgatgtcaactccggaattcttgtagtccatttactgctcctttaaatactctttgtaaccaatttcgttaagcttcttgtctttctctttgacctgctcctttaagtctttgaggtaagccttgagtttcgagagaagttctggatccgatacagcaaggatctttgctgcgaggattcccgcattggcgccgccattgatagcaactgtggctaccggtattcccgtaggcatctgaactatagaatagagcgaatccaatccgccaaggtctgacgtcttcatagggatacctatgaccggcatcggaaacagtgctgcgcacatacctggaaggtgtgctgccttaccggctcctgcgatgataaccttaatacctttgtcttcggcagatttcgcatattcgaaaaattcgtccggctctctgtgagcactgatcacattcatctcgtacgtgataccaaatttgtcaagaatgtctgctgcctttgccatgatcggaagatctgaatcacttcccatgacgatacctacctgtgccattttgcaatcctttctttttctgcttaatctatacaaagggacctgtaaagatcccaggctgcccaaaacaaatcacaaaatcctgtaaagtccaactaaataaagtacaagataaccagtcaatgctgccgccggaaggacgactccccaggctctcgatgagactgagtgccccggtttcttcgcaaagcggattccaaaaaccagctctataagactggcaaagaaaaatatcatcgaaaatcctgtcacctgacgcggcagagacttattcactgtcgcggcatatatagcataaaatagaaaaataatcccggcgagccctgcaaatgcgcagatcaacgatcttaccgaagcagcttccctttctctttttcttctgcgcttcatctgaattcggctcatctgcttttcctccagtggtaatgaatataatatatcaggcttccaatgaatcctccaagagtgtttaatatcacgtcgtccacgtcacagcttccgactcttgtaaaaagctgtatcagctctatggaacacgagaccgtaaatgccagcagcgttactcgaagcactgccactctctctgcccttttaaaaaatgtcaccagcgctccaaacgggataaatatcaaaacattaccaaagagattcatcagagaaatatatggatacacctttaaaagatgcaaatatctttttatctcatggaacggtactgcattgtacttgagcggccccgccagattcctgcttctccagtccattaggaacataacatagatcataaatatcagatatatgataaagagtaccgctccaataactttttttatcttatcatatctcccgcttttcattcctcagcgccgtactccctgtaataatcatcaatccgggttttcatagcatcatcaattataactgttccattgtacggcttattataaaggcattctacaacctcagccatcgtaactatcgaagtggtcttcatgtcaaattcatcggccagctcctggagcgcacctttcttaccagtgcctctctccatacggtcaacagagaccacaagtcccttaacatcagcttcagctactgactttatcagaggataagtctctctgatcgaagttcctgcagtcgtcacatcctctacgataattaccctgtctccatcattaataggggagccaagaagaattcccttctctccgtggtcctttgcctcctttcggttggcgcagtacccgcagtcaacgccatggttttcacttaacgctatagctgccgctacagaaaggggtattcccttgtaagccgggccaaataagatgtcaaaatccttcccaaagctgtctacaatagctctcgcatagtactcaccgagttttttaagctgtgagcctgtcctgtaaaagcctgtatttacgaaaaaaggtgtctttcttccgctctttgtcacaaagtctccgaactttaagactttgcagtctatcataaaatgaataaaatcttccttgtactgttccacgttttctccttaatgaactgctccgactatgtcgcttactctgtctatgtcgtggtcgtccagatacttctctataccgtcaataatctcaatcgcggcttctggattgtagaaatttgcagcgccgacagccaccgccgaggctcctgcgagcatcatctctacagcatccttccagtctgatataccgcccattccaatgatcggaatcttcactgccgctgctgcctcatagaccatacgcactgcaacagggtgaattgccggaccgctcaatcctccggtcttattggccagttcgaaggtctgcttctcaacatcaatcttcataccagtaatagtattgataagagatatgccatctgctccaccagcttctgcagccttagcgatctcctttatatctgtcacattaggagtaagcttcataactacaggcttcctggtatttttctttataagctttgtgatcttctcgacctcggcaggatctgttccaaaggcaagagctcctgcttttacattagggcagctgatatttatctccagaaaagcgatagccggatcatcgagtctctttacaacatcgacatattcatcctcggtgtgtccgcagacgtttacaccgacagtagcacctgcattttttaaaaatggcagatcccgctttaaaaatacatctacacccggattctcaagtcctatagaattcagcatcccagacggagtctcggcaatacgcggtgattcatttccttcccacggagttcttgacactccctttgtaataactgcgccaagccttgaaatatcaataaaatccgagtattcttcgccgcttccgaaggttccgctggctgtcagcacaggattcttcagagtcacaaagcccagatcagtcgtcaaatcaggtctgttcatcatatgataacctcctttgcgttaaataccgggccatctttacatacgcgcgccttcttgacattcagatgtccgtttacatctacagtgtcaatcgtacacccgaggcaggcgccaactccgcaggccatcttctcttccatagaaatatagcactccatatttctaacctttgcaaactgcttcacagcgcgaagcatcggaagtggtccgcaggcaaagatcacattcgccttcagataattctccataatggcactgactacagttcccttcgttccgtagcttccgttttcggtggctacatatacactggaaccggttttttcaaactcctctttgaggaatgggaaattactgtagccaagaactatcttgcagctgctcggaaattccttcgcaagctcaagcatcggcgggatccctatacctcctcctattatcatggcgtccttctgcggaatgtccagaggaaaaccatttccaagaggtccgataaactggatcgtatctcccgacgagagatgcgaaaattcatccgtcccctttcctgaaaccctgtaaactaatctgatagaacccctgagcctgtctatctcacatatagaaataggccttggcagaagcctgcttttatcatggcaaaacaggttgagaaactgtcccggctttgccacctgggatgacggtgtgtttatccacatagagaaaatattctcagcgacctgctcctgtcttatgataaacgctgtctcttttttcctcttgtcttcctccatgacatacctcctgtacacctgagcacttcaggcaatagcatttttaagatcctgcttcatatcaagcacagccgctctggaagcgtctgcaaaattctcttctccgtacttttcatagcctggctttgtgtaagctgcaattatgccgcgggatgagttgacgatagctccgtctccattcttatcgaagaatcccttcaagtcagctccctttccgccctgggctccatatcccggaacgagtataaatgtgtgcggcattctctcacgaagttccgctcccatctctggataagtagctcctaccacagctcctacatctgagtactgaccatggcgcaggtcctttccccactcctctactttatctccgacaagctcatagagagtattccatccgatctttttgtcctggaactctccgctcgatgggtttgaagtctttacgagaacaaagatacctttgtcctcatctttacatacatcgagaaaaggctttactccatctgtcccaaggtaaggatttaccgtcgcaaaatccgcatcaaataccggaacagacttcttcccgacagtgatcttcccaaggtgggcattagcataagatttggatgtggatccaatatctgctctctttacatcagctatgacaaaaaggcccctgctcctgcagtaatctatagtttccttataagcaataaggcccggaatcccgaactgctcatacatggcaatctgtggctttacagctggcacaagatcgtatacagcatcgactatcgccttattaaaggcgagaacagcaccagcagctgcctctaaggtttcaccacactcttctatagccgcctttttaataaatgacggaataaatgccatattcggatcgagtcctactactataggtgcctgtttcttatggatctcagagataagtttctctatcatcctcttgtcctttctattgctttgttatctgccctttgtataaaactgctctgacctgaccggtcagttttttgcctttgaacggagtattcctgcccttactcttaaacttatcagggtcaactgtccagaccttctttgggtcaaaaacaactatatcggcaatatttccaatgcttatgtctcccctggaaatacctaaaatcctcgatggattaaaactcatcttctcggccattcccataggtgtcagatatccaccgtttaccagaactgaattcgttagtgctgccgcagtctcaagtccaacgataccaaatggtgccttcagaaaactgcgtgccttctcctcctgagtatgtggggcgtggtcggtacttatacagtcaaaaatgccattcgagatgccctctcttaatgccgcaacatctgctctggtgcgaagaggtggattcatcttgtagttcgcgtcattattatccggtatatcctcacagctcagtgagaaatggtgcgggcagacttctccgctgacgcggatccccgcctcctttgcctgataaagatactgctctgctcccaccgtagaacagtggcataggtgaagccatactccggtctccttcgcaagcatgatatcccttaccgctattatatcctcgacagcgtttgaaatgcccggcagggaaaggcgcccggattctgtcatatttacgacaccgccctctaccagaggcttatcctcacagtgatctaaaatgacacctcctgaagccttgataatcttcatggcctgtctcataagggctgagttcatcacactcttcccgtcttcggagaataccctgcagcctgctgcaataagtccttttagatctgaaagttcctcacccttaagtccttttgtgatagatcccgcctgaagaacagtgacttttccatgcttttttgctttgtcgcaaacgtattggtacgtctcttcattgtcaacgacaggcaccgtgtttgccatcgcgactatcgtcgtaaagcctccacttacagctgcttcaatgcctgtatcaatggtctccttctctgtctgtccaggatccctcaaatgcacatgcatatcaataaatccgggcattacccagcagcccgacgcatcaataactgcatctgcgtcaccctctgtaacagcaggcaaaatactctttacccttccatcttcgactaagacatcagccagggtgtccattctgtctgccggattaataactcgtccatttttaatgataatcttcatcaacctgctccacagcttttgtagtgtattaacaattatccgcagtatcttatgaaacgcttctaagcaccgtcttcagaaaatcctgttcctttttcatatcctcatcatcgggatactgcttcaggtagtgtttgacacaattcagagcatttgaataatcattttcattctcgtagcagatgacccgaagcttcagcactttctttgaagccttcgcctccttcggcattttcccgtaaaacgaatcagcctgtttggtcatgcctgcatttatcagagaaagataagcattctcatacaggctggactttcctgacgcactgcatgccttactcagataagtaaaagccttatctggttttgcatcatcgcagtatataagtcccatcagatacagtgctttgtaatcctctggattaaatttcagaagactctcaagtgtttttagtgctgcattcttcttcccaagcttatactgtgcagatgccttgtagagtgctatgtcctgctcgtcttttccaactctgcccgactgtgccaatgcgccactgaaacacttcagcgccctgtcatagtccttgtcctgcatagcctctatgccgtcccttttgtactcgtcctgtttcttctttgaaccacatccagtcagtggaaatgctaaagaaaatataagtcccagggaacaaatgcttaatagtaatttcttcatcttcataactatctgattataccaaaatagagaatcaattaacagtgaacgtgtgattttttaatctttttcggtctcgcctctgctttcctctttctgcggaatctttatctttaccttcactattcttctgtgtctgacatcagaggcggtaaaaataactccctcctttgtcacatagctttctcccttcctcggaaggtgatcgaagagccccaaaaggtagccgcctatcgtatcatagtcttcggattccagcttcagtccgagtttgtctgacagatcgtcaagattcatagatccgagaacagtatattctcccggcccatcctctgtaaattcaggggcttctcttccatcgtactcgtcctgtatatttccgacaagttcctcgagaaggtcttcaagcgtgacaatgcctgaaacagaaccaaattcatcgagaactattgccatatgaatgtgtccttttctcatctggttgaaaagttcgtcggcatttttaaactcaaatgtaaaaaaaggctctctcagataactcttaagtgagaactgctcgccatcctttcgcttgatcagatccttcatattcaaaatcccaatgacatgatccgtatccgtgtcatacacaggaatcctcgtgtacattttctccatgaacacgcttctgactttggaataagaccagttgacatttatcatagtggcgtcgattctcgggatcattatctccctgacctctgtatctgaaaaatcaaagaggttatttatataatccttctcttcattctctatcgcaccactctcattccccacgtccactatcgtacggaattcagcttctgtcatcctggactttttgtcatctttatctgctccagctattttcattataaagccacagatatggtttactacaaaaatggccggtgtcagtactactgtaatagcatatataatgcctgctacacgaagcgaaagcttaagtgactgacggcttgccatattcttcggcgtaatctcaccaaagatcaggacaagaaatgtcataatgcctgtagctatccctgctccagagcttccaaacagattcatgaaaataacagtcgcaagggacgatgcggaaatgtttacgatattattcccgataagcaccgcagagagcatcttcggggtattcgaagtaaccttctggaccatcttcgcacgggaatcgccctgatttgccattgtgcggatctttatatggctgacagtagttagggcagtctcggccgaagaaaaaaatcctgagagtgctaaaagaataatcaaaattatgatctgaacagctatcatacgtttctccaaacatcagtacgcccgatattgtgagattaaaggggcaaacctgcccctttagtataacacagatattgattgttgtcgtcaaacattattttctgatacagcacattttttcatcaaatgacattcgtcgccgcttcgacctcgttcgaatactcacttcgttcactttgattgtcatgcccaatcctgcttccaaatgctctaaccctgtatctatataccccttgatcagggattctggtatcaagcattacgacatcagagcccagataattctctccactgccatttacagtaaattcatctatctttttaatagcttcccagtgttttaccccattccccttaatacacctgcgttcaatagtgtatgattctgtcaaatggtcattttcaaatagtaaacgtatatcccgaatgccactgcctggcttataaatagaaagcgttggctttctgagtttttttgtattaaaagtctctttgtatgtcataaactcattcccgcggtagtagaaaacagcttccgccagatatgtggtgtctggttttagatcatcgaatactattccagaattcatcttctgcccagacagccgcctcagagttttctttttagattctccccagtttgaaacagtcacctctaccctgtcagtttctgaattgatatcccaggtcagtctcaccgatgaaagcccttcttcaactataagcggcttgtttttctggctttcagcagtctttatatccgacaccttatttgtaacgaacgtatttctccagctaagcacatcagctgtgccactataaagcatatcttttgatttacggatgtcatcccctgaaaatatccatttctcaatgccttctgaatcatcttttacagcttcacttaatgcttttttgtatctttcctctttccatactgactttgcctctaaagtattaagtgccgattcagaaatcgatctgacatagattggagtcgagtaataactgtcggatgatgtccctgcgttgcctctcctcccagacaaaggaatgtcatctgatgtatcctccgcatcgtcacttaagacagtgactttagcagatgtaacagacctgttctgcttgaacctgttagtgtcagctacgttcttatccgcaacagagtagtagactacaacgcttcccacatcacccatattcttaaaagcttctacggaaaaagtctttctaacaggatctgtataaagatctatataccttctgtcgatgattccatcctcacgatctgtagctatcaccgtatcttttgacaagagcttctttatgacagtgttcttatcagacagctcatctgcataaaatgatacatcatttgccgtgataaccgggtattcgtcccagactacgtaaattttaagttctgcattctgaccgtttgtaagtagttttccatgctcaagggcagaaaagtatagtttcaaagcttcaacatttgaataattatttttgtaataaacttctaccgcagtctgccctggccagcgcaacgtatcacctgcacaaaatacttcgtttgtcatatacgatgagtctttataaaaactccatccttgaaatgaaaacccatgcttataatctctgtctttcatcaggtcataggcgtacctgtttctcgtgacagacttcttgaaatactcgtcactcctctcatcaggaccggtattccctgcaaatataaaagtttggccgttgtagtctttcgaatagtttctggcaccatttgtctgaccatttccatcaaatgtgagtgtaatgtttacatcccatattgcagaaaatatgtgatccgtttcatagattcctattatcctgtcattgtagactctattactgtatccattttcatctttgtctatgtacccagtttgttttaagccggcagtcacctcagaattatcccagaatacatggcacctgtcacttttataactatccggagcagtcctaaacattttcggttctttccagtaaaaagaggtcctttccggatgtctcactgtgagatgggaactttttactgggaaatcagcatcatagcttgcagacagaaaacatgataatacaatagtgcccgtatttccattagtcttctcaccctcctcaggctgaagcgccgcctccatattcttatccaatacatatggaccgatgccacatcttagaatagctttgtggtctgccaccttatcaaaactaagagaaaagccagtcagctgtctcataatacgaagtttttctttgtccgccatatttttgtaggaagcacttgaaatgtcattctgtccgtcggcagtgaatagttttaccattattcttccaggtttccggtcatttgctgcgagattaaacgaagctcttatcgatggaagtttattttcatactgttcttcataaagaatccgcacatttgacttcacctgtttgccgttctttttcttagaagtaaggtatatcgagttcgcaggtccctttggctctacgacagatcctggcagcatataaaatataccgttctgccataccgcagcctgcgatgaatcagttatattcacatccctgtaataaaagcatttcccgttattatctagtccacgggatgatccttttatatcgacacgatttcccgaatcatcgaggtcatctccaatgtatgcctctccagtggcagaatttataattccatttttttgtgcctgaatgttagcattttttaagtaaagttcgccttcgttttttatcccgttagcacacctgcctctttctcctgagatgcgtatatttttttctatcaggacagctgttgagttctgttttacactgatgcctgttccctgaagagaagattgtatctgcgctgttccgcttccatctatttctaaatggcagaagggatcataattacttttatcaaaaattttgtcttttccgtttttaccagtcagaataccacaagcatttccataaatctttacagaacgctcaggctctatatatactgatccaaactggacttctactgcaatatttccagctttaatctcacctccagagatattcattatagaattatccccatagtcaagcagatcagagatatcttcagctgtaataactgaccgctctatactatctgctttagctgaacttattttttttataatttcggtattccgtacagcgtcaatgtttcttctccctacgatgcctctgtcatcagccgaaatagtaatgtctgccggaagccaaagtttaagacaattataaataccacatgcctctgctctatccttggattgcttcaaagaccatgcctttgaatgaactgcctttatcgatactccctttccaatcacaagttttccacgattttgaacagcataactgttcacgaacgcattcccagcaaatgctccagtatttactgatattgaggtatcagatactgtaacagtacctttcttcccaattgttttattaaaaatgtttctgtcaaggcggccatttttcagcgatttagagacagccgtataagtagcatcgtcaaaattatcaatacctttgacgccgtacaaatgacaattcgttatatttaattttccacttgatctgaagtcaactgcgtctccacagtctccccttaattcacagttatctatacccgcttttacatttccctgcaatatgacaccattaaatctgccataaagctttgtaccgctcactgtcaaatcagcttttccgtttcctgaattttgtacatagattccatttccaatataatcatcaaaatcattataggtaaaagcgttagtttctcccataccataaagataagaattctttatagttccactaccgtttctcaacaaaatcgcacagttatgtgcaaggattttcgaattattaagtgtaagctgtcctattgacgaagatttatcctcatcatatgcactgaccattccgacttttattcccgatcccttagcattttgggatggattaatagtctcatactctcctccataagtcctgataaagacctgcttgccagaataggccagaatgttcgcattatcgagcgtaagcttcgccccattataaatacgaaaaacaaatccatcttccgttctttttacggaatgacctcctccatttatgctaatttttttgatatctccatctaccagccatttcttcctttctactccatcgatatctgactgcagactgccgcaatcgatattttttgcaattgaaagtgatgaatacttgtgtaccttttctttcagatcatatgaacttcttatcacagtatccttcggcgtagttgcgctttttgtaaggcttccggtctttttcttcgctgtgacagtcccatttgcgttaacaactgaataagcctgttcatattttacttttactgtatatgtttcaaagtccagtagattttcaagctttacactgcaacttcttcccgactgtgtgaggcttaaactggcattctgactatctcccctgcctgctcctgtagtcttccacgatgataccgaaaagcttacgttatcactatagccagaagagcttagttttggaacagagaaattcagtgttttagtaaatctgccatcatttgcagtcttcgcagcattttttaccaatactttcttcctcagaactggccccatcctggctttagtcttttgctttttcgtgacttctgtctcctcagtttctggaattttagctttcttcgtaacagactccttattctctgaatctttagtctttttagtggccggctccggattcccgatgtcctgatctgtcgtttcttcaataacgggctctggaatcccgatttctgcgactctggtatcttcagtggcgggctctgtattttcttctgcgcgtacacttgatacactaaaatgagtaatgataacaactgttgctaaaagtacacatattcccttctgtattcgtctctttcccgacataggctctccctcttatatatcaattatatacagctgttagtctgattccgttgttttctctctgttcatcccatctgacaaatgaatgtcccttgtactcaggagccgaaatatcagtgcttacattcatgccttttgtatatctcttctgatagtaaaggaagtccgctccctcatagtaatcaaatcctgcttctttggccacctgccatggaatgtaatagctgatgcactctgaaggtcttttgctttctctttcaactatctgaatagtagatgctgtcacagttcctttaccgccattcgggtaggtgaagttttctttgacactggctgaaagtatgcctttgtaaatatctgcagccttaatagttatctcgatgatctgtccattatctgttgcgtcggtcgcatagacttctccgttctctgaaacaaccctgcccgttgtcttcatctttcctagaaagctgcggataaaatcagccgtaagagcatcgttatcatttatctcagtcttttgagacagacaggcattctcaagagactgtttcgcagataatttgagtgcccgctccagttcagtctgccgtaaatctttagaatgaaccgtcataaggatgatcacgacaagtaccgccaccgatgtgcttataagtgccaaaaccacatgcttcatactctcccctttctatgacttacatggacaaacacctgataggagcttgtcacagaattcgaatccgtgactgacaccacaatcctgtaaatacccggcattgtaaatctaagatatgagttattcccatatatatcctcatagatgacctgatcagtaacatcgtatccgtcactatacgtttcattcccatgtagtaatcttactgcattaatatgtatccttctggctccaccgttctttagattgataaggcctccactcttctcataatatatgttctggtgaacaccgatatacttatcagaggacatggcgacattatcagatcggatacttagtctctgttttaaagctgcctcacctgtctgtgattcctgtcttactattccgctgtcgagttcttccgtcagccgttcatcagataacattaaattaaatccagtaaagatcaatgccatgattgcaaaaaaagctactgccgtaacaatagagtgaccatattcctttattaaagcctgcatctctctcccttcagagcaggtatccgcagaacgatatcaatatattgtgaaatattccgttcctgctcaaaaaaacaaaagcaaaaagccctaaaactgcagcaacagccaccgcccctgcgatggcttctccgtattctttaatgatctcctgcatacagttcctcctttacacactcgttatagagtttaataccatagcaagatacccagtaaccatcgcaccaacaatcgcatataatatagcttctccataatctgataggatttctttcatcttattctcctcatgtcattacagacgatacagaatgtgtagtgtcatatcctataaacggaatcctgaaatggtacttaagtgtagctctcgcatatgacacctgtctttttccattttgagctgctttcacaacctcgagcgcatcttttccttctccaaactgtacctttgcatcatttctgcaggcagctataacgtcatctgaatagtttgaattctctatctcttcaacataccccagaagtgcacggttagcattcgaagcctgaatagaagatgcaataaggcttatgcccaggctcgttatcatcagaaagaaaaacagcccggaaaatgatttaaatactgtctccataaaacctcctatgctacagttgacatgcttcccaaatacactacaaataacagcaccatatcacagacaagttttagtccgcctgtaagctgcggtgcaagaaaaagtgcatacatacctgcaagtgaatccgaatcctgctgccttttcgccttgtcgctcataagctggtttctttttataatatcagctatctgtcctctagcttctcctcctttaccttcagagatagaatagagcattttcatagtgctccttacttctggcagtgtaaaatctgagagaaaatccatgtaggcattcctgtcattcgggttcacacgcagtctgcctatcatctcttttagagcgggttttaaaatctcgggggcattgtcatacgatttaaaaatagcgacctgtacattctcaccctgcatcagaagagacatctgcataagccattctggaaaacatgtctttatatactcctgaatgctcttctttgcagcttttttgccgagtctggatataaggtcattcttataattcttgtatctctcgtactgttttaaatgctctttttcgcggtctctgtcgtctgccacataccccgccgtaagctttgaatctgccttgtaatagatcaaaagatcaagtaccaggactacaagcgttatgatctgtgataagatatttgtggaaacatccagattcatccttctcgccataaagaagatcatcgagcacagcagaagcgaagtcacgatcgagagaataatctctctccgtttaactttcttctcctgctgcagagcatagactctgtctgcccacattcttctcgattcaagcagaagatctatcgactccccgtactcaccacccagcgcttctgtcctcaatgcaaatctatgaatcacattaagcccctcgtacggatagtttttctcaatgatttttaaggctttatcctcgaagtcggactcattataagtgtttgtgatatgctcaatggctctgccgagcgtatctttcatctctccatcttcaaaaagatcctgagtatccttaagggatgcaaggacttttctattctttttaaacgaatacaggaactgctccatgtatatgttcaagtctgaaaacttcttctgataataacggttcctgtatgtattcctgagaaaaaacgggagtatgagcatccccactatggaaagtataatctgcggaataagctgcaacgaaaaaaatctacctaataaaaacaatcccacaataacaagtgcataccccaatattgattttctgacagagaatacatatccatacgccgtcatttcatctgaaagctgccttctctttcctgccaacaaatgtcatcccccttctctttttctgaataaattcacgttccatgtccgaaagaacctccgccgcttcctcaattctctgatccatgtctgctgcttcaggctttccattgtaatcactcatgctctcagctacagactgaagcggtctggcagggattgcatagccgtcagaatgcttatcatcacaaatctcagtaaccaggtcctgtctataatcaaatgtgtaaggatcctcgacacacgcctcctggaatttcttcatcatgacttcaggaatgtcgtttccagtcggttcaccctgatccaggactaaaaggcaactgttcttcttgttctccctgtagaaaaatcctatctgatctacataacgaatcacttcaaatgatccattaggacgctttctgagcttttttctgatcagaacgccaacatctataaaactgtagatgtcattttcaagcctgccctctgaacgcagactcccagccatattcatcatcctgtccgggaccttcctgatgtcgtctgtatgaagtgtcgtcatgccacgtacaccagtagaaaacccttcaagcagatatacaacctccttacttctggcctccgagagcatcatccatttggggttcagcctgagacaggtctttatggccttagtgtaatccatgaccggactgatccgaagttccacggaatctgcccctggatttagggagctgtagtgccactctgggttgtcctcgatcgtgatgactctctgtgacttcggaatatacgaagaaaaatacttggcacactccgtctttccaacgccaggttcaccgcagaatgtcatattcatccgtgctttcacacagtttatcagaaggtttatcatcgactccgacagatagccatctcttaccatgctgtctctcgaaagtcttgtaaacggcatagatttcctgatgcagatggctctgcctgtaatggctgctgactcatgcactatcgtaatgcgaagcgtctctgtctctgcttcgagcaccggagactgcttgtgaaactgcttgctgacacagttcgccactctcttcgtaaaagccgtgacaaaatccacaggaagctgtatcttcgcttgatatctgtggttcttagtatcggaaagccagagtctgcgcccgtcatagtctatgtcagtaatggaatcgtcctctatatactggtagagtggcccgaaaaactccgggctgatctctacctttccattctcttctgccatacatactctcctctctatagccagttacggtttgatcgctggagcaaggctcttggtagaattatcaaaaaatcctttgatgagattagagaatgcctctcctacaacgctgccagtatcacttccgataagaaatacaacaagtgcaataagtgctaaaatagctataactgtgatcaatgctggtccgtattcttttaaaatgtcttgcattataagtccccctttcaatgcctggaaaatagtttgtaaccgaaatgtataagacgcgtctgtccacaccactgaattagcagttgtgctttgtataaaatgatactcacagtcagggcccaatttcaattaatctccgattaagatttaattaaaataagtttataatctggtcagaattaaatattttaataattgggtgtgtagcagagaagtagaacagcgatgaaatacaagctgagtttgaagtgtcttttcatatttctaattcaggagaaccgtggcttatgccacggtttttgttgtttataattttttgtttatattttaatataaaaattatttaagtcgt

SEQ ID NO: 7 - DNA, 343905 bp, Unknown
  Metagenome-assembled genome
cttcaaatacggtattccgacagagcggaattggtcttcgagtcagatttatccctaatccatactatgtcgacagtctaagcacaagaccggaaacgacccagagatcgtcgagatttgtatcaggaattcagacgtgtcgcataagttttatgacaaactcaacggacctgatcactttcttatactgatacataaaagagggaaagaacgagcttgtgtatcttcattggatgtaccggcggcagacaaaccgctcttccactgtagccagagagctttaccacgcactggcaaaagcacatggcgatatcggagctcgcattgacaacgagttacgacacaggataattgtctttttcatcagatgtaaaggctgagctttacgaagttatatcccaaagccaggcactgccagactcgaggcaggcggctgtgacattgtcatagcggaaggtggcactggcagatatgccgtcagcggaaaactgaaaataaaaaaaaacttataaaaagtactttactttatgtattgcaaacgattaatattaaaaaagatgtctacgatgagctggcttgtggacggcaggaaactacagggaacttttgaaaataaaggcgatgactttactgacaagacgaatctgtgatcttagaacagaattgctgcaggagagtacatttttgcgggggattttttcttagtcctgggtctgtacgatccgacaatccaccacttgcgagatcgtctgcacacacactgcggaaggcaggagctcgtgcaggacttctatccggattgatgctgtgatcccatatagtagagagaaaggcactttcgtagttctatttgaaagagggctgcgcagattattaaatagcttggcatcataggtgcaccgaaggacttcatgatttgaaaatatcatgcatcttaaagaagatcgtgaaaacgtcaccggcgcgtgaactgtgacgactcaaacatccgaagtctgtttcgacaaagcatcattcaggagacaattgaagacattcgctttttcaggagagcggaattttgcgggagctggggcaggcgctctgcaggcgagccgcaaactgcggcgttgagaacccggagatgccacgttacgaactggggcagaaatgccacctccggttggaaagagcggcataaggtaaccagagctcagaaaaaatcggaagttggctatgatattaaacatcaggccaccccccaccaccccccaccaatacccctccccacacacccaaacaaccccaccccccactccaaacgatacacaaccagcacccatccaaccccaccatcaaaacaacacacccgccacgctcccaacctaccctccaccaccccaccaccaactccccaatagtaacaccccactctccaacaacaatcacccccccccccccacaccctcaataacaccaccctcatccccctaactaaatcccccccaccccctgacaacatcaaccaaccccaaacaccaatcacacatcaacccacttcccacaaaatctactctcccccctctaatgaccaacaggaatcctaacaccccctcacaccacgaacctccaaaaaaaccaacccctaacacaaaaacaccccacccaacccacccccaccccccccccccccccaccaccaaccccaacccgaccatccaacctctcgccctcccctccccctcaatccccaacaaacaccccccaaagtcacacctccaccccagccccaccctcccccaatacctcacacatctctccccacccccaccccaacgacccccaccatccaacaacttcccccacaacccaaccctaccccacaatccctcaaagacccccccccaccccacaacccagcccacacacctaactgaccccctcccgctacacactaccacacccacccccaaccacccaaacctccacacaacaaaagccccaacctccacccactcccaacctaccaacatcacctgccccccccacctcatttcttccccataccagtaaacctccttccccccaaccccccctaatcccaaacccacctctcaacctaccccgtccccactccccccaccccacccccaaaaaaaattccgtacccaaccacaactcacaactcccctatacccatctcacccccccctcccaactcaacccaaccacaacttccactcctccccactccacaaaccccacccatccaatccacctcccgcagtccccacaacaattcaatccacaccaccaaaatacaaccagacccccctcagtaggcgataacccctccaacaccataaccctccttcacgctacccctccgcctctcttccccccaccccccccccacacccccccctctccagcggacacccatgaaaaaaaatgtcaccatcaaaagcgtgagacaatggaggcaactcctattgctcacttggtgcagctggctaatcagttccagagccaggtgtatatgagaaggacactaagaaggtaaacgcgaagagcatcgggatgatgagcctcgtgcttacaagaggtaatgaagtgacaatagatgctcagggcgacgacgaggagaaggcagtcttagccattgaggatttttcaccaaataagaccggggttattttcatggggaaaaaaaatctgtttatctacaatccacattcaggacgcggcatggtcaaggtacacctgtccgatatcattgagaccatggtgcgagccggatatgaggttgtagtttatcctacgcagcatccgaaagatgcagagcagaaggcaaaagaatacggtggttcatttgacaggatcgtagtcagtggaggagacggtacgctggacgaggtcgtctcaggtctgatgtctctcgagaacagatgcgctgtaggctatattcggcaggcagcacgaacgattacgcagcgtcactcggactcgagtcggatatgctcaaggcttccgatacggcagtcaatggaactccgacaaaagtcgatgtcggcagtttcgcggacaggtatttcgtgtatgtggcggctttcggcatttttacagagacgagctacactacgagccagcagctgaagaacgttttgggacatgcggcctatttctttcggcattcaaacagctcaaagacataccatcgtacaggatgcaggtcgaatacgcgggaacgtgctctacgatgaatttatctatgggatggtcacaaatactgtctctgtaggaggcatgaagggcctgatctcaggcgaggttgacttaagtgacggactttttgaagtgactctcgtaaggacaccgaagaatctatcgatctgagccagattgtgtcttctcttacgggggtggatacggatacagacatggtgacttcttttcagacaagcagggtgaaatttactgctgctgaggagataccgtggactttgggacggagaatatggcggcagacctgaagaagtagatattaaggtgctgaatggtgccataagtatcgtcagctgaaaataaggttgaacgaatccggctaatggggtataatgctttttggtgtttaaaaaccaatacatgaaacggaggatacgtacatgttagttaatgcagcagagatgctcaaagaggccaagaaaggccactatgcagtaggacatttcaacatcaataacctcgagtggacgaagtcaatccttcttaccgctgaggagctcaagagccctgttattctcggtgtttccgagggcgcaggcaagtatatggctggatttgatacagttgcagctatggttaaggctatggataagagcctggaatcacagttcctgtagctcttcatcttgatcatggtacatacgaaggctgtacaagtgtattaaggcaggcttcacttctatcatgtacgatggttcacatgatgacatcgagacgaatgttaatcatacaaaggagctcgttgctatagctcatcatcttggcctgtctatcgaggctgaggtcggcggaatcggcggcgaggaagacggcgtcgtatctatgggcgagtgcgctgatccggaggatgcgagagaatcgcaaaccttggagttgatatgctcgcagcaggcatcggcaacattcacggtgttacccagagaactggccgggacttcgtttcgacgttcttgacgctatccagcagaagacaggagatatgcctctggttcttacggcggcacagaattctgacgacatggtaaagaaggccatcacttcgtgtgtttcaaaggttaacgttaacactgagtgccagctcgtatttgctgaggctacacgcaagtacatcgaggcaggcaaggataaggaaggcaagggcttcgatcctcgtaagcttctcgacctggtggcgaggctatcaagggcaaggtaaaggaaaagatggagctcttcggttctgttggaaaggcctgaataataaatcagttttacaccggcgcgctggacttcggtccaccgcgcttttttgtgggacaaaagggacggttctttttgtcccgccaggtggtttattttggcgggaaataggtataataggttataactgagagaaaatgtttctcagaattatatcttttaaggaggaaaagacgaatgaaaaatgtcaaaaggttacttgccatcgcgatggcaacagctactgtagtcacagcagcacctggggcggttttgctcttgcagcagattctgcaacaaactctgatgcctgcagctactacgctcggcgacgagcaacgactaaggtacatacatgtcgatgatgaagaagtcacagctgatactgatgccaagaagaaaccggcattaaagcttaatacagtgaccgatgctggaaagactgctgcgataactgtatctggtaccacagaaaaagtttatgttataccagaggatacttcggttgtaaaagctgacgtaaaggatcagacgttacagtcacagcacagaaggcaggcaagacaagcatcaaagttacagtaggaaggaggagttcactgttccagtagagattgctgatactgtatctgatattcaagacagattgtggtgaggattctgatactgtaacacttgaccaggatacttcaacagctgtaaatgccaggaagacagcaaagatcgccggaacatcagaacttggacttgtgtaaattatgacctttacacttcaaaggatgacaagggtcttgtcagcggcaacaaaaaatgagtcgtttcacttgcttctgatggcacacttacagccggaaagcaggacggaacggtttatgttaaggtttatacaaatgacaataacggcaaacagatgaagggggcttctgcctgggttactgtactgttgcaaaacttccagaggccacatcacattagcagaatcgatacacttgatgtaaggactaaactgcaaccacaggtagttacatccagtcagtaacagatcgcttaaatggatgttggcctctggagttttgcaacagtaacaaacccaggcagaagcccccttcactgtttgccgttattgtcatttgatagaccttaactaaaaccgttccgtcctgctttccggctgtaagtgtgccatcagaagcaagtgaaacgacatcatttttgttgccgctgacactgacccttgtcatcctttgaagtgtaaaggtcataatacagcaagtccaagtgtctgactgtatgttccggcgatctttgctgttcctggcatttacagctgttgaagtatcctggtcaagtgttacagtatcagaatcctcaccatcaatctgtgtcttgacattatcagaacagtatcacgcaatctctactggaacagtgaactcctccttgcctactgtaactttgatgcttgtcttgcctgccttctgtgctgtgactgtaacagtctgatccttacgtcagcttttacaaccgaagtatccctggtataacataaacttttcttgtggtaccagatacagttatcgcagcagtctttccagcatcggtcactgtattaagctttaatgccgggttcttcttggcctcagtatcagctgtgacttcttcatcatcgacagtgtatgtaaccttagtcgtgctcgtcgccgaaggcgtagtagctgcagcagaagttgttgcagaatctgtgcaagagcaaaaaccgccccaggtgctgctgtgactacagtagctgttgccatcgcgatggcaagtaaccttttgacatttttcattcgtcttttcctccttaaaagatataattctgagaaacattttctctcagttataacctattatacctatttcccgccaaaaaataaaccacctggcgggacaaaaaagaaccgtcttttgtcccacaaaaaagcgcggtggaccgaagtccagcgcgccggtgtaaaactgatttattattcagcctttccaacagaaccgaagagctccatcttttcctttaccttgcccttgatagcctcagcaccaggtgcgagaagcttacgaggatcgaagccctgcgcttccttatccttgcctgcctcgatgtacttgcgtgtagcctcagcaaatacgagctggcactcagtgttaacgttaacctttgaaacaccgagagtgatggccttctttaccatgtcgtcaggaattcctgtgccgccgtgaagaaccagaggataatctcctgtctttgctggaagcgtcaagaacgtcgaaacgaagtcccggccagttctctgggtaaacaccgtgaatgttgccgatgcctgtgcgagcatatcaactccaaggtttgcgattctctcgcactcctccggatcagcgactgccccatagatacgacgccgtcttcctcgcgccgattccgccgacctcagcctcgatagacaggccaagatgagagcatagcaacgagctctttgtatgattaacattcgtctcgatgttcatgtgaaccatctcacatgatagaagtgaagcctgccttaatacacttgtagcagccttcgtatgtaccatgatcaagatgaagagctacaggaactgtgattccaaggctcttatccatagccttaaccatagctgcaactgtatcaaatccagccatatacttgcctgcgccctcggaaacaccgagaataacagggctcttgagctcctcagcggtaagaaggatgacttcgtccactcgaggttattgatgttgaaatgtcctactgcatagtggcctttcttggcctctttgagcatcttgctgcattaactaacatgtacgtatcctccgtttcatgtattggtttaaacaccaaaaagcattataccccattagccggattcgttcaaccttattttcagctgactacttatggcaccattcagcaccttaatatctacttcttcaggtctgccgccatattctccgtccaaagtccacggtatctcctcagcagcagtaaatttcaccctgcttgtctgaaaagaagtcaccatgtctgtatccgtatccacccccgtaagagaagacacaatctggctcagatcgataggattcttcggtgtcctacgagagtcacttcaaaaagtccgtcacttaagtcaacctcgcctgagatcaggcccttcatgcctcctacagagacagtatttggaccatcccatagataaattcatcgtagagcacgttcccgtcgtattcgacctgcatcctgtacgatggtatgtctttgagctgtttgaatgccgaaagaacataggccgcagtcccaaaacgttcttcagctgctggcgtagtgtagctcgtcttgtaaaatgccgaaagccgccacatacacgaaatacctgtccgcgaaactgccgacatcgacttttgtcggagttccattgactgccgtatcggaagccttgagcatatccgactcgagtccgagtgacgctgcgtaatcgttcgtgctgcctgccggaatatagcctaagcgcatctgtttcagagacatagacctgagacgacctcgtccagcgtaccgtctcctccactgactacgatcctgtcaaatgaaccaccgtattcttttgccttctgctctgcatctttcggatgctgcgtaggataaactacaacctcatatccggcttgcaccatggtctcaatgatacggacaggtgtaccttgaccagccgcgtcctgaatgtggattgtagataaacagaagttttttccccatgaaaaataaccccggtcttatttggtgagaaaatcctcaatggctaagactgccttctccgtcgtcgccctgagcatctattgtcacttcagtacctcttgtaagcacgaggctcatcatccccatgatgctcttcgcgtttaccttcttagtgtccttctcaatatacacctggctctggaactgattagccagctgcaccaagtgagcaataggagttgcctccattggctcacgcattttgattgtgacattttttttcatgtggtgtcctcctgatgtttaatatcataagccaactgtcgatttttcgagcctgtggtttatgccgctctttcccaccggaggtgagcatttctgccccagttcgtaaagtggcatccgggttctcagccgcagttttgcggcctcctgcagccggccccagtccgcaaaatgtcgctctcctgaagaaagcatgtcttcaattgtctgactgctgctgaaacagacttgcggagtgttgacgttcacagttcacctgccggttgacgttttacgcatctttttaagatcctgatattttcaaaatccatgaaagccttcggtgcacctatgatgccaagcatatttataatctgcgagccctctttcaaatagactacgaagtgcccttttctctctactatatgaggatcacagtcataatccgatataagtccctgcacgagctctgcctgccgcattgtgtggcagacgatctcgaagtggtaggacttgttcggatcgcttacagacccagacgaaagaaaaatcccccgcaaaaagacctcctgcagcaatctgttctagatcacaggattcgtgtcagtaaagtcatcgcatttatttcaaaagttccgtagtttcctgccgtccacagagtccagctcatcggagacatcttttttaatattaatcgtttgcaataataaagtaaagtacttttttaagtttttattttcagtttccagcctgacggcatatctgccagtgccagccttcgctatgacagatgtcacagccgctgcctctgcgatctggcagtgcctgctttgggataaactcgtaaagctcatcctttacatctgatgaaaaagacatatatcctttgtctatatctgtttcaatgcggagtcgtagtcgccatcgtgctttgccagtgcgtggtaaagctctctggctacagtgaccgagcggtgtctgccgccggtacatccaatgcagatcacaagctcgttctttcctcttttatgtattcaggtataagaaaagtgataggtccgtgagtttgtctataaacttatgcgacactctgaatcatgacataatcgacgatctcctggtcgtttccggtcttgtgccttagactgtcgacatagtatggattcgggagaaatctgacatcgaagaccagatccgcatctgtcggaataccgtatttgaagccaaatgagagtatcgtgatattcaggttcttgtagttggtgccctcttcgaaaatttttgtaagttcagcggcgagatccctgacaagaagatgcgatgtatcgactatataatcggcccgtttttttaaaaaggccatctcgtcccgttcttgtggatcgcgtctatagtcgtccaccatcggcaagcggcggcgtcctttctctctctttgaatcgcttcacaagtgtgtcgtcatcagcatccaggaaaagtactggacttttttgccatcgctcgagtcatcgaggatatttcaagctttgaaataggtgtacggttctcacatcgattcctacggcaaccttgtcgttgttcggtgaatttgacgcaagagaggcaaagctgcggaaaagaggtatagggaggttatcgacgcagtgtgtaccctatgtcttcaagtattttaaatgcgtatgttttcctgcaccagacattccggtaattatcagtaggtccatgcgccttaccctctctaaaacgttccaattatcttaacttccggctcggtgtaactccagtttttaatttcacctgttcgataattggcttatcagattatagatatccgaggccgtcgcttcacatcatatgacaaatcccgaatgcttcggtgagacacaggccccgccaacctggcatcgcccattccagctcctgcacgagctcaggccggtgtatagcctcgggcgtatccgtctccgagctttctgaacgtgcttccggcgctccgttttccaacaggctgggatttctgcgttctcgcggattgcagcggcgcgggcttttatctgctccggatcgtctcttctcaggtgcaggactgctcctgttattatctctttattctttgaaaaaatactggtacggtagtcgatccaatctggtcgcagtgttttttttcagtaccgttcatatcgactgcagttacacttacgacagagtcactcatgtcgccgccaaatgctcggcattcatatagactgcgccgccgatcgtacccggtattgggtggcaaactcaaggggtaaggccgttttcacacgctcttctggcaacaatcggaaggagtgctcggaggctgcagaaatgtctgctacgccatctcatcccgaacttcgagggggagtcgatacgatatttcaatagcgcgaacgcgcgaatgagcagccgcgaagcgggtgcgaatagcaccgctcatttgtccatagcgcgaaccgcagccgcgaagcgggtgcgaatagcaccgctcatttgcgaagagagcgaaggagcgtatcgatgccggcggacgagagcgtacgcaaaggcaatcgatacgatatttgtaagcacttattataaagtttggtgacaccgtgaaatatttgtggtagaataatgtgctatggaaataacagttgatggaaaaaatataagatataaagtgactggcagtggtaagaagaccgctgttatactgcagggctggggcacagatatgaagctatacgattcgatcgctgcggatataagcgatgagtacagggtcattcagttcaatctgcctggattttcagacagtgaagagccttcggaaccatggggcgtcgaggagttcgcggcctggttcaatcattttatgcaggcacttgagatcagaaaagcggtcttgatcggacacagtttcggcggaaggataatgatctggctcggttcgctctcgaaggacgagatctcatttgctatcgacaagctcgtgcttgtggatgcagcaggcattcagagggagaagacgccgaagcagaagaggagcatcgcaagataccattttaagaggagattttttcatctgccgcttatctactatttttttaaggatgcggtagacatatggcagggacagcagggcagcgctgattacaggaattcttccccgatgatgaagaagtgcatggtaaaggctgtaaatgatgaccttacatacaggctgccagacattccttacgagacctgccttatctggggcgaccaggacactgcgacgcctcttttagatgggaaggacatggagaggctgatgccgaatgctgcgcttcatgtgctgactggaactgatcatttttcttttctcagaaaaccgcaggagttcaatgagatactaaggagctttttatgctgaaaactataaatctggtgctaggcgatgtggaggttgtggtcacgctggtgacactgatactggctctccgcttcaacctccagatgttccagcagaacggttataaaaatggtgaatattttcactggctctcgaaaaacagtaacagacagcgcttcctatgggcaatgatcatcacttttgtgctgcagcttctgatcaggcagccggtgatccagctgatactgatagtgatcactattgtatggcttggcgcggtaaattccgcttacaacctctatagaaagaccgagaccaagaaaaaactcgttgtcactgcgagagtcaagagactgatcgtaacttttataattctctgtgctctgatgctgatcttctcgggaaaatacagggttttctgcactggtgtatttcttatctgcactccggagatcgtgatcctatgcaatattataaatcatccaatcgaagccgggatcaacaggtactatatcagagatgcacagaaaatcctccgcgaaaacccacagatcaagctgataggtatcaccggaagttatggcaagacatcgatgaagtactacctgaatacgcttcttaaggatttttacgatgtgcttattactccgggaaatttcaatacgactctcggtgtcgtcaggaccataagagagcatctgaagccatccaaccagattttcctctgtgaaatgggcgcgagacacgttcacgatatcaaggagatctgtgatctgttcaagccatctgagggcatcattacgagtatcgggccgcagcacctggagacgtttcacactcaggagaatattgtaaatacgaaattcgaactcgcggacgcggtcccggagggcaacagggtgtacctgaacgccgacaacgaattcgagctgaaaaaagcttccgaatacactgacaagcgaaagatcattttttactcatataagtcgaacaagggctaccatgcatctgaggtgcgccttacaacgcttggcacagagtttacactgactgcaccggatggtgagaccgccagatttactatgagacttataggtgagcacaatgtcataaatgtatgtggtgcgatcgctgtagcgcatgagcagggtatttcactcgagaagctccgcgttccggtcagaagaatcgaacctgttccgcaccgccttcagatgattcagcgcggtgacgtgactataatcgacgatgcatacaattcgaatccagccggttcaaaggccgctgtcgagacacttcatatgtttgacggcataaggatactagtgacgcctggaatggtcgagcttggtgagaaggaagacgactacaactacaaatttggcacttacgcagctgcaaactgcgactatattctgctggtcggaaggatctcgcatacggatcctatcagagatggcgctatcgaaagcggttttcctgaggcaagagtccgctcatttgacgacctccagggtgcgatgaactgcgcttacggcatcagcggtgagggacacaagtatatcctccttgagaatgatctgccggatgcttattgatgattattttgattcatttgataattattttttatgtttgaaaggaacaaaatgaagactagagtagctgttatgtacggtggcagaagtgttgagcatgaagtttccgttatttccggaatccaggctctgatgaatatagacacggacaaatatgagacgataccggtctatattacgaagcagaacgagttctatgtcggagatgacatcggaaagattgaggcctataaggatatcgacggactgctcgccagatctcagaaggtcgtctgggtcaatgagggagacaaagttgtcctctcgccttacccgaagaaaatgttcggcggaatgaaagatatcgaagtcgacgtcgcattcccggtagttcacggcactaacgaggaggacggaacactcgtaggatttttaaagactcttggcattccgtttgtaggctgcgatgtaacctctgcagcagtcggaatggacaaatacatccagaagtgtgtcttaaaggacgttgatattccggtcctcgactgtgtctgcttccacgaggacgattatgctgacatggaaaaactgctagacactgcagagcagaaggtcggctatcctgctgtcataaaaccggtaaattcgggctcatcagtcggaatttcgatggccagaaacagggaagagctcacaaagtcgattgatgacgcatttacctacgcttcgatcgtacttgttgagcatggaatcgagaaattaaaagagattaactgctctgttttaggagatgacagtggcgcgaaggcatctattcttgaggaaccattccacacgaaggatatcctctcatacaaagataagtacgagagcaatggcgccaagtccggtggttcgaagggcatggcttctgtccagagaaaaattccggcagatcttccggaggagaccacaaagcagatccaggactacgcagtccgtgcattcaaggcactcggatgcaacggtgtcgttcgtatcgactttatgatcgacgaagctaccggaaagctctatttcaacgagataaatactatacctggctcactttcgttctacctctgggaaccttcgggagttccttacaaggatcttctcgatcagcttatacagcttgcgctgaaacgtgccagaaagtaccagaatatcacatttacatttgatacgaatattctgaattcagcttcattcggaggcgcgaagggagtcaaataatggcagagatttttgagccaattgaaaaaaatgatataattcatgcgccgattgctgtctttgattcaggagtcggcggtgtttcggtgctccgcgaactcgtgcgcgtcatgcctaaggaaaaattctacttctatggggattcgggaaacgccccgtatggaactaaatccaggtacgaggtcctgcagcttaccagaggtcatgttgaggactttatcgacatgggtgtcaagggaatctgtatcgcctgcaacaccgcgacatcagctgcagtaagacagcttcggctcgactatccggaagttcctgttgtagggatagagccggcactcaagcctgcggtctcatttatgcaccaccctaaggtgctcgtgatggcgacacctatgactatccgggaaaataagtttcagaaccttctgaataaatacggcgaagaggctgaggtgttcccgctcgcctgcccaggtcttatggagtatgtggaagctggaaaagccgggacagaagaagttcagaaatttttaaatgatctgttgaaagactatgcgcctggtggaaaatacggtcctatggacgcagttgtcaccggctgtactcactatccttttgtcaaagaccagatagagactgctctcggtggcgggacccgtgtatttgacggcgcaaatggtactgcccgtgagatgcgccgcagactttttgcggccggcagcctgatccctgaggaacgcagcacagaggctctttccgatgagcagatcctctcccgtgtccactttgagaactctgccccggaccgcgaggcaaagattgagctgtgcaggaagctgctgctggaaaaatgacagggtggtaaaaaggaaaaatacaaattcgttgtagttaaaaattatgagatataagaatattttttttgacctggacgggactatcactgattctggaaatgctataatgacatgtgcaaagtatgcccttgaccggatgggttttccagatgaaccagaggagaggctcagaagatttgtagggccgtctctgatggattcttttgtgaaactctatgggatgacagaagagagggcagccgaagcaacccgtatttttcgctcactctatgtcgataacaaaatgtatgacgttacagtttatcctggtatccctgagcttctcgcgaagtgtcgcgaggccggcctgaagacttttgtcgtgacctcgaaagttcaggaatatgctggccgtattattaaaaaaacaggtcttgcagaccttttcactgatacaatcggtcctgatccaaccgatttttcttctgataaatcaaggcttatcaaccgcgtagtcgatgattattctcttgataaggcagagtgcgtaatgatcggagacacccgcttcgatatcgagggagcagtaaaggctggggtagactcgatagccgtgacttatggctatggaaatccggctgagatgcagatggtccacccgacatacaaagcggcagacgcggctgagattggggatataatacttccgtgaaactttttatttctgtttcagatggtgattgtaaaggtgaccatattcaggacattgcttccggtcgagactccggaaagaccagctgtcgtgccgaattggccgacgactaagaggtcgactgctccatacattgcctggagtatcagggaaccgaataactgaaacgtaaacatgagttgcttttttacggtaggccacaattatgagcaataaaactcttgatttaaactttctgatcaatctgataaattcatataaaaaactgtccaaatctgagcgtgagaagttccttgacttcaaactgcgctattatcagttctttataaaggtctctctgacggctacctgcctttcgtctatacttttccttgtgtcagatgcacaactaagcggaaccttcggttctacagtgattacccggttttccgtcatgttaccgttgatactgtatcttatcgtggaaccaaggataaagggcaggcggttaaagacattttcggattattttctgtcagaatgcatagtgtgggcaacgatatggtcagtctatcatttgacaaacaaagtccacttcgcagaaggttcgttttccatgaaccttatatttataatcctggggcttggcacatcagctgcgtcaggacttatcaattatgcagtatttttcgcgggacttatcatatcaaatacctttaactgctatccgaattttgatatcatcctgtcgctcaatatccctactgccgtagctgtaaccgccgcccaggttattctctcgctcggtgcgtacgacaattacctgacgaatgcaaggcttgaaaaatcactgatgtatgatgccctcactggagttggaaacagagaacgcctgcagagtcttctctctgaaaataaactggttaaggatataaaaccgacatctgtgatcatgatagatgtcgataatttcaaaagcataaatgatacaaatggccatgaggccggtgacatagtcctcaaatatgtcggcgattttttcaaccgccacatgagaaacggggataatgtgataaggtacggtggcgacgaatttcttctgatcatgtataactgtaaaacaactgtcgccagtaaacggataaaagccatccgtgaaaaaatgaacgcagacgagacaaaaccgtatgatttttcattttcggcaggaatagcggcatataccggagacttcaaaggcgaccttgagtgcgcggacaaggcactctaccatgtaaagcagggaagcaaaggctcgacctatgtctcaaaataataagcttcaccggcccgcttggaagaggctctgactgtcagtgtgtcagcagactcccaggaattagcctatttaaactatgtctgcggttaaaacgtacagctttttccagggaggtcaagctgcagttttttcacaaatttttcatgtagatattttcaaattctgtgtatatactataatagtttcaagagattacacgaaaagaaggagaaatcgagtctatgggttctgtaaaaaacggaaaggctccagaggaatatatcagggattttgaggagaacaaaggccatccgctgaagaccttcatggctcttttcaaggggtattatcataacctgatactagcgggcatttttttctttataaaacacagcccggtgctggtttttccaatagtcacagcaaatatcataaaccttatcatcgaaaataagcctggttccctgcacagcatcataataaatgccgtggtgatcacggcgcttcttattctgaaccttccgatggctgaccttcagatgcatttcaggagtatcgcgcagaggtcggtcgaggcgggacttcgaaaaagcctggtgtataagattcagcagctttcgattccgtatcagaaggatatcgagactggacgtatgcagtcgaaaatgatccgtgatgtcgaggctgtggagaccttgtcggatcaggtcttcaataacatgatgagcataatcacggtgtctgtcgcggcgtttgcagtaacagctgttaaaagcctgactgtgcttgtatttttcctgttgatgggacctgtcggagcagttgtggtctactcctttagaaagcagattttcagacggaaccggacctttagaaaagagatggagtcagcgagtggaaaagtagccgaaatggttgaattggttccggtgaccagagctttttcacgcagattgtcggccagatgaaccagcttcttaaccttattcctatccttacgaagggacttgagtcagttacaagtattggagagattttgacagcggatgatatagaagaggacaacggtaagaggatacttaccagcatgaacggagattacgattttaaggatgtgacctaccgatatccagacaataccgatccggccgttctgaatctgaatcttcatgtaaatgcaggcgagactgtcgcgtttgtcggagaaagtggagcaggaaagtccacaattttaaatctcctggttggctttggacagccatcagagggtgagatttatatcgatggacagccgctttcagaaatctcgctcaggtcttatagaaaatttctcgcagttgtaccgcagaatacgatacttttttcaggaagtgtaagggaaaatattctctatggcactactggggttacagaagaaaagtttaaggacgtgctgaagaaatcaggtctggagagcgttatcaaaaacctgccgaacggtgctgacactatggttggtgaacacggcgacaagctttccggcggccagaagcagaggatttcgatagcaagggctcttatcagggaccctaaggttctgattctcgatgaggctaccagcgctctcgatgcagtctcagaaaaagaggtctccgagactcttgacagccttggaaacagctgcacgacctttatcgtggcgcatagactttcgactgtccgcagagccgacagaataatcgtcatgaaagaaggaaaaatgatagagaccggtaccttcgacgagctgctaaagcgaaacggcgccttccaggagatgataatggccggagccggggactaaaggagctatgataacacatatgtcacagacttgtaattctgcttcacatggtagaacgctgtttctggcctcatgaccgttggagtcgtttgtttttttaaattatcgacatcaatcatgataagaaaagccgggcggacatccttaaaggaagtgccccaattgatcttagcgctcaatttgttattgaaacaaatgtctggttgctttatacttatattgagtacttgagacgcaaacgtctaaagtactcaatataaggaggcatctatgatacaacgtaatctctatatacagcagcttatttcttacatgtgggatggtcagatcaaggttattaccggtatacgtcgctgtggaaaatctgtccttttatttgaactatttcgtgactatctgctatcacaggggacaaatgctgatcatatcataacgatagaattggataatcgtaaagatattaaataccgcaatccgattattctttgtgatatggttgaagaaaaaattcaggaaagcactcagcagtactatctttttattgatgaaattcagctttctgtttctgtcccagatccagattttccaggggaaaaggtgactatttatgagatgctgaacgaattacgaggatataaaaaccttgacatatatgttactggcagcaattcaaaaatgctttccagcgacattatgacagaatttcgaggccgttcttcacagatccatgtatttccgttttccttcaaggaatttttcatggcagttggaggggataaaagagacgcatttgacaggtatatgctgtatggagggatgccatatcttctgaatttaaaggaagaccgtcagaaaaaagactatctgaagcagctttttgacgaagtatatataaaagacatcgtggaacgtgaaggcatcgagcgtcctgatgttttatcagatattttggattacctggcatcgtctgtgagttcactgacaaatccaacaaatatcgccaatacacttaacagcacaaaaaaagcaaacattagcgcaaatactgtctcaagttatctggggtatttaaaaaatgcatttcttattaatgaggcaaagcgctgggatgtaaaaggaaaacggtattttcaatatcccaataaatattattacacagatattggtcttcgcaatgcccgagttaatttcaggcaattcgattctgggcatataatggaaaacatcctgtacaatgagttgatcgaacgaggatattccgttgacgttggtgtcgtatatgaccgcaggagggaacagaaggtgcagaaagagattgattttgttgtcaatcagggagataaaaaggtatatatccagtctgcatatgaaatgactaatacagagaaagcagcaagtgaattggattctctccgcctgactaatgatttttttggaaaaataatcatgcgtcgtgatataccggcctcctttacggatgaaaatgggatacgccatatcaatgtactggatttccttctaggcaaagagtctatcttctagggacattatctgcctgtcggtattatttcaaatcattccaatttagaatatttatatttacattccgcactcaaataattccatacttagacagatcaactttcccgtctttcacttcaatcccgtctgcttgaagaagtctttcctgaacaccttctccaaatgcaaaattgccggacaggccacctttcgagtttacgacacgaaaacacgggatgtgatcagaatcaggatttctatgaagcgcatttccaactgctcgcgacatcctgggattgccagccatcgcagccacctgggcataggttgcgacatggcctttaggtatttttttcacagcctcataaatcctttttgtcggcgagtcggtaactaagtcatagctaagtgctatcatatttttaatctcatcgtcaggaattgagccatcgagaattatggtattccagtggtccttattctgatgatacgcaggaatcactgaagtatatacctgtctccataaatcccttgaatccggatcaaccttgacgttcagatttataaatccatccttctcatatgtccataagaaggcctttttgctttctttaactcttacaagccgccagttggtctctttaaatggtgtatctatatatgtgtctggaaaggacagcccgaattctaatgcttcttttctggtcttcattttaactcctatgaatatcttttccttcttaggtgtattgacttcattatgaactcttttagcagaaacgtcaattttcgtattagctaattataaatatttagttgactatagcaaccatttaaattataatagttgccaaaatcaactaaatggagacgcgttatgaatgaagctattgaaaaaatcagagagttcaatcgcatttacctgccttccatgaatctgctgggcgaccattacctcggttcagaatactcagccacggaggcccgggtatttttcgagatttatcagaacgaaggatgcaacgctgctcacatcgttcagaaggtatatgtcgacaaaggctatctgagccgcattataaataagcatgagaggcttggacacatcaaaagaaagcattccactgatgacagccgttcttacaatatttttctaacagacgaaggcaggtctctcgccgaagatttaatccgcaaatcaaatgaggatattggaaaaataatcagcggattatctgtcgatgaaaaaaacaggcttgtcgacgccatggatactgtactgaaactaatagaaaaaggaagtaaatcagaatgaaaatagtaccttacgattcaaaatacaaaaaagatttcatcgagatgaataaagcctggattaaagaaatgtttgccctggaaccgcaggacgagcgggaacttgaaaatatagagaattatatcgaaaagggcggacagattttctttgccttagatgatgatgagcacgtaatggcctgctgcatgagcgcgcagatatagcttttgaaatgaaactataataaaaaatcaacgccatagtcaagaaactgtctgcttaatggatgaattcttttattttttgaatcgcaacagccaattaaagcgtaggtctcatgtccatgaatcttcccatatgcattacttccaattgtgtatgataattataaagagaatgatagtaatgttcaaacaatgttaagcaatgtcgagcaatgttgttgcaatgtcgagcaatgtttgatatcatatagataatgatttttttgacaaagacaaaactatttgaaactttgtataaggacattgcaaatgaaaataaatgaattatttaaggatgtaatagtagaaaatactgaatgtgaatttaaagccactttaaatccggataatcctataaaatgggcaaagactcttgtagcatttgccaatggaaacggaggaattttgtttgtcggtgtttcagatagcagggaagcgtttggactttcgttggatgagattgataaaataaaaaatctgattgccagagtaaatgacagacatatttttccgcacataaagctgcaatacagtatgagaagtgtagatgaagcggctgaacgatttgtactggccattaatatcaagcctgcagagtctgtcgtcagatatcgtgaaggagattttaacgagacagtatatataaaaggagacgggaatactactccagctagtccagaagacataatatctctttcaagaagaaaaagtggagtcgataacgaaactacagatatcaagtattacgaagaaaattggagtgactatataaatctgtgcaaagagtaccggaatgatgagctgcctccgactttaaaagaattacaaaacgaagagattgtttccaaagatggttatgttaaatcgggattcctgatgtttgcagatgactacaatggagatgattcgttaatttgctgcagattgtggaaaggtctgaataaggcaggtgttgttctcgaccatatgcggtataaaggccctctatcttctgtattttcagaggcttttaaattcatcgaacgaaatacaaaaatcggatggcaaaagacaaaaaatggaggaagaaaagaaataagatcctatcctaaagaggctgtccgtgaagcgcttgtaaatgcgattgcacatagagattattctatttctggcacacagattgatgtagatatatatgataacagaattgatatcgtttcaccaggttcatggcttttgccaaaaagctatgaggaataccctattggcagcattccttcgattcgcaggaattcaataatcgctgcctgtcttgatgtagcaaaccttatggaacgtggtggaactggttttcaaaccatggctgactgttataaaaatgccagtgtagaaaaacagcctggtgtattgatatatcccggatttttggacttgagattatttgatcttttatatgatgaggataccgaaatagaaatggacgatatttcagagactgaaagagtactcgaattgttaaagagtggcccgaaatcagttaaggaacttcaggcatcctcatcatataatagcagaagcatcttcctaaaagaagtaataaatccgcttatcaaagcaggaaaaatatatcgtgatggtccagcaaaatccccatcatcgttaatgcatttaagtactaaggtgtctccagatatgtagtattaccgtgcattcctgaaagctgctgccgctggcacgctttcttctgcttattttcttataaaataagaatgaaatcattttttggaggatattaatgatacagtttacagaagattttttgattggaattcccgagattgaccgcgagcataaaaaactgtttgtgatgattgaacatatatacagtggaattctacttaaatgaaattcctgccgtatatttttcatatgtgagattgcatgctttaaaccatcagaagcggtgtttaaggtcatgctctccataaaaccgaaggagtcctttgagctgtttcgctctttgttcagactggtatcgtaaaagctatagtttataaagtctggaatgcagttgttttcgaagcagtaattgagaaggcccttcaatagggagttatctgagtcttcaggcagatagtatatgcatggcagaccgaagcagatatccttattgaaaaatttgacagtatcgtaagttttcttgtaaaaaaattcaaattctttgaagctttcaaatccaaaaagacgggacggagtatttggctgatgccagacactgaacttccacgtcaaaatctcatggattccgtaacgctttataagatgttccagaaaattatgaatcagatcacaccagacatttatatccttcggctcgctaaccagatgattcagcatatatctgtcggagcgcttcgccaggtcctttggcatatatgaaaactgcatcagaggtttgaggccgatacttatgaggaaatcaaagattctgtcagtgtaggcaaaattatatattggggtgtttttaggccccattttgaacacgtggagactgtctgaaaaaatcccgttgaaaaataaatattcaaatccaatgtcacgctgcatccgggttagaattctctgaatatctcctaatagaatatcgctggcctgacctatagagagaatgcgcttccagctgtgctgaagctcacgggtatttttatacgcagaaaaatcagctgatacagttagcggtggcaccgaagcttcatatgttttctctgaacgattcagatatttccgaagagatgacatatactcattgtaaactattggcgtagcaggagcggaagcctctgcatttttaagcttccttctgtaagcgctcggaagcattccatactcttttttgaatgccgatgtaaaagcgttgctgtttgggaaaccggaatcaacggcaatggcttctatcgttttgtctgtgttcgtcaaatccgatacagcagcttttattcttagttctgtcaggtaggaaaggaaattaactccaaattgcttctgaaaatgaagcagcaaagtacagtggtgttacctacccaatgaagaatttcagtgatctgctggatatatgtgagatcaaataatcaggcaggaggattgcaatgggaagcagatactatctggcaattgatattggagcttcaagtggccgacatatactgtcgcatctggaaaatggcaggatgattttggaagaggtgtatcgttttcagaatggaatgatagaaaaaaacggccacaaagtctgggatatcgaccgtctttttacagaggtcaaaaacggaataaaaaatgcaaagctttaggcaggattccgtacagcattggaatcgatacctgggctgttgattttgtcctgctgggacaaaatggacaacgtcttactgatgcagttgcatacagggatgaacgcaccagtggtatggataaaaaagtatatgaaatagtttctgagagacagctttacgaaaggaccggaatccaaaagcagatatttaattagtggatggcggtatagtcactacaaaggaattatcgatggaggcaggggataagttcagggcagcagatgtagatcttgttatcatgcagcttttaacctatgctacaagctacaacatgcttccagcagtcagggatctgaatgtgccggagtagtaccatggatggttccaggtggaaaagaaatcgcagtagcaacaagtgaaatgatgaaaaagtatgacctcgcaatctgggcacatcatggaatgtttgcagttggatttgattttgacacaacctttggacttatgcacactgccgaaaagtctgctgaaattctggtaaagactctttcaatgcagcatgataagactcagacgataactcctgagcagttccgcagccttgccagggattttggagtaaaactcccggaaaaattcctttacgaaaaataaaagctatccccctgtaaaaatccttgattttatgttaagatatttctgccgctgtccgatataatgattggacagtttatatagaaatggaattctatcagaacggcggccagcttcggatacggatgtccggagacgactgggaaagacgatatacgaatggtaaaaggattatataccggctggaatggtatgctcgaagagcagcgcagaatggatgtcatgaccaataacctcgcgaattcaaataccgtgggctataagaaggaaggcacgacgaatgctgcgttcgccagacagctggcactccgcatcagagactcgggagactttaatttcgcgagaggcctgggagatatccagcagggagataagatcggtgagacttataccgactggagccagggcagtttcaaggttaccgatgagaagagcaacctggctatcggaggcgatggactttttgcgatagcctacactgacaagcagggaaacacttctgtcaagtacactagagacggagaatttacagtagacaatcagggatatttcagaaccgggaacggcgattatcttctcgatatgaatggcgccacctccggacagatcagcgaggccaactatgtcagagtcgatccgctgcagacttacactgtagatgaactcggaaatatctggcagaacaacacgattgtggacaatgtcggcgtagtcgatgtgaataacacagactacctgtcgaagtatggagagaatctgtacaatcttgagaatggcggcacggtaagacgtgggcagaacttcaggatcgagcagggagctttagagacttcgaatgtaaatgtcgtggatgagatggttcagatgataaccatccagagagcgtatgaggctggccagaaggttgtccaggcagaggatgagactatggatcaggctgccggacaggttggcaaaattggcggctgataagctgacaggaggtaattagtatatgatgcgttcactgtggacagcagctactggtatgaagagtcagcagaccgctgtagatacgattgcaaataaccttgcgaatgtaaatactgtaggatttaaacagaagaataccgaattcaagtcacttttgtatcagaatatccagacgaggactacatctgcgaatggccagaccaagccgacgcaggcacaggtggggcttggtacaagagtagcggctacgaacacgagctttgcgactggaatccagcagtctagtgacaacccggcagcatgctttattgccgggaacggatttttctcagttgaaggtgtggatggaaacacatattacaccagagacggtgactttaactggactatagacaacgacggaaggagaatccttacaaacaatcagggactaaggatcctggacagccgtggcagaaggatcacccttccagacggtgtcagtgtagacaaggtttctatagatacggatggaaatatcggatatattgatgcaaatggggcctggcacttgaccggacagaggatcggacttttccaattttcaaatatggatggccttgatgaagcgggtggaaacctctacagggctacagcagccagcggggccgccattaatgaagccacaacgaaccttaatatcgtaaaaagccagataaagcagggctatattgaaggatcgaatgtcagtatggcagatcagatggtcgacctgatcatagcacagagagcctatgagatgaactcgaaggctatcactacatctgacagcatgcttgagaccgctaataacctcaggaggtaataattgagcagtattggcacagattttacatcgtcatatctgaacagtatttcaagccaggctgcgaatatgagaaattcgcagcaggcctctgatgtcgagaacgcggcagcaggcctctcgaagaattcttctaaagaggacctgacgaaggcggcgaagacatttgaagcctattttgtcgagcagatcatcaaggaagtaaagaagtccaacgatgagctgaagggtgatgacgattctgacacctatgcaaagcaggttcaggatatgtacatggattctaccatccagacgctttcatccgatattgtcgacaaatatggtgacagatttaccgaggatatggtaaagaatatgcaggcacagtacggagtcacagatacttcagatacagagaaatcatgacgacgatagagggatatgtagaccacattatttttagaaatgagacaaacgcttacacagtgctggtcctaaagccggatgaaccggtggaggacgagggccttgaagacccggatgaggtcacctgtgtaggcgtttttttgtcagtgacagcgggcgagaaccttcgggtgtcgggtacttttacgatgcacgagagctttggcatgcagcttaaggtaagctcatacgaggagataaagccgaaggacacccaggcactctacagatatctgagctccggtgctgtcaagggcattggcgagggactcgcgaagcggatcatagataaattcggcgacaagaccttcgagatcatggagatcgagccggagaggctggctgaggtcaggggtatcagcgcacgaaaggcgattgcgatagctgaggatttgagaaaaaagcatgaccagcgcaaggtgatgcttgaactctcgaagctgaatatcactaccgggatgtcattaaagatctacaacaaatatggtcaggcggctatggatgtcatcaaaaaaaatccctacaggctcgctgaagagattgacggcattggctttaagacggctgacgatattgctatggcactggggtttgccagaaacagtgaagacaggatcaggagcggagttctctacgttcttggcatggcaggcgcagacggcaacacctatatgagacgcgaagaacttgtgcaggagtctgagagacttcttgctgtagatcctgatatggtcgaaagtgttatttttgacctgaccatgaacagaaaaataaagacggtcggggatgcagtctacctttttccatattacaggatggaagagcggacagcggctatgatgctgactcttaccggacggtttcaggcagatgagagccgtatcttgaaaaaaattgaaaaaattgaaaaggatgagggtatgacgctggatgaaaaccagcgaaaagctgctgtgcaggcagcggagaacggtgtgcttatccttacaggaggtcctggaaccggtaaaaccaccacgataaagacaattatcagctattttgaatccgaaggcatggaagtgcggctcgcggcgcctaccggcagagctgcaaagaggatgacgcaggcagtcgggcaggaagcacagactattcacagactgctcgaagtccagaaaggcggaacgaccgatgacagcgcaccgggctcgaatcccggtatttttgacaggaacgaggacaatccgatagagggcgatgtcgtgataatcgacgagatgtcgatggtcgatataacgcttatgtactcgctgcttcgggcaatcccagccggcacaaggctcgtactcgttggagatgtcgaccagctgccatcggtcggcccaggcaatgtgttaaaggaccttataaattccggcgcatttccggtagtaacgcttactaatattttccggcaggccgagaccagcgatattgtattaaatgctcaccatattaaaaatggcgagcttgtaaggctcgacaacaagagcagggatttcttttttctgaaaaggtacgacgctgacagcattataagcaccatcctctcacttttaaagactaatctgccggcctatgtcggagctgaagttttggatattcaggtgctttctccgatgagaaaggggcaggctggtgtcgagaggctgaacagggtgcttcagcagcagctgaacccgccttcgggagacagagaagagaaaaaattcggcgatgtgatctttcgggaaggcgacaaggtcatgcagaccaggaatgactatgatactacctggaggcgatacggcaggaatcacatcctgcttgaagagggaaccggtattttcaacggtgactgcggaatcatcagagaagtaaatgaattctcttcggatatgcttatagagttcgatgacggacattttgtcgagtatccgttctcaagtcttgagaatttaagcctcgcctatgcaatgactatccataaatcccagggcagcgagtatccggcagtgatagtgccgcttatcgccggaccggatgtcttgtacaatagaaaccttctctacacagctgttacccgcgcaaagaaatgcgtgatattagttggcgatgagaacgttttttacaggatggaaaaaaacgacaggcagaggctaaggctttcgggacttgtggacagaatccgcgaacagagggagagtggagcgtatgaaagtatttaaagaaactttaaaaagagaagcgaggaggcttttatttcctccgagatgcccgtcttgcgatgagctgctggcacctgatgagcagagcttctgcaaaaggtgcgaacctttgataaaaaaagtgcgcggaaatttctgtatggtctgtggcagactgttaaagagcgcggatgctctggtctgcccggactgcggtaaatttccgcatattttttctgagggcaggccactctatgagtacgagggacctgtaagggaggcagtctacagattcaagtacggcgggagaaaatcgtatgcagatgcttttgcgtatgatgcgatgaaactctggggtgagtggatcaaggcgtcggctgacctgatcgtcccggtcccgatgaatgcagacaagctgaaaaaacggggctatgatcaggcggatgttctggcaaaagcggtttcgtaccagagcgggatcgagtattcgcatgccctctatcgaatgaagaacaccgtaccgatgaaaactcttacgaggagcgagaggcagaataatctcaaaaacgcttttcaagtaaggaattttgatgtaaaattgagaagaatacttttagtcgacgacatatatacgacaggttccactttagacgcctgcgctttggcacttctcgatcagggtgcggcagaagtctgtgggatctatattagtataggagggtaagtagaaaggcagggtgagtttccatggaattgagaaactgcattaaatgtgggaaaatattcggatacagaggagttggtcctgctatctgcgataattgcaagaaggaagcagaagagcgatttgacaaggtcaaggaatacatccgggacaacccgctgacatcgataaatgaagttgcagaggagtgccatgtcacagtagcacagatcaagcagtgggtcagagaagagagacttatgttctcgaaggaatcaggggtggtattccattgcgagaattgcggcgctcctataaggacaggaagattttgtgagaagtgcaagagtgagatggtaaatgatctcgacggcatgtatcagaagcctcaggcacctgcagcgcctccgaagagacagagagagacagaccgcatgaggtttgctggcaggaagtgatttatgattgatacagaacgtgtcaagaagatgacgcagatggctcttcgcgagaagcgctcgggaataaagcttgattcagttgacgacatcgacaagaaggacttcctgtccttctatggggtaagatctttttttcagtcgacgatcatctactgtgtcctttttatcctgatcatcgttttgatattttctacggtcacagtacaggtgaaccgactgaacattgcaatcactgtctttgccggtatcatgggttatcttttctttatgctgttttactcgggctattcgaggagacagaacataaggcgctttgctgaataccagcagatagcagatgatcagaggaatgatctgaagattctggaggagatgtacgagaaagaggagagggaaagtcacggacagcaggagaagacagacagggacgaacagaatgaagatagacctggcgacgaggagccaaatcaataacttcatatctacccatgagaatttattcagacgtgcagcgggtggagtatggacttttttcggagtttttatcatttcacgtgactttgggttttcgacactgctctcttcacctgttatcacaattatacttacagcagccggagtctttgtcccgttttccggcatagctttgatgctggttatttacacagtgcttcagattttgaacctatcgcagtctgtcggtgtagttctgcttctgatgtatctgtttttttatgcattcacctattcatacaaggcgaagaatatgaacctgctcccgggtatcactgtgttgtacaggatttcaataccgtactgcgcacctatggtggcaggactttttggagattatcacgaggttacgtcgatcataggcggcagtgctatcgcatactatatgaagagtgtacacgatgcagttccgacgctctcagagtcgggcaatgctaccggaggactcgatatcctctcgtctatgatcggaaacagtggattttatttttttatggccgcaatggtcataatgtttctgatggtcactacgatcagaaatatccgctctccgcattcatggatatttgcagtcatactcggggtactttctgaggcactgatcatggctggaggagagatatttttcggacaggggccgggagcggcgagccttttctttggaaatgttgtagcggcagtagtgggatttctgtccgcagcttttctgcagaatctcgactatacgagggttgagagggttcagtttgaagacgatgaatattactattatgtgacggctgtgccgaagatccatatttcaaaggaagataaagagataaagaggatcactccggatatggccgatgataaaaatgatgagaaggaggtgaaagcgtgactggatttctggataatttaaatgcattcctgtatgataatttttctgttaccattccttcagtgcatgtgatcgatgttatagagatcctgatcatagccttctttatctatgagatacttctctggctgaaaaacagccgcgcttacatgctccttcgtggaatacttgttattgtcgtatttttcgtgatagcaggtctgttacagatgaacacgatcctctggctcggtgagagactgttgagcgtcggtattacagcacttatcgtcgtgttccagccggagcttcgctcagcgctggagcagctcggacggaggaatctgtttcaggtgctcgtcaagggattccagaagaatgctgaagagagattcagcgaccatacactaagcgacctcgtaaaggcatgctttgatatgggatcagtgcggacaggtgctcttatcgtcattgaaatggagacggggcttcaggagtatgagcgtacaggtatatctatagatgctatactttccaggcagcttctgataaatattttcgagaaaaatacccctctgcacgacggtgcagtcctcgtcaaaggagacagagtcgtctcggcgacctgctatctgccgctttcagacaatatggagatatcaaaggaccttggaacaagacacagggcggctcttggaatctcagaggtgtcggatgccctgactattgtggtctcagaggagaccggacaggtctctgtgacaaagggaggcaggctgtaccacgatattacagcagatgagctgactaagtttctggaggatattcagaataagaatataaaaaatgacagaaagaaggaaggaggatctgcagatgagcaaaaggcttaaagacttcctgacaaagaactggggatggaaaatccttgcagtgattctgtcgatcatcctctgggttgtaatagtcagtgtaaacgatcccgtcgagaaacgtgatttcaccgccaaggtttcacttgagaataaagactcgataagccagcagggtaaatatgtttcggtggctgattcggcgctttctgtgacttttcgcgtcagtgcccacaggggcgttatggacaggctcagaaacactgatttcattgccacggctgatcttaattatgtcgataagaatggcaaagtcccgatacagataagctgctctacatactcgcagaatcaggtgaaaattatcggagctacacactatctgcaggtcgaggtcggcgagaagcagtcgaagaaatttatgataagacctgcgaccaaaggaaatccggcagacggttttgcagtcaagtctgcatcggtcactccgaatgtagtgactgtagaggggccggccagcattgtgaaaaagatcgaccatgtcagcgctgtagctgatattgacgatgtatcagagaacgttacagagaaggtagtaccggtattctacgattcgaataacgaagagataaatacgacgagacttacgctttcgacttctactgtaaatgtatcggttgtaatggagtcgctcaagacggtcccgatagaggtgactgaaccgaagagcagtgagcttccggacggtgtctcgataagcagtattaccacagatccgagccagatttcccttgtgggagatgcgaagaatctgaacagcatcacgaggatttcaatcccgttctctgtgatagacctgaatacaaagaagtcatcgttcagtactgaagttgatatcacgagttaccttccgaaaaatgtgagcctgagtgaagattccaagtctaaaattactgtgactgtgaatctggagagtcagacgagtaagactatttcagtttcaactgataatctgacagtgaataatctgccggacggatatcaggcggcattcgctgaaaagacagtaagcgtggaacttaccgggcttgagagcaagctgtcatcaatagatgccgataagctgactggctctgttgatgcgagcggtctatcggaaggggatcaccaggtgtctgttaagctgtcgctgcctgatggcatcaaggcacagaatgctacgactaagatcaccattaagaagaagacgactgaaaacaccgacagtggaagtacaacggatagtggaagcacgaacagcggaagtaccgatagcaatagcacaaccagtacggatgataataacaccagcaacaatggaggaacacagtaatatatggtaagtcagaagcttacgataacaaatccgacggggcttcacctccgacccgctggagcgctctgccaggaggcaatgaaatataaatcaaagattactttcaaatacggcccgaatgatatgggcgaagctaatgccaaaagtatactctcggtcctaggagcctgcatcaggcgtggcgacgagattacgcttatctgcgatggcgaggacgaggtggaagccatgcaccgcctggtgaaggttatagtagatggttttggtgattaatctgttgatttgcatttgaggaaatcaaggaaagaaggaaaaagacaaaatgatgaattacaaacactatgtaaagaacccggtattaaatttcccggagaggacatggccggacaaggagataacgaagcatccgatctggtgctcagtagacttaagagacggtaaccaggcacttgtggagccgatgaatgtcgatgagaagatggagatgttcgatctccttttaaagctcggcttcaaggagattgagataggctttccggcagcatctcagattgaatacgattttctgagaaaacttgtcgaagagcacagaataccggacgatgtaaaggtacaggttctctgccagtgcagacagaatcttatcgaccgtacatttgaagcgatacagggcattccaaacgttatttttcatatttacaactccacttcgacgctgcagcgtgacgttgttttccatatggacaaggaaggcattaagcagctcgctatcgatggtacaaatatggtaaaagccggcatttcgaagtataagggaaatctccagctcgagtattcaccggagagttttacaggcacagaagcagattatgcggctgaagtctgtaacgcagtagcagcaacctgggatcatgcgacagacaatccgatcattttcaatctccctgcaacagtcgagatgaatacgccgaatgtatatgcagatcagattgagtatatgaacaatcacctggacgagagggagaacgtcatcctttcactccacccgcacaatgaccgcggtacaggtatcgcctgcgcagagcttggacttctcgccggggcagaccgtatagaaggaactcttcttggaaatggcgagagaacgggaaatgtagatattttaaatatagcgtacaatatgttctcgcagggcatcgatccgggtctggatctttctgatattaaggagattgtagaagtttgcgagagatgcacaaagatgaccgttgacccaagacatccgtatgccgggagccttgtattcacagcgttctcaggatcacatcaggacgctatcaataagggcacgcaggctatgaaggagagaggatcagaaatctggcaggtaccgtatcttccgatcgatccttcagatatcggcagagagtacgagccggttgtccgtatcaacagccagtcaggacgaggcggtgtggcttttgtaatggacaaggtctatggcttcaagatcccgaagatcatgcagcgtgaatttgccgacgtaattcaggccatcagtgagaaagagggcggcgaagtcaagccggagcgtatcatgaaggagttcaagagggagtacatcgataagaagtctccgttcaagctcgactttgttgacatcgacgataataccgatgatgaggatacacacatttcactcgatttcaagtacaatggcgaggcattccattcggaggccgacggaaacggacctgtcgatgcagtaaagacggccatcagacagtgcgttccgcaggttgattttacagtcgaagattattcggagcactctctcggagttggatctggtgcaaaggctgcggcctacattgagctgtccgatccgcgtacgaagaacatcgccttcggtgtaggactttcctcgaacatcacaagagcttccataagagggatcttctcggcactgaacagaatgaccgaaaagcagaaagatctttaaataaaaaaatattgagaaaagcaatgagaaaaatagtagtgaccgggccgaatggccagcttggaaaagcggtattaaaagagtacaaaaacgacgcagatgcagagctgatttcaatttcccatcgggaaatgccaatcgaggatctcgatgctgttttaaataagaccgcagagcttgatccggatgttatcattaactgtgcggggtatacggacgtggacggatgtgaaaaaaacacacatctggctggaagaatcaacggtatcggaccgagaaacctcgcgatagcagcgcagaagaccggggcaaaacttgtacatatttctacggactatgtatttgacggctgcggtgacaggccatatgtggagtccgatgctccgggaccggtcagtgcctatggccgttcgaagcttgtcggagagaaatatgtggaatccctgtgtcagaagtactttatcataagaactgcctggctatatggtgacggggaaaattttgtccgctcgatgcttcgcctgtcggaaagccacgatcaggtgtccgtcgtagacgatcagatcggatgccctacgagcgctgcagaggttgcaaagctgatccactatcttgaacagactgagcagtacggcctctatcacggtgtctgccgtggtgagaccagctgggctgattttgcagaacggatattcagcatcaaaggcatcaaggcaaaagtaaatcacatttcgtctgaagagtatgtgaagatgaatccagacagcgcaaacaggccgcattactcagtgcttgaagatcagatgctctcactcattgctcccgaggacggcggctttcagatggcgacctggcaggaagcaataaaaaattacttaaaaaaatgaaaccaactataagtgttattatcccggcttacaatatagccgggctgctgcccggaatggtgaaagacattctcgggcagccgtttaaatattttgaaataatcattgtcctcaggaaggacgacccggatactgcggcagcagcggatgagcttgcgaagctcgatgacaggatccgtgtgatctacagacaatctcctggagtctctgcggcgagaaatgccggaatagaggctgcaaggggagaatacctggtgtttcctgacggagatgacagagtagagagaggttatatcgggacactctttgcttctatagcagattcgaaaaaacagaaactcgtaaaggatttcaagaggatccctgtacagcttggcatagtgggatacgatattgtggatcaggatcaggttgtagatgagacacaggaagcagtagtcagggttatgaacaaggaggattttctctgcagactgttttttcaggagaactatcagggctatatctggaataaaattttcaaaaagagtataatcgataagttcaatctgcgttttgacgaaaaagtttactatcgcgaggatcagctttttatctgcaggtatgtgctgcactgtaaagccataagatacaatccggcgcatatgtaccactatgtacagcgtcccgattcggcaactgcactgctcgaaccggagaatggagtcctcgatttaagggtattagagaggcagatgacagagtgcagggctttttcgaagatgaggaaactcttgaaaagacatgaggatcccaagtggtatttagagcaggagtatgtattttacgctctggagattttttacaggatgagattcgtgaaggaccgttcgcactttaagaacagctacttcaggaagatagccaaagaagtgacagatatagagtactgtccagtcgacgattgggaaaaagaacagcttgattcgatgagagaatacgcaaatacaggattggttaaggagaacagaaatgaaggttaatgacctcgtagtagggagcggattatttggcgcagtttatgccagagaggcaatggacgcgggcagaagcgtcgctgtcattgagaagagaaatcatataggtggaaatgtctataccaaaaagatttcaggaatcgatgtgcacatctatggagcccatatttttcatacttcggataaggaagtctgggaatatgtgaacaggtttgctgagttcaacaactatatcaactccccgattgccatctatggtgacgagctctacaatctcccgttcaatatgaatacattttcaaagatgtggggaataaagacacctgcagaggctaaggcgaagattgctgagcagataaagcagctgaatatcacaaatccaaagaacttagaggagcaggcgctttctctggtaggaagtgatgtgtacgagaagctcataaaaggttatacccagaagcagtggggaagaccatgcacagagctcccttcatttatcataaagaggattccgcttcgttttacttatgacaacaactatttcacagaccgctatcagggaattcctgtcgacggctacacagctatcgtagaaaagcttttaaagggtgctgacgtattcctgaacgaagattttaaagacttcaagaagaaacacactttaagcgacggtacagagatcgagtacgacagactgatctatactggtcaggttgacgaatattttgattatacctatggcccgctctcatggagaagcgtccgctttgagactgaggagctcgacactgataactatcagggaaatgcagtagtaaactacacctctgcagatgtaccttatacccgtatcattgagcacaagcacttcaatttcggaaagcagccgacgactatcatctcacgggagtactcacacgagtggaaaccgggagaggaaccttactatcctgtaaatgatgaacagaacacggctctctatgagagatatgcatcactagctgaagatgaaaagaagaaaaatgtctacttcggcggaagactcggacagtacaaatactacaacatggatcaggtaatcgcggaggctctgaagctctctgaagaattgctgtgaggacaatgaatgaagaaacctgcagattggctggattcggtattcaattatttttttacaaggcatcctaaaagccgtaaggtggagccgctttaccgaaaatacaaagagcttatgctctacggtatgtttggattcggaaccttcattatatctctattcacgtactggctctttacagaaccactgcattggaatatactattgggaaatgcgctgtcgtgggtatttgcgactgcttttgcattttttacgaacaggaggtatgtattttacaatcatacttcaggagtgttcgcgtttttctatcaactggggacgttctgcgttggcaggcttattaccctggcgatagaggaatttatgctcggcattcttattggagttttaggtctgccgaacatgctgataaagtttatcgcgcagtttgtcgtgataactttgaattatgttttttctaagatttttgtgttcaaaaaggaatagtaaatgtcggaaaaattagaaaatggcaaacacctttaccgttttctcacgaatctgatcattacggtagcggttgcacttctatttgcatatgggtggaatcattggctgaatatcctgcttgacaggcctttccggcatcttggctgtctggcgatgatacttatctatacgtttctggctgtatttttcatatacagttttggaggctatgagataggtatcagcaggatttcccacgcgtcgataggctgtactctggcttcatttatagtgaatattatcatggcggtgatgacagtaatgatggttggctacagaaaacttgtaccgactatcattttcgtgtactttgagctgtgtattattgaagtgatagtactgttcattatcacctatctgggaacgtggctgttcaggaaaatcttcccgccgtacaggatgctgcagatccacggcatgcatgtaaacaacctggaccgcaagatggaacagcgcagtgataagtttgtaatagcagagactgttatggtaaatgctccgctgagtgaaatcgagaagaaaattgatgagtacgatacagtccttataaacgatatcccgtccgaattaaaaaacaagatactaaagtattgctttgaccgccagaaaagagtatattttacaccgaagatttcagatatcatagttcgagagtcggatgaactgaatcttttcgattctccgctctatctgtcgagaaacgtcggattttcgatgtggcagaggatcgtaaagcgcgcgggagacattattttatctctcataggcatcatattgacatccccgataatgctggtgaccgcgatacttattcattcttatgataagggacctgttttttacaggcaggaacgctacacgatccacaagaaaaagttcaaggtaatcaaattcagaagcatgatagtggatgccgagaaattttccggcgcgcgcctcgcctctgagcacgacgacaggataacgccgataggacattttatccgctctacgagaattgacgagataccgcagtttttcaatgtgctaaaaggcgacatgtcgtttgtcggaccgaggccggagagacctgaaatccacgaagagtactgcgaaaaagttcccgaatttgacttccgacttgctgtaaaggctggtcttacaggctatgcacaggtctttggcaaatacaatacgacaacatacgataaactcaaattcgatatgatttatgttcagaaggcttcaatacttctggatatgaagttgatacttctgactctcagagtcgtttttcaaaaggaaagcactgaaggcgtcgaagaaggagaaaagacagcaaaatgaaaaaatacatcaaaggattttacgattaccgctttctgctcagtgagctcgtaaaacggggaatcaggctgaagtacagaagaagttaccttggaatcgtctggtcgcttatcgaaccgctgatgaccacagccgtactggtagttgtattcggagctttgttcgacagggcaaacgatccgacattcgctacctacatcatggcaggccgtctggtctatacatttttccagaacggaacaaagggagcgagcaaggcaatacgtggaaatgccggcatgataaaaaagatttatgtgccaaaatacctgtatcctctgtcgaatgtactgttcaactttatcatctttttgatatcgcttatagtactcgttccggtacttattatttcacgccttacaccgtcgcttcgtctctggaagctgatccctggaatcatcctgcttcttatactgacgatcggcgtcggcatgatactttcggttcttgacgtatttttccgtgatattgagtatctctggaacgtgctgttgatgatcattatgtacttatcggctattttctacccgatagagagaattaagaagcaccatctgatgtggcttcttcatctgaatccactctactgtatcatcaatctgttccgaggcggacttatgaaatatggcaatccgctctgggagtacgcttacccgtttgtatttggagtgatctgctttatcgtaggatttattgctatgaagaagaagcaggacgagtttattttacatttgtaattcgaggaaaaaatatgaagccatctgtagaagtctcacatctcggcatgatgttcaatctaagcaaagagatgcacgatacacttaaggattatttcataaatcttttcaagcaccacgagaagatgaaaaaagacgagttctgggccctgtcggatgtaagctttaagctctatccgggtgaccgtctcggcattctcggactcaatggtgcaggaaaatctactatacttaaagctatcgcaggtgtttatcatcctacgacaggaagcatacacaagagaggaaagcttgcccctctgcttgagctcggcgctggttttgagccacagtactccgccagagagaatatttacctttacggttccatacttggttattcgaaggaattcatcgaatcaaagtttgacgagatcattgaatttgcagagcttcagaaattcgtagaagttccggttaagaactattcatcaggtatgaagagccgtctcggcttcgcaatctgcacagccgtaaaccctgatatactgatcctcgatgaggttctctcggttggcgataaaaaattccgccgtaaatcagaggacaagattatgagcatgctgaatggtgaagttacagtgctcttcgtgtcccattcacttgaacaggttcgtcgtatctgcaacaaggctatgatcctcgaccatggcaaattaaagtgctttggagatatcaatgagatcgctcctatttatgctgagatgactcaggaagatcctgaagagatcaaaaagcgtgaagccaaggcaaaggcaaaccgtgagaagaaactccgcgaagccagaaagaccaaggctcacgatatcatcaacatgacaaacaatcttgatatttcggttgaagatgctatggctgccatcgatattccggaggataagtacaagacttactataaagtaatcgatgagatcgagaaagaagagggaattcttacaaagcaggacgcattgaaagctgctgctgcagaagaggcggaattcgaccgtgcggctacgttccctaatgacgaagaccgtgcagaatctgatgacgatgatttcgattcataagtcgatagattcgagattagaacatcattgataattatcttgacactcgtgttttcacgcgctataataactaggcgtgcgtaaaaacgcgagtgtttttttgcgcgtagaaacgtacagtattattttacaggaggtgaaataaatgccaacatttaaccagttagtgagaaaaggcagacagacatctgagaagaaatcaaactcacctgcactgcagagaggcttcaattcattaaagaagcgccctacagagacagcttcaccgcagaagcgtggtgtttgcacagctgttaagactgccactcctaagaagcctaactcagcgcttcgtaagatcgccagagttcgtctttcaaacggaatcgaagttacttcttacatcccgggcgagggacacaaccttcaggagcactctgttgtattagttcgtggcggacgtgtaaaggaccttccaggtaccagataccatgtcatccgtggaacacttgatactgccggtgttgctgacagaaagcaggctcgttcaaagtacggcgctaagaagccaaagaattgatttctttgatacgtatttttgtaacgagtaaacacatcggaagtatttcatttatgaagtaatggtttgttggtgtttatttttacataacccagcacgcacacattttcataaactgtgagtacctacgatctaatcgaatcccatgattaaggagggaagcagacgtgccacgtaaaggacattttgaaaaaagagatgtgcttgcagatcctatctacaattcaaagatcgtaaccaagctcatcaacaacatcatgctcgacggtaagaagggcgttgcccagaagatcgtttacggagcatttgaaaaagtagcagataagactggaaaaccggctcttgaggttttcgaagaagctatgaacaatgtaatgcctgttctcgaagttaaggcaagacgtgtcggtggtgccacatatcaggtacctatcgaagttcgccctgacagacgtcagacattaggactcagatggctcacatttttctcaagaaaaagaagtgagaagaccatggtagaccgcctcgcaggcgagatcatggatgctgcaaacaatactggagcagcagtaaagcgtaaggaagagatgcacagaatggcagatgcaaacaaggcatttgcacattacagattctgaccgaaagcttcgagatgagagcaagcctctggcgccgctcgaatccgaagcgaggtcgctgtctgagattagtgagaacgagccgaaggcgaagttcgaacttaacgaagacagcttccttattaagctggcttgtatttttgaggagaaaaaatggctgaaagagaatacccactggagagaaccagaaatatcggtatcatggctcatatcgatgcaggaaagactacattgacagagcgtattctttactataccggtgttaactacaaaatcggtgagacctacgaaggaacttctaccatggactacatggagcaggagcaggaaagaggtatcaccatcacttctgccgcaacgacatgccattggacagaagaagatcacacaaagccaaagaagggtgcattagagcatcgtattaatatcatcgatactccgggacacgttgacttcacagttgaggttgagcgttcacttagagtacttgatggttcagtcggtgtattcgatgccaagggaggcgttgagcctcagtctgagaacgtttggcgtcaggctgataagtacaacgttcctcgtatggctttcgttaacaagatggatatccttggtgctgatttttacaatacagtatcagagatccacacaaagctcggaaagaaccctgtagttgttgagcttcctattggtaaagaggacaacttccagggaatcatcgatcttttcgagatggattcatacatctacaacgataagatgggcaaagatatcactgttggacctatccctgatgatatgaaggatcaggccgatgagtggcatacaaagctcgttgagggaatctgcgaatttgatgatgatcttatggagcagtacctcgatggaaaagagccatctgtcgatgatatgaagaaggcacttcgtcgtgcaactatcgccaatgatgcagttcctgtattctgcggttctgctcaccagaacaagggaatccagaagcttcttgacggtgttatcgaatatatgccttcaccagtagatgttcctgacatcactggaacagatcttgatggcaacgaagttacacgtaagtcatctgatgatgagccgttctcagctcttgcattcaagatcattacagacccgttcgtcggaaaactcgcattcatccgtgtatattcaggaacatgtaaggccggttcttacgtactgaactctacaaaggataagaaagagcgtgttggccgtctcttacagatgcatgctgataagagaaaagagatcgatgaggtcttctcaggtgatatcgctgcagcagtaggccttaagaacactggtacaggtgatacaatctgtgacgaacagcacccggttatccttgagtcgatggagttcccggacccggttatcgagctcgctatcgagccaaagacaaaggaaggtcagcagaagcttggcgaagcactcgcaaagcttgctgaggaggatcctacattcagggctcatacaaacgaagagactggtcagacaatcatcgctggtatgggtgagcttcaccttgagatcattgttgaccgtctccagagagagttcaacgttgacgcaaatgtaggtaagccacaggttgcatacaaagagacatttacaattcctgtagatcaggagtacaagtacgctaagcagtcaggtggtcgtggacagtacggacattgtaaagttaagttcgaaccactcgatgctaacgctgatgaaaaccttgtattcgagaatgccgttgtcggtggtgctattcctaaggaatatatcccggcagtaggcgatggtatcgctgaggctgagaaggctggtattcttgccggatatcctgttgtaggcgttaaggctacagtatatgatggttcatatcatgaagtcgattcttctgagatggctttccatatcgctggaagcatgtgcttcaaggaggccatgaagaaagctaaacctgttatccttgagcctatcatgaaggttgagatcacaatgcctgaggattacatgggtgatgttatcggagacgttaactcacgccgtggccgtgtcgagggtatggacgacgtaggtggaaacggaaagatggttaaggcttatgttccgcttgccgagatgttcggatactctactacacttcgttctatgactcagggacgtggtaactactctatgttctttgatcactatgatccggtaccaaagaacgttcaggataagatcataaacgataaaggctgacagctcgaaaagaactaaagcttgcaaagtttatggttagttgatataattaaacttaacatgtaaagcccctctttaaagaggggtgggtaaattttccacaggaggaaattaaaatggcaaaagagcattttgatcgttcaaagccacattgtaacatcggaacaattggccacgtagatcatggtaaaacaacacttaccgctgcaatcacaaaggttctctctgagagagtagagggaaacaaggctgaggccttcgatcagatcgataaggctccagaggagagagaaagaggaatcactatttctacagctcacgttgagtatcagacagctaatcgtcactatgctcacgttgactgcccgggacatgccgactacgttaagaacatgatcaccggtgctgcacagatggatggtgccatccttgttgttgctgctacagacggtgttatggctcagacaaaggagcatatcctccttgctcgtcaggtaggtgttccttacatcatcgtattccttaacaagtgcgatatgatcgatgacccagagcttcttgagctcgttgagatggaagttactgagcagctcgaagagtatggcttcgagggatgccctatcatcaagggttctgcttatcaggcacttcaggacgacaaggctcctgcaaagcttgctaacggagatcctcttgatccagataacccggataagaactggggagactgcatcatggagctcatggatacagttgattcatacatcccagatcctaagagagataacgagaagccattccttatgccagtcgaggatgtattcaccatcactggtcgtggaacagttgctacaggccgtgtagagcgtggtactatcaaggttaacgacccagtcgagatccttggtcttcgcgatgacgttgagacttctacagttacaggtcttgagatgttccgtaagactcttgacttcgctgaggctggtgataacatcggtgcccttcttcgtggtatcgatcgtgaccagatcgagcgtggacaggttgtagctgctccaggaacagttacctgccataagaaattcacagctcaggtatacgttctgacaaaggacgagggtggacgtcatacaccattcttcaacaactatcgtcctcagttctacttcagaacaactgatgtaactggtgtcatcactcttccagagggaacagagatgtgcatgcctggtgataacgttgagatgacaatcgagctcatccatcctatcgctatggaacagggtcttacattcgctatccgtgagggtggccgtacagtaggatcaggccgtgttgctacagtaatcgagtaattgactgtacgctgcagaagcattaagttaaaataacaaagaccccgtaggaaaatttattttcctacggggtctttttagtgggacagtagggacggttctttttgtcccattttttgaactttctgacaaatcaagccaacgctgtttctcgtttatagatgatcatacaaaaaaggcggccaccggtggatgaccgcatttgttctccaaaaggagataagtttgtaaaaatcgatgtgaagattttatgaaacattttatgctgccttgcttttaatggcggttttccttataatggaaaaaggcaatttctattattgacagaaatggtacaattaaaggcattagaaggcaggtgacatttttggatgataataatttttataatcagaataataatggcggtccaaacggcccgggcatgaatggaaatggtcaggggcctaacaataataatcagaacccaaggtttaatcctatactggcattcattctgttttcactggttgcactttttattgtgacaatgctttacagaggcgttgacagcagtgccaatcagacagtaagttacgataagttttacaagctggcagtaaataacgaactgaagtcagtcacttttgatggaagcaatatcaacttcaaggtaaaggacagttcgaagttctatgcgaacaccgaggataagaatcagcaggagctctacagacagagtacaggacagaagctcgaagtcaattactcgacaggctacattcaggatgatgaacttctacctattttaaagaaaaacaatgtaactataaggcgcaaggactcctcatctacatcagcacttatttataatattgtttcatttattgtaccactggttatcatctggatcattttcgcagttattgcgaagagaatgagcaacagcgtaggtggtctcggcggtgtaggaaagagcaatgccaaggtttacgtacagaagtcgacaggcgttacatttgacgacgttgcaggccaggatgaggcgaaggagtctctgcaggaggtcgttgatttcctgaaaaatcctggcaaatatacaaggattggcgcgaagctgccgaagggtgcccttctggtcggccctcctggaacaggtaagacactgcttgcgaaggcagttgcaggtgaggcgggagttccgttcttctcacttgcgggttcagatttcgtcgagatgttcgtcggagtcggcgccagccgtgtaagagacctttttaatgaggcaaagcgacaggctccgtgcatcatctttatcgatgagatcgacgccatcggtaaatcccgtgattcacagtttggcgggggaaatgatgagcgtgagcagacattaaaccagctgcttgctgagatggatggttttgactcttccaagggtcttctgatccttggagctacgaacagaccggaagtcctcgataaagcgcttctgcgaccgggacgtttcgacaggcgcatcattgtcgacagacctgatatgaagggacgtcttgacacgcttcgcgttcattcacgtgatgtgaagatggattcttcctgtgatcttgaagccatagcgcttgcttcggcaggacttgtaggatctgatcttgcgaatattataaacgaggcagctattctcgcagtagagaacggccgtgagtatgtttcacagccagatctgttcgaggcatttgagcgtgtggccgtcggaggcaaggagaagaaagaccgtccgatgagcgacaaggagagacatatcgtctcttaccacgaggtcggacacgctcttgtttcagcattacagaagaataccgacccggtacagaagataactattgttcctcgtactatgggtgcccttggttatacgctgcagacacctgaggaggagaagttcctccagtccaaggaagaactcgaagaggatatcacgacattcatgggtggccgtgcagcagaggagatcgtcttccactcaatcacaagtggagcagcaaacgacattgagaaggctactaatattgccagaaatatggtcacccgtttcggtatgagtgacaagttcggtatgatgggtcttgctacagtccagagccagtatctcgatggcggtgcgcagatgacctgcggccagcagacggctagtgaagtagatggagaagtcctctccattatcaataaagcatatgccaaggccaggcagctcctgacagataacagggaagcgctcgacaagatttcagagtatctgtacaagaaagagacgatcaccggaaaagagttcatgaacatgttccgtgagatcaccggtattcaggctgatccggaaaaagagatcgatgacgagaagactgagagagatcacgaagtggcaaggagactccagcgtgagatggattcctatgaggaatcaaaggctggaaagaaatcgcctgttgagacagatgcatctgacaagtcttcagacgaggccggattgtctggctcagaaaaatcatcaaatggagattctgaaggagctggcgacggatccaaacctgaagtgagcgataatgatgacatctttgacgaataaaaggtgcagacatgagttttgatatacaggaagagctgaagaagatacctgattctcccggtgtgtatatcatgcacgacaagagcgacgcgatcatctacatcggcaaggcgaagagcctgacgaagagggtacatcagtattttcagccatcgcatgacgagggcatcaaaaagaagcagatggtcgagcatatcgatcattttgagtacattgtcaccgattcagagcttgaggcactggtcctcgaaaataatcttataaaggagcatcgtccgaaatacaacacgatgctccgtgatgacaagacatatccatatataaaggtgaccctgggtgagcattttcccagggttgttttttcaagaaaagtatataaggacaaggccagatatttcggcccgtttacatctgcgggagacgtcagagagacgattgagcttacgaacaaactcttccatctgcgcacctgcaaccgtgtatttccgagagattttaaaagagagcggccctgcctgaactaccatataaagcagtgccctggcatctgccttggcaatatttccgaagaggaatatatgaagtcggtaaaatcggccatggaatttcttgagggaaaggctgatccggtcatcgatgcgctcactgaaaaaatgaacgaggcatcgaagaatctcgaatttgagaaggcagctacgtaccgcgatgaaatctctgcggtaaagatgtgcatccagaagcagaagattacggatacagagggcgaagacagggatatcctcgcgatcgctcttgataaggaagacgcctgtgcggtcgtattttttataagaggcggcagaatgataggccgcgatcactttttcctgaatctgcgtgaggatgacaggaaggaggatctgatcagcacatttatacagcagttttactcggggacgccatttgtgccgaaggagctcttcgttcagacagaactttcagaacagaagatgcttgaggactttctctcagagaaaaaaggcagtgctgttcatatagtgactccaaagcgtgggcagaaggagaggctcgtagagctggcctggaaaaatgcctcattgatcctgacgaaggacagagagaggataaagaaggaagagggccggacgatcggcgccatgaaggagctctccggaatcctcgggctgccggggatacagaggatggaagcttacgatatttcaaatacgatgggctaccagtccgtcggatcgatggtcgtatttgaccatggcaaaccgttaagaaacgactacaggaaattccgcattaagacagtagagggcccgaacgattacgcttctatgagagaagtgcttaccagaaggtttacacacggactcgaggaaaaggccgggggagagtctgaggaaacaggaagttttacgagatttccggatgtcattatgatggacggcggcagaggacaggtaaatatcgcacttgatgtcttaaaagagctgggtcttaccattccggtctgcgggatggtaaaagacgaccaccacaggacgagaggactgttttttaacaataaggagctgccaatcgacaagagctcagaggctttcaagctgataacaaggctgcaggacgaggcacaccggtttgcgatagagtatcacaggtctcttagaggcaggaatcaggtaaggagttttctcgacgatatcccgggaatcgggcctgcgcgcaggcgcgcactgatgaaaaaatacgtctcagccgaggctataaggaatgccagtgtagaggatctggcaaaaacagatacgatgaacgagaaggcggcccagcaggtttgggattacctgcacaagaccaagccttgacaaaaggaacgggcgcttttatcatatatcagaggagaaaaacttatggcattaaagcaggaaggtgcgagcatcaaggatattgccgagaagctcaagctgacaaattacacgaaaaatattgacctggcagattgcttcatcaaggtcagggatatcaacaggccggcccttcagctgacaggattttacgatcattttgattcgaacagaatccagcttattggtatggtcgagtatgcctatctgaatgggcagcacgatgagaatgagagacatgagatctataagaagctcttttcaaatcatatcccggctgttatagtctgccgcggccttgagccggagaagaatttccttgaagaggcagagaaagcaggcacaccggtgcttggtacatcgagagcgacttcgcagtttgaagccgctctgataaatgtcttaagctatgagctcgcaccgacgacgactatccacggagttttagtcgatgtctatggtgaaggacttctgatcacaggtgagagcggcattggaaagtccgaggcagcactcgagcttgtaagacgtggccacagacttgtcgcagacgacgttgtagagataagaagggtaaacgacactacacttataggtacatcgccagctattacgaagtatctgattgagttaaggggcatcggaatcatcgatgttaagagtctctatggagtagagtgtgtaaaggacacgcagaccatagatcttgtgatacagctcgaagactggcaccgcgacactgactatgacaggcttggactcgacgacgagtatatcgagatcctgggtcagaaggtggtctgccattcacttccgataagacctggccgtaatcttgcgatcatctgtgagactgcagcagtcaaccaccgccagaagaagatgggatacaatgcagcagcagagctgtacaaacgggttcaggagaacattgtcggcgcatcgaaagaaataaaataataatgagcggtgtgaaagcaccgctcttacaaatatattagaacaaggaggcattgatcttggataacaagaatgcatggttaaagtactacactaaagagaatgacagaaaaaaggtcatggatttcgcggaggactaccgcaggtttttaagcggtggaaagacagagagggaatgcacctcattttttgcaaaagaagcagagaaggcaggctttaagaacctcgacgatataatcgcagctgatggtaaggtagaggcaggagataaggtttaccgcacgaaccgcggcaaaaatatcgcgcttttcgttatcggtgaagagccgctctcaaagggcatgaacatcctcggagctcacatcgattccccgcgcatggatttaaagcaggtacctctctatgaagatacagagatggcgtttcttgatacacactactatggcggaatcaagaagtaccagtgggtcgcacttccactcgcacttcacggagtagttgcaaagaaggacggaacagtcgtaaatgtttgcgtcggtgaagatccggatgacccggttttaggagtaagcgatctccttatccaccttgcgcaggaccagatgaagaagacaggtgccaaggttatcgagggcgaggacttgaatgtcatgatcggaacgatccctctcgacgatgctacagacgacaaagataagaaggatgccgttaagagaaatattcttcatattttgaaggaaaaatacgatattgaggaggatgacttcctctcagccgagctcgtagttcttccggcaggaccagcccgcgactatggacttgacagaggctgcatcatgggatacggtcaggatgataaggtatgtgcatacccgtcatttcgggctattgtcgacgccaagccaggcaggagaacttatgcctgcctccttgtagacaaagaggagataggctctgtaggcgccacaggaatggagtccaggttctttgcaaatacggtagcagagctgcttcatgcagagggcgacgattcaccgctttctattatgagggctatgcagtattcgaaggcactttcatcggatgtatctgcggcgtttgatccgaattaccctgaggtgatggagaagaagaacagctgctattttggcaagggccttgttatcaacaaatacactggagccaggggaaagagcggttcaaatgatgccacagcagagtacatggctgagatcagaaagatctttgatgatgccgacgttgagttccagactgcagagcttggaaaagttgaccagggcggcggcggaactatcgcctacatccttggtaactgggatatgagcgttatcgactcaggcgtcgcagtgctcaatatgcatgcgccttgggagataacctcaaaggtagatatctacgaggcctacagaggctatatggcatttctgcttgcagagtgaggcttattatggagagagttttaaaagccctgagacagatagttggtacggatcaagcaatccgcgtcgatgaaccgatgagccgccacaccacttttggagtcggaggaccagcggatattttcatagatgcggcagcggatgagcttaaagatattttaaatctcctttctgaagaaaaatttcctttcactgttattggaaatggcagcaatctcctggtctcagacaaaggcatccgtggcgcggtgatctgcattggaaagcggatgagtggtatagaagtgcgggatggagatggcgtagcagacatttctgcagcctccggagcactccttccgattgttgccagaagagcgtgtgaaaacggccttaccggccttgagtttgccacccagataccgggtacgatcggcggcgcagtctatatgaatgccggagcatttggcggcgacatgagtgactctgtcgtaagtgtaactgcagtcgatatgaacggtactgaaaaaaaatacactgcagaccagattggattcgactaccgtaccagtattttttcaaagaataaagagataataacaggagcagtcctgcacctgagaagagacgatccggagcagataaaagcccgcgccgctgcaatccgcgagaagcgcgagaaatcccagcctgttggaaaacggagcgccggaagcacgttcagaaagctcggagacggagatacgcccgaggctatgacaccggcctggaagctcgtgcaggaggctggaatgggcgatgccagagttggcggggcctgtgtctcaccgaagcattcgggatttgtcataaatgatggtgaagcgacggcctcggatatctataatctgataagccagattatcgaacaggtgaaattaaaaactggagttacactcgagccggaagttaagataattggaacgttttagagagggtaaggcgcatggacctactgataattaccggaatgtctggtgcaggaaaacatacagcatttaaaatacttgaagacatagggtacaactgcgtcgataacctccctatacctcttttccgcagctttgcctctcttgcgtcaaattcaccgaacaacgacaaggttgccgtaggaatcgatgtgagaagccgtacacctatttcaaagcttgaaaatatcctcgatgagctcgaaggcgatggcaaaaaagtccagatacttttcctggatgctgatgacgacacacttgtgaagcgattcaaagaggagagaaggacgccgccgcttgccgatggtggacggactatagacgcgatccacagagaacgggacgagatggcctttttaaaaaaacgggccgattatatagtcgatacatcgcatcttcttgtcagggatctgcgcgctgaacttacaaaaattttcgaagagggcaccaactacaagaacctgaatatcacgatactctcatttggcttcaaatacggtattccgacagatgcggatctggtcttcgatgtcagatttctcccgaatccatactatgtcgacagtctaaggcacaagaccggaaacgaccaggagatcgtcgattatgtcatgaattcagacgtgtcgcataagtttatagacaaactcacggacctgatcacttttcttatacctgaatacataaaagagggaaagaacgagcttgtgatctgcattggatgtaccggcggcagacaccgctcggtcactgtagccagagagctttaccacgcactggcaaagcacgatggcgactacggactccgcattgaacacagagatatagacaaaggataatatgtctttttcatcagatgtaaaggatgagctttacgaagtttatcccaaagccaggcactgccagatcgcagaggcagcggctgtgacatctgtcatagcgaaggctggcactggcagatatgccgtcaggctggaaactgaaaataaaaaacttataaaaaagtactttactttattattgcaaacgattaatattaaaaaagatgtctccgatgagctggactctgtggacggcaggaaactacgggaacttttgaaaataaatggcgatgactttactgacacgaatcctgtgatcttagaacaggattgctgcaggaggtcatttttgcgggggatttttctttcgtctgggtctgtaagcgatccgaacaagtcctaccacttcgagatcgtctgccacacaatgcggcaggcagagctcgtgcagggacttatatcggattatgactgtgatcctcatatagtagagagaaaagggcacttcgtagtctatttgaaagagggctcgcagattataaatatgcttggcatcataggtgcaccgaaggctttcatggattttgaaaatatcaggatcttaaaagagatgcgtgaaaacgtcaaccggcaggtgaactgtgagacgtcaaacatccgcaagtctgtttcagcagcagtcagacaaattgaagacattcgctttcttcaggagagcggacattttgcggagctggggccggctctgcaggaggccgcaaaactgcggcttgagaacccggagatgccactttacgaactggggcagaaatgctcacctccggtgggaaagagcggcataaaccacaggctcagaaaaatcggacagttggcttatgatattaaacatcaggaggacaccacatgaaaaaaaatgtcaccatcaaaatgcgtgagacaatggaggcaactcctattgctcacttggtgcagctggctaatcagttccagagccaggtgtatattgagaaggacactaagaaggtaaacgcgaagagcatcatggggatgatgagcctcgtgcttacaagaggtactgaagtgacaatagatgctcagggcgacgacgaggagaaggcagtcttagccattgaggattttctcaccaaataagaccggggttatttttcatggggaaaaaacttctgtttatctacaatccacattcaggacgcggcatggtcaaggtacacctgtccgatatcattgagaccatggtgcgagccggatatgaggttgtagtttatcctacgcagcatccgaaagatgcagagcagaaggcaaaagaatacggtggttcatttgacaggatcgtagtcagtggaggagacggtacgctggacgaggtcgtctcaggtctgatgtctctcgagaacagatgcgctgtaggctatattccggcaggcagcacgaacgattacgcagcgtcactcggactcgagtcggatatgctcaaggcttccgatacggcagtcaatggaactccgacaaaagtcgatgtcggcagtttcgcggacaggtatttcgtgtatgtggcggctttcggcatttttacagagacgagctacactacgagccagcagctgaagaacgttttgggacatgcggcctatgttctttcggcattcaaacagctcaaagacataccatcgtacaggatgcaggtcgaatacgacgggaacgtgctctacgatgaatttatctatgggatggtcacaaatactgtctctgtaggaggcatgaagggcctgatctcaggcgaggttgacttaagtgacggactttttgaagtgactctcgtaaggacaccgaagaatcctatcgatctgagccagattgtgtcttctcttacgggggtggatacggatacagacatggtgacttcttttcagacaagcagggtgaaatttactgctgctgaggagataccgtggactttggacggagaatatggcggcagacctgaagaagtagatattaaggtgctgaatggtgccataagtatcgtcagctgaaaataaggttgaacgaatccggctaatggggtataatgctttttggtgtttaaaaaccaatacatgaaacggaggatacgtacatgttagttaatgcagcagagatgctcaaagaggccaagaaaggccactatgcagtaggacatttcaacatcaataacctcgagtggacgaagtcaatccttcttaccgctgaggagctcaagagccctgttattctcggtgtttccgagggcgcaggcaagtatatggctggatttgatacagttgcagctatggttaaggctatggataagagccttggaatcacagttcctgtagctcttcatcttgatcatggtacatacgaaggctgctacaagtgtattaaggcaggcttcacttctatcatgtacgatggttcacatgatgacatcgagacgaatgttaatcatacaaaggagctcgttgctatagctcatcatcttggcctgtctatcgaggctgaggtcggcggaatcggcggcgaggaagacggcgtcgtatctatgggcgagtgcgctgatccggaggagtgcgagagaatcgcaaaccttggagttgatatgctcgcagcaggcatcggcaacattcacggtgtttacccagagaactggccgggacttcgtttcgacgttcttgacgctatccagcagaagacaggagatatgcctctggttcttcacggcggcacaggaattcctgacgacatggtaaagaaggccatcactctcggtgtttcaaaggttaacgttaacactgagtgccagctcgtatttgctgaggctacacgcaagtacatcgaggcaggcaaggataaggaaggcaagggcttcgatcctcgtaagcttctcgcacctggtgctgaggctatcaagggcaaggtaaaggaaaagatggagctcttcggttctgttggaaaggcctgaataataaatcagttttacaccggcgcgctggacttcggtccaccgcgcttttttgtgggacaaaagggacggttctttttgtcccgccaggtggtttattttttggcgggaaataggtataataggttataactgagagaaaatgtttctcagaattatatcttttaaggaggaaaagacgaatgaaaaatgtcaaaaggttacttgccatcgcgatggcaacagctactgtagtcacagcagcacctggggcggtttttgctcttgcagcagattctgcaacaacttctgctgcggagagtttgggggtggttgacgttttagtggggtgttgtggtggttgtggttggtgtcttttttggtttttgggtgggacaaacccccccccatcttttttttttatttttcttccgcccagcttttccctgtgttttttttttaccttttttgtttttctcctcctcttttcctgttgttttaatttctttttttttgttttttctttttcctctttttgtttttttttttttgcttgcccataccccccttcttttttttgcttgtttctgtgtgtttttttgtttcgctgtattctttgtcgttttgtctgtaccttttgctttcccctacccgtttttcgattttgtgtgttctgtttttttttgttgtgtgtgttttgcgttcttttttttattgttgtccggtgtcctatggttgggtgtttgatgctttgagagttgatgtagtgttttgttctttttatttttgttctcggcccgctcaaggctggtggaatcttgaaagttcgtagttcttcgccttagtactgttggatctctagggcgttgtgttgtcttttttgttgtttacatggggtttttggtatttgtctagtttgtttttgtcttttgtttttcccgccgccgtcgcagttctagtgtttcagtattttctttgttttccgttgtgctttattttttttttcttggggttttgatgttgtgttgtttgtgcgctgttgggattgactgatggtttcgtggttgtcgtgggggtgtgcgtaaagtgctttttgtggtggagagagtgtacgaaatggggcgtttggtgtgggcgtacatggatagtgcgtttttattggtgttgtttcctgtgagaaggtgtgttcgtcttctttgcgagggaagcacttttttggttggtgggggttgtggggtggttaatggcatcccggcctgtttgccttgtctcgtgggccttgctcggtggtgcagccccactcacgtgggagcgtatggaaagttggtagtgacaagggaatgtggctgattgggggttggtgtttgtttgcctgttgtttgtcttttttcccctcgtttcccttttttttacttgcccctattggattacttttccaatactttatttctgatttggcacactcactcacggttcttttttgtggatttttgtgtgggtggtgtggaatatggtcttatccgctgacgtataggtgatcttaatcgggctgttccccttggctttggtgttttgatttgatgataccctctctcgtaaggaacgtcttgcgggtctctgacatgcgtgggaccaaactctatctagttcctttcttccttctcattcgcgcgttcgcgctattgatacaaaaagagacgcccttacggatacaagtatcctccaggcgtctctttttgtatcagcaccgctcatttattacgcggaagattgcacttctttttaggacatgttataatataatctaattggcatttgacaaaggagaatgaatttttaatgagtatagtcagcaagatttttggtacgcacagccagcatgagctcagacgtatcaaacctatcgtggataagatcgaatcgtaccacgatgagatgggaaagctctctgacgatgagctgaaaggcaagacacagtatttcaaggatcagctcgcagatggaaagactctcgatgacatccttcctgaagcgtacgctgtagtccgtgaggctgcgaagagatctgtcgggatggaaccgttcagagtccagctgattggtggtgttatcctccaccagggccgtatcgcagagatgaagaccggtgaaggaaaaaccctcgtttgtacacttccagcatatcttaatgcgctcgagggcaaaggagttcacgtagttaccgtaaacgactacctggcgaagcgtgatgcacagtggatgggaaaagtgcatgagttcttaggccttacagttggtgtcgttttaaacgacatggataaggaagagagacaggcagcgtacaactgcgacattacttatattacaaataatgagcttggattcgactacctcagagacaacatggtcgttcacaaagaggatatggtacagcgtggcctgaactacgctattatcgatgaggtcgactcagttcttatcgatgaagccagaactcctcttatcatttcaggtcagagcggcaagtccacaaagctctatgagatgtgcgatgtccttgtcagacagatggagcgaggcaaggatctccctgagtactcgaagatggatgccatcatgggtattgagcaggaggagacaggtgactacatcgtaggcgagaaggataaggtagttaaccttacccagcgtggcatcaagaaggtcgaggatttcttccacattgacaacctcgcagacccggagaacctcgagatccagcactgtgttatcctcgctatcagagcacatgagctgatgcacagggatgaggattacgttgtaaaggacgacgaagttcttatcgttgatgattttactggacgtattatgccgggccgccgttattctgatggtctccatcaggctatcgaggcgaaggagcatgttcacgtaaagcgtgagagcatgactcttgcagacatcacgttccagaattttttcaataagtacaagaagaaagcaggtatgactggtactgccctcaccgaggagcaggagttccgtgacatttacggaatggacgttatcgagatccctacgaacaagcctgttatcagagtcgatcacgatgatgccgtatacaagaccaagaaagaaaaattcaacgcagttgttgacgaagtgaagaagtcccatgcgaagggacagcctgttctcgttggtactataaatattgatgtttccgagcagctttcgagaatgctctcgaaggagggaatccagcacgaggtgctgaacgcgaaaaacaacgagagagaggctgagatcgtagcacaggctggtattcacgggcatgttactatcgcaacgaacatggcaggccgtggtactgatatcaagatcgatgacgaagcgcgtgcggcaggcggactgaagatcattggaacagaaaggcacgagtccagacgtatcgacaaccagctgcgtggccgttccggtcgtcagggagacccgggtgaatcacagttctttatctcacttgaggacgaccttatgagactgttcggttctgaacgtctgataaaagtcttcaattctcttggaatccctgagggagagcagatccaccacaagatgctctcaagcgctatcgagcatgcacaggagaagatcgagtcgaacaacttcggcatcagaaagaaccttcttgagtacgatgaagtcacaaatgaccagcgtgagctggtctacaagcagaggcgcagggttctcgatggcgaggatatgcatgaccagatcaagaacatgatcagtggccagatcaaggattctgtcgagacagttattaatgacggaatcaacagagacgaatgggatttaaacgagctgaaccgtgtccttctcgacatcgttcctttaaagcctgtaaatgagacttatctagaacagcacgatataaagaatgttgctgcgttagaggatgaactgactagcgatgctttcgagctctatgaccagaaggagaaagaattcccgccggaaattgatttccgcgaagtggagcgtacaattcttctgcgtgttatcgatcagcactggatggaagagatcgacaacatggagcagctgcgccagggcattgggcttcaggcctacggtcagagaaaccctatcgatgagtacaaggcacagtcgtatgagatgatggatgcgatgaacgccgctatccagcacgataccgttcagatgatgtatcgtatcagagtcgagagacaggtcgagcgtgaggaagtcgccaaggctaccggaacaaataaggaggagggcccttcacagtcaggtcctagacgccgcaaggcacctaagatctacccgaatgatccttgcccatgtggatccggtctcaaatacaagaactgccacggcaaaaagatatatggaaacaaaggctgatgatattttagaaacactggcgctttctcgagagaaagccgccggtgtttctcagttaaagaacgatttaaaatatggtgacagcgaccttcgctggaagacggactgttttcttgtaagctggcttcagcaggagcttgcggcagccgggcagtttgacaacatggtgcttctggcgcttggttctgacatacaggcccgcatgccatttttaaaggatatgctgtcgcaccaaggggagtatgggcgttttcttgaaaatgcatctccttatatgtttcttgtaggagacgacatctgcttcggagtgctcgaggatttttccagaaaatttggcgcggccctgcagagagcaggatatcaggtgatctttcagaacagaaacgagataccgcaggtttatggacagagatttcagggaaattcatacagggggatctttggcctgcaggacccgctgatggcgacgaaaatagagaacggttcatatctgtttgatcatattaattcaaagaaatatttctggtcatttgaccatccggctggattttttgatacactccatgctgcgcctgaagatgttatcgttctgacgctggacaagaactatgtttcttacactaagcgttttctgaaaagaagggcactgttcttcccaccgggcggcgaaaagcaatcaaagacctggaaaaatttcgacgaatttaaggcctcgaagctgcgtgaaaaccagatgggcatctcatttctgggaactccgggagtgggtcttcaggaaaatatagattacacccgcgaacacaatagaaagctctatccgctggtatcgacttattcgtataatcttttaaaccacacagatgaaccgagcgaaatggcattcgagaggacccttgaggatccggaagtcggcataaagaatcagataagtgatgacgactttgcagaattatttggcgagtgggccagcctcgagaaaaatgcctctaaaactgtgcgaaaacaggtagttaaagagatagtttccgctggtgcagatctcaatgtctatgacagagggtggaaggatatcggcgattttccgaatctgatcgtccacgacagtattccatacgaggatgccagaaaagtttacgacaagtcctggatgtcgttaaatgtgatgagctggcacaaggacggctttaccgagagaatcgccgagccgcagcttcacggatctctggtcgttacagacagcaccaggtatcttcgtgaaaattacacagatggtgaggatattgtgatgttcgatctgaacgatcagagcataaaagagcttccggagaggatcagggcactcctttccgataaagacagattattgcacatcgcatacaatggatatctgaatgccttgaagaatcatacctgggacgcaagagcagaacagttcttaaagctgacagcagctttggattaaaaaaattagaaatgttattctgtataggaaaaatttatctaaaaaaaacaattttttaattattggtccacaaatttttcacaaatggatagtatagtaataattgtcaaagggaaagacctttgatgttaattgttttcgtttttcatactccccctcttaggactgtgagatctatctcacagtccttattttttcgcgtattaaatgagcggtgctgaaatatcgtatcggctcccccggaggatggggataagcgccgaaggaatacgagggcagatgaaatcagatatcttcccgcttctgaatctcgacaggccggccgaggatttttgtttctgcctcttcatttcaaggaatcgtcgataggctatattgccttcaaaaatgtcacagggtgtcttgacaaacagatgtattttcaagcggctattaccatccagcggcgaatcaaagagctttacaatgaaaaggcatccgagaggttaacagacgcctgttgtatctctacaagacggactcgctgacaggagtattgaacagagtcgggtacaatgaagaaagcgtctcatactttgaattcaccgccgcgcgggcagcaggtttatgggatgttctgcgatctcgacaggcttaaatatataaatgacaattacgggcacaaggctggagaccgcgcgataagagaccttgcaaagactctgtgtcaggtccttggcaaagattcggtcattgccagaatgggcggagatgagtttgtcgctatgggatcatttgcgtcggaagatgaccttaatgatatgatggtggcataagccccggctcaaggctcttcaaaaagagaaaaggctgccgtacgatctcgatgtaagcattggtacgagtattgcaagaccgaccgatagaaacgatcctgaatactttgtaaaagaggctgacaagcggatgtatgaagaaaaacaaagcatcaccaatttacctcttgacaaatttcaataatcgtgtaaaaataaattctataaaccgagtagttttgtaggatatagagagcgcgattatatgagttagtaccaggggcagtatgccattaaggttatgatagatctggcagagcatgataacggtcagtttatcccgttgtctgatatagccaggagacgagatttcagaaaaatacctcgaagcatatttttcgacgctgtccaaagcaggtttcttacagtcacttcgtgggaaaggcggcggctacaaattgagccacagaccagatgagtattcggtccgtgaggttttagaggctactgaaggttcactggctcctgttcccgaagaggagatgtattcagtcggtgacgagcatgtatcgactttccgcaccgcgaagatgtggaaggggctatacgatgtgatagaaattacctgaattcagtctccattagagatctggccggtgaagacaacggtcagtacgacttcgtcatttaatttggagagcggtgcaattcgcactacataaatgagcggtgcaattcgcattccgctacgctgcatctccccctaagatgagatatcccgtctttaaaagacataagatcccttgaagagtacaaggtagatagggcaggggtgtaagagctgcaaggctctcagctgactgtcactaatagatcgaaggcttgatcaagagttcgggttagataagagataatgtatgaagttttgaaggtattttcattactttgaaaaaatggcctggtggctcagttggttagagcgccgccctgtcacggcggaggtcgagggttcgaacccctcccaggtcgtatgggatcttagctcagctgggagagcatctgccttacaagcaggaggtcataggttcgagccctataggtcccattttttaataattatatacgccgatgtggctcaattggcagagcagctgatttgtaatcagcaggttaacggttcgagtccgctcatcggctttttgtcttattcaaggcaaatgggtggtttcccgagtggccaaaggggacagactgtaaatctgctgcaacttgcttcgatggttcgaatccatcaccacccattggcgaaagccctaacatcgcggggtggagcagtctggaagctcgccgggctcataacccggaggtcacaggttcaaatcctgtccccgcaattttagcttctggtcaaaggctacaaggccggatgacttggaagttatttttttatatatgcccagttagctcagttggtagagcaggggactgaaaatccccgtgtctctggttcgattccggaactgggcatatttaaaaaggatctatcatttagataggtccttttttttataggatataatgatttggcggtcaaaaggttgaccaccaaaactatttaaggggaagcccgctgtcatatgaaagattcccaagactagattttaacaggcgaatatattcaaagtaatctcgagaaccgaattcagctttagtgagcttatttagaagtgaaagacggtgaatatagttgtgcatagccttgaaaaacaagtcgtataacgactcggtagaaaagatatcagtcttccatgggttgcgccagagatggtgtctgaggttgcagggatcgctgtatgtgatatggtcatctgctgcgatcatggctgatacttgtggatgagaagaaaatatgccttcaagtgagcggacaaatttctttttccagctgagagggtcctccattaaatcgtaagctagacgagtggtatgaaacgcctggttgatctcataggaaagtacaagagaagaagggtaggtcttatcgatagctcttacaataaatgaagaaagaaaaaatgaatcttcactcgaaagccttatagtataggaagggtgaaattcagagggacggagttttaaaaagtgagctagtaaagcacagtcgatgtcagtttcaagaagaacgtgattgtgaaaacccttatttgacttatcatttatatctttacatgatctgaaatgtatatacgggtggcatacagtgtcaagtgagtaatggcctataaaacctgctgtataagcatatgccagggatttgagccgctgaatctttatcgaaccggcagtgtcgataagctgcattatatattcaagcgttcgttcatggtgcatccgtatgccaatattctggtgatgcagataagatgtcggattaaagaaaaaaatatccggaccctgttcgcctaaagcataaacggctggataagctctaatcatatcccaaacagcaagactgctgtcagtatttgtctttttcaattcatttctagtctcgataccaaaaatataatgagaacgaaaacctggcatgaaaactctcctttaagaaaatagttaaaaattttaccctcgtccgtgacattataacagaaaaaaaatataagtaaaggaaatttgacttgaaagagtagttgaaacgtattacaatagattacgcaaatatataaaaggagacagctatggtcggaagagagagagaattacagatcctgcgtgaattttacgataattctgatacaaatgtgattgctgtaaccggaagaacaggcatcggaaaaactacactgataaaggaatttgtaaaagataaacagtgcatattttttaccgcttattctacgacggagatgcatcaacgagcattatttggtaaggctgttggcattgatgacgatcaatctaccctggatcagatttacagtaaagttacagctatgtcagacgaggggacagcagtccttgtgattgaccactatgcagattttgcgaagactgacaagaagtttcctgaaagcctttataagtatatgacgacagtgtggaaacaaggcactgtaaagcttattttatgcgattcttcaagcatccagatggaaaaatcagtctatgggcccagggccgtatggaacagtctgcatcctgtaattcttacagttgatacgctctacttcgacgaggctgtaaagatgttaccggatacagacaggctgactgaaagtgagatatacggtatcacaggcggaatcccggtattgctggagattgcagctgaaggacttaaaaataatccagaagatgccgtatggagaacaatagagcggatttttttgtcaaaattttttgatttcaaaggatcgccagaaaatatcctcggcagagagctcagggagaaagcatattacgacaggctgatgtattcacttgcccatggctatctaagagtaaatcagctctcggagcagcttggcaaacccaaagatgtcgtcgtgccatacctttcaactcttatgaagctggggctggtgacgaaggaaaatccggtcacagagcctacaaaccgcagaaagacaaggtattctcttatatcagactatgacagattctggtaccagatcatcatgtcgaggtacgaagacttcgtaaatgacaacagagaaaatataaaggcttattggaatgaccatatttctgaatatatgaaacctgtttttatcagaatgtgtcatgaatatctgctccggcaatgcaggtcagataaaatgccgttttcgatcaaaaatatcggaagctggtgggaaaacaatgaatccactggagaaagtgatggttttgacctaatggcaactggagaagcggaaggtaaaaacgcatatatttttgccagatgttttttcaaggagcaacaggtagatatgatggatgtgaaagagcttattgatcttacaaaaaaaatccacaacaaaatctctacattttacttgtttttctcagtgaatggctttgcagagaatgtacagactgtatctcaaactatacgaaatatcatgttaattgacttgaaagatatggtataatcaaagaagatgtcaaaaattgactttttaaagaaagggaaacagatgacaaatcaagaattagcaatcaaagcgaacgaagtgagaaagggcattatcgaaggggtttataatgctcacagtggacatccgggcggatcgctttcttcagcagatgtacttacatatctgtattttgaagaaatgaacatcgacccgaagaacccagacaaggcagacagagacagattcgtactttcgaaaggacattgcgcacctgcttactattctgcactggccaacagaggatattttccggtagaggatcttaagacattaagacatgttggctcttaccttcagggacacccttgcaagaatgacacacctggagttgatgcttcaagcggatcactcggtcagggtatttctgtagcagtcggtatggctcttgctggaaagattgacgatgcatcatacagagtatatacacttttaggcgatggagagatcgaagaaggacaggtttgggaagctgctcttttcgcaggtgcaagacatcttgacaatctcgttgtaatagtggataataacggccttcagatagacggaccagtagatcaggtcgattctccatatcctatcgcagacaaattccgcgcattcaatttccatgtagtagaagttgcagacggcagtgactttgatcttttaagaggcgcatttaaagaggccagagatacaaagggtgctccgacagctatcatcatgaagacactcaagggtaaaggagtatcatacatggaaggtcaggtcggctggcacggtaaagctccgaacgaagaacagtacaagcaggctatggatgaattaacaaaggcaggagaagcattatgtcagaagtaaagaagatcgctacaagacagagttacggtgaagaactggttgaattaggaaaagagtacgataatctttatgtacttgatgccgaccttgcttcggctacaaagacaggtatttttaaagaagcattcccagacagacatattgactgtggcattcaggagtcagatatgatgggaatcgccgcaggtctcgcatcatgcggaaagataccattctgctctacttttgcaatgtttgcagctggcagagcttatgaacaggttagaaattccatcggctatccgcatctgaatgtaaagatcggcgctacacacgcaggaatttctgtaggtgaggatggagctacacatcaatgccttgaggatctggccctgatgagagttattccgggtatgactgtcataaatccggcagacgatgtagaagctaaagcagcagttaaggcagcatatgagtttgaaggacctgtttacctgcgctttggcagacttgcagttccggttattaacgacagatctgattacaagttcgagatcggtaagggttatgtagtaaaggaaggcacagatgttactatcattgctaccggacttgaggtgtcagcagccatcgacgcagcagatcttttagcaaaggacggcatcagcgctgagatcgtaaatattcacacgatcaagccgatcgataaagatcttatcatcaaagaggccgagaagacaggaaaggtagtaactgttgaagagcactcagtaattggaggacttggcagtgccgtatgtgaggtactcgcagagaatcatccgcttcctgtaaagagaatcggtgtatatgacaggtacggtgaatcaggaccggcagtagagcttttacataagtataagctcgatggagaggggatagcagaacaggttaaggagtacctgaagggttaaccctttatataaaagcctatgagtagtacaaagaagaaaaagcatagtggtgcgaagaagtttctgatcgttcagcttgtgattcttggaattatcttagcatttgttggttattactatggcagcggattagctggcaaaataagcaaattgaaagcagatgctgacaaggctgtagctgaatcaaacagagacacgttcaagagagaggaaacgggagtcgcatatgattcagatggtaaaaccattgcagtccttaaaaaggacaaagatgtctactatctgacgtatgatgagatacctgtcgaagtccgccaggccattgtttctatcgaagataaaaaattcgaagaacatcatggcgtcgacttcatggccattgtgagagccgcatttgctgttatcagacataacggtgagaagactcagggtggttccacgattactcagcagcttgccagaaatattttccttactcagaaaaagacatacgaacgaaagatagaagagatttttatagcattagatctcgagaaaaaatatactaaacatgatattctggagttctatctgaacaatgtctactttggcaatggatactatggtattgaggctgctgcccagggatatttcagaaaagatgccgttgatcttgatacctcgcagatcgcatttctgtgcggacttccgaatgctccaagcagatacgatccgagactgcatctgagtgcagctgtttcacgtaggaacagagtccttaaaaatatgcacgaggatggagtacttggcgaatctgactatcagaaggctgtcgctgaaaagataaagataagcaagcctaagcagtactaccagaactacatggagacttatgtatactggtgcgccacccgtgctttgatggatgtcgatggattcaagttccagtataaatttaaagataacgctgagaagaaagcttatcagaagaaatattatgaagagtacagtatctgcaacgacaggctttacactggaggttatcgtatctacacaacgcttaaccgcagagtgcagaaacagcttcaggccagcattaatgatggattaaagggctttggagataagaccaaaaacggtatttacaaaactcagggagccggcgtctgcatagacaatgatacaggatcagttatagctatagtcggcggcagaagccagaagattacaggatataccttaaacagagctttccagagttaccgacagccaggttcatcgatcaagcctctgatagtttataccccggctcttgaaaatggctatactgcaaatacgatagtagatgaccataagtttgagggcggaccatctaatgctggtggtggctatcatggcaagataaagctttcagaagctgttcagagatcgctcaatacagtagcatggcagatatttgacaagctgacaccgaaggttggaatttcatatctttacaagatgaaattctcaaatatcgtaaaaacagatgaaacacttgcatcatcacttgggggcgtaacaaatggtgtttccccactcgagatggcaaaagcttatgctactatagagaacgatggatcttacagagatccgacctgtatcgaccgaatcaccaccgcagatggtaaaaaggtctgggagaatcaccgtaaggaaacagtcgtatataccaaagaagcatccagagagatggttgatatacttaaaggtgtatttactaccagttggggtacaggaagagccttaaagcttggtacaatgccttgcgcaggaaagactggtactactaatgactacaaagatggatggttctgcggctttacccgttactacacgacagctatctgggtaggaaacgatcagccagtcagactgtacggcctgcagggagcatcttacccgggtcacatctggcagaattttatgctgaaggttcaccagaacaagtcacctatagacttcgagaagccgacacaggtgactggagagatcagagaagacataagtactgatgaagcatctcaggcagaacaggatttgaaggaccagaaagctgccgaaaatgcaactacggatacaaagacacagagtacagataacagtacaaagcagaatacagacaacagtacgaaaaaaactcaaaatacgacccagaacagtacccaaaataacagccaggatactggcaacaagaatcaaacaactacgaataatacccagaatcagcagtctactggggaaaatacgcagaatgccaatacaaatggcaacgcaaaccagaataccagtcagcagactactgataacaaccagaatgctgacgccaataacgaaaataaagctgacacctctggaacaaataattcaggcaatcagtaagacacacgcttaagatgaaaggaacaaaaacagtaagatgaagtatgcagtgggatttgatctcggaggaactacctgcaaggtaggagtttttgacgagaccggaaagctattagacaagtgggaggttcagacagacaaaaaagacggcggtaagaatatcatcccaaatcttgctgaaaacatcaaaagctatctgcatgggaagaatattccgatatccgatgttattggtggaggtattggtgttcccggtgcagttacacctgatggcatcgtaaacaaatgcgttaaccttggctgggatgaaaaagtagcgatagaagagcagatgacaaagtactgcggtttccctgtcaaggcaggaaacgatggagatgtagctgcattaggtgaaaattacaaaggcgctggccagggaactcagagcatggtcatggtaacgcttggcacaggaatcggcggcggaatcataatcgaaaacaaaatgctgatcggattcaatggagcaggtggagaaattggccacatacatattgatgatgatgaaacagaacagtgtgggtgtggcaataaaggctgtattgagcagtatgcttcagcgacaggaattgtccgccttgcacaccgtgcgcttcttaaagagagcatggattctccactgagacagatgcagcacattactgcaaaggatgtatttgaccaggcgaaagccggcgatgcacttgccaatcaaatcgccgatgaagtctgtgcaaggcttggaaaggccctttcgattattgcaaatatcataaatcccgagatgtttgttataggtggaggcgtttccaaagccggccagattataattgacaagactcgtccatcatttgaagaatacgcattccatgcctgccgcggcacaaagattgagcttgcaaaactcggaaatgacgctggaatctacggaggcgtaggacttatattaaataaataaaaatacttgcattttccgaacagaagtggtaaaataccatctgttcggttgcgatgcgtggctcagcttggtagagcgctgcgttcgggacgcagaggtcgctggttcaaatccagtcgcatcgatacaatttagctgcagctctttggtaatgagaggtgcagctctttttttaaataaaaataatttaccaggtggagacagctatgggcactaagacaaaatgggcagtaatcacaggcgcctcgtccggcataggagaggagttcgcatacagattttatgacatgggttattcactggtgctgatttcacaaacaagagagaaactctccgcagttgaaaaacatcttctgaagagaaaaagaaaagcacctgaaaggcggcaggagataaagctgatcgacgctgatcttggcgagatggggtctcttaagaagacaagtcttgagataaagaaaatatttcagatggaaaagttcacagaagattcaaatctgcctgctatactaataaattgtgccggttttggagctgtaggtgaattcaccgatatttcgatagaaaaacaggaatccatgatcgatgtaaatgtcaagggattagtatatctgacatacgagatgcttccgataatggaggcagcaggcggcggaaggatattaaatgtcgcaagctcagcgggatttttcccgggtggaccgtatatgactatatactacgcgacaaagtcttttgtgctgagctttactaacggactcaggcgtgagctttttgaaaaaaagagtccggtacatatttcggcactgtgcccaggaccagtgaatacgccttttaacgcaagagcaaatgtccgaaatgccctgccgggaatcagtgcgaaacgttgtgtcagcgctgcgatttccggaatgaaacacgacaaggcagtcatagtaccggggattacaataaaagcggctgagctaggagcgaagattctaccggcaaaagctgttattccaatggtatcacatcagcagaagaaaaaaatttaaaaatatagttttaaacagaggaaggaaaaaagagtgtctgaagatagaaataagttgaatcaagagcagactagtgacgaaaaaacgggaaacgacatagacaacgaaaaggttgaaccaaaaaccaacgtgtttaaggagctgatgtcgtgggttatgatggttgttatagttctggcgatagtctggtttctgacgaattatataatagtaaatgccagcattccatcaggctcgatggagaacacgataatgacaggggacaggctgataggccagaggttcgcatattggtttaatgacccgaagaggggcgatattgtactttttcactggcctgtagaaccaaagactatctatataaagagagtgatcggtctgccaggagagacagtaactataaaaaagggcaggatctatattaacgacagcactactccattgaaagaggattacctgaaggaaaagtgggttaatgagaatgacggattcacatttcatgtgccaaatgacagctatctgatgcttggagacaaccgtaacaattcagccgacagcagagactgggctgaagaggctgttgaaaagggagtaaccaacagcacaaagaaagctaagaagcttacctatgttaaaaagaagcagataatagcgaaagcctggttcagatatgtgggcggtttcaagaaccttactaatacagcagattacgacaactgatagaaaacgaaagaggccaattattgaaaaatattttaaaaaacgttaaaggatacagactggtatccattcttacgccccttgcgatgctgctcgaagtagctatggaaatggtacttccaggccttatggcaagcatcatcgatgacggtgtaaacaaaggaaatatgacagttatactacaggacggtggctggatgctccttgtcgcactgatcggacttgcggcaggtgtaggcggcggagttttcggagcacaggcctcggccggacttgccagaaacctcagggcggcacagtttagaaaaattcagacctattcctttgaaaatatagataaatttgagagttcatcgcttatcacaagacttacgacagatgtgacaaacgtacagaatgcctatatgatgacacttcgaatgggaatgagggcgccggcatctatggcagtcgcacttataatgtcatttattgtaagcccgaggatggcgatcatctatgtatatgcactgttattccttgcggtaattcttatagttataatgcctgtagctaaccgcatgttccagagagttttcaagaaatacgatgcactaaacgagagtgtagaggaaaatgtctctgcaatccgtgtagttaaggcctatgtccgtgaaaagttcgaaaatgagaagtttaagaaaaagagcggagatatttacaagaacttccttaaagtagagaagctgatgacatttattatgcctgtaatgatgggaacagtgtatgtggttatccttcttctgtcatggaatggagcaaagctgatcatcggcggagatctgacgacaggacagctggtccagatcctcacctactgcatgagcatactgatgagtcttatgatgttcgcgatggtcgcaatgatgattctgatgagcgaagcatcagttgagagaatcagcgaggttctcgatgaggagccggctattaagaatccagagaatccagtaatggagatcagggacggcagcatagacttcgaccatgtaaatttctcatacttaaaaaatgacaactatattttaaatgatatagatctgcatataaagagcggagaaaccattggagttatcggtgggaccggaagctctaaaaccagcctcgtaaatctgataagcaggttgtatgatgtatcaaccggtgacgtaaaagtgggcggagtcgatgtcagaaagtacgatgttcagaagctgagagacgcagtatcagttgtactccagcagaatatgcttttctccgggactatttacgacaatctaagatggggcgataagaatgccacggacgaagagtgcaggagagctgcacatctggcttgtgcggatgaatttattgacagattcccagacggctacaacaccagaatatcccagggcggaacaaacgtatcaggcggacagagacagaggctctgtattgcaagagcgcttctaaagaagcctaaagtcctgattcttgatgactctacaagtgcagtcgatacaacgaccgacgcaaatatcagaagagccttcagagaggaaatcccgggaactacaaagattattattgcgcagagaatcagctcggtaaaggatgcagacaggatagtcgtaatggacgaaggccatattgatggaatcggaacacacgacgaactccttaagacaaatgcgatctacagggatgtgtatgactcacaggccagcggatcgggagactttgatgaaaaggaggaagcctgatgcctagaccaggaagcagaggcagagcctcaaaagaagatagaaaaaaagctatgaaaacgctgaaaaggctgtttaaagaccttttcaagaattaccctgtacagcttatcatggtggtaatttttatcattataagcgtattagctaatgttcagggaacacttttcatgcagactctgatagacaactacatcactccaatgcttaagtcaaaaagtcataacttcgacccgctgctcggagcgataagaagagttgcagcattctatattattggtatcatggctacgtatgcatacaattttataatgatatacgtaaaccagggaatgcttaaaaaaatgcgtgatgcgatgtttacgcatatggagacgctgccaatccgatattttgatacgcatgctcacggcgatatcatgagctgttatacaaatgatattgatacgctgcgccagatgataagccagtcgataccgatgataattcaggcatcgtttacgatcattacagtgcttatctcgatgatctacctatcgccaattcttacacttttgactctcgcaatgacagtagtcatgatatttgtgacaggaaaggcagcgagcctatcgggcagattctatacacagcagcagtcagaccttggcgcactgaatggtcagatcgaagagatcatgaagggcgagaaagttgtaaaagtattcaaccacgagaaagaggcaactgcagatttcgacaagttaaacgatgcactgtacaagagcgcggcgaatgcgaacagttacgcaaatattctaggccctataaataatcagctcggaaacgtaagctatgtgcttgtagctgtagctggcggcggaatggctatatccgggttcggaggtataacgcttggaaaacttgcaagcttcctgtcgttcaacagaagcttcaatatgccgatctcacaggtcagccagcagctgaacttcatagtaatagctgcagccggagccagacgtatctatgctctgcttgacgaagaaccggagcacgacgacggctacgttacacttgtaaatactaaagaggagaatggcagactcgttgagacgaaggagaggacagagcagtgggcctggagacacgaacatcaggcagaccacactgttgattacaagaaactcaccggaaatgtagtaatggatcatgtggatttcgggtatgctccgaataagcaggtcctctacgatataactctctatgccgagccaggccagaaggtcgcatttgtcggtgctaccggagctggaaagacgacgatcacgaacctgatcaatcggttctacgatgtagaggatggaaagatccgctacgacggaataaatataaataagataaaaaaaccagacttaagaagatcgcttggcatagttcttcaggatacacatcttttcacgggaactgtagccgacaatatccgctacggaaagcttgaagctactgatgaggaagtaaaggcggctgctaagctggcaaatgctgatggttttatcagacatctgaaagatggctataatacggtgctaaagggagacggcgccaatttgtcagcaggccagcggcagcttttagcaatagccagagcggccatagccaatccaccagtgctgatccttgatgaagctacttcatctatcgataccagaacagagaaaatagtccaggatggaatggacaagctgatggcaggaaggaccaccttcgtaatagcccacaggctttcgacaatcagaaactccgatgtcatcatggtactcgaccagggacatatcatcgagcgcggaagccacgaagaactgatggcgaagaagggcaagtactaccagctctacacaggcaaaattgtgaacgcataatattttcatatcataataaaaaaaggtgtcgcaggacacctttttttagtggaaaaatgagttaattaaaaaaaacgtcgcataattgtggaaagaatggtaaactatttataaagttcgccgacataaatattagacatagtctaactatgcccaaatgaaagacagggcagaccgaatagatacgaacaaatgaggactgcagaatataaaactaaaaccacaatagtaagagtggaggcaatgaatggaaactaaaagacttctgaagagaattgcagctgttacgatggcggctctgaccgttatgacatcgtccaatatagatgtaaatcttctgactgcaaatgctgccgagaaagtagagcagcctgcggcgcagagcaccgaacagacgacatccgaaaataagacgacagacacagacagcaaatcggatgccgcaacaaaacgttcattcactacagacgaaagccttcagagagcagtggcagatgcgggttttacaatagatgtaaagactgacaaagtgacatctgcagttcttaaagatggtgagactcagcttacactcggaaaagacttcacagcagatgcaaagcgtaccggtgtgaaaaatgttgaatcgaaatacaactatatttatacaatcacgataaacggcactggtgaatttgaaggaacagcaaaaagagaaaacgtagagcagatttctgatactgctccagacggtacagaggataattctgccaagaagcaggaaactaagaaaactacagtttcgaagaaatcagcaccagtaaagaaatcatctgttcggaaaaacgcgccagtactgaaagctgccagtactacagagacggaagatccgaataaagtttttcaggcgacagttactagtgtcactacagacaaatacttgagatatgacacaggagagggatgggtattttatttcaatcagagatttgtaaactatgatcctgagggtaagaagcaggtagcaagatttggtgacggaaccaggttgaataatggagtgaccgtatactacaaagatgaaaaaggagaagaaccacttaatggtggaggtgacgattactctatcgaatatggcgaaaacacagaagctggagagagttcaggaacatttactgttacatcaaatctggttggtggcagctatttttcaacacggacagacgatattgccagtaagccttatgctaaaaaaatcaccgtaagtttcaggattctgaattcaattcttaagggatcatctggagaggggttaaaactaatctataacgggcaggaacataatgtagaaagaacttcaaatggaaacggtaaggcagaaggagaatttgtatataacggaaataaggtaagacctgagataaaatatagaaatggtaccagtaattccggagagccaatttgggcaactctaagcgaagcaaatcagaaaataaaaattgaatatacatatgataacaaaaccggaacagcattgattcagacgtcaattccaagtgaaggggaaacatacgaaaaagtaaatataaaatatacgatcagcgcaagatcaataactgataactataatactaatataagttcgacaacaggcattactatacagttgagtgacgcagacctgacttacgatgggacttctaaggaaccaaaagtaacagtaactgaaaaaggcgaatcttcagataaagatggaacaaaaacatcgcacactcttacagagggtacagattatacagttacttatcagaataatacaaatgcaggaacagcggatgtcattgtttcggccgttgagaacagcaactataccggttccgctacagtacctttcactataaaaccaaagaaagcagattcaggggatatcataactgacgaaagtaaaaaagataaaggcaaattttatatcactggacttgattccaagtacacaggctccgaattaaaacctgttcctacaattaaatactacgttcagaaaaagggtgatgactacgatgtccttacactcgagcagggaaaggactttgaagtaacaagctggactaataatacgaatattgccggaagtgacgctcagaaccctcctacagctcatattcgcttcaaaggaaactatacgggagaaatagatcgaacgttctctattacaaagtacgatctctcgagcgctggtacgaaggtaactgtaaacagttcttcagaaaaagaagtaaaaaatacaggaaccggtacgggagaggttgattttaaggattatacgatagattacagtcctataaaatctgaactaccagttatccagatcaaggattcaaacaatagaactctgtcatgcgataagtacaataagaagggggatggagactatagtatagataaagaaccgacgtgggcaggctcaggtacagcgcaggaatggccaagtgttggagactggaatttgaccataactggcaaaggtaactattcaggatattcaggaacaatcacggtaaagttccatgtgagtccgttagacttatcaaaatcagtttccagtggaaaattaaagatagtaaatcagggatttgattcaaatggtaaggcgtatgtagagttttcctataaaaataccgtttcggaatatggaaaaacgattccatatgaaactgaggaaaatatcaaagctactaaagaagttaagacaggagacacaactgaaactgtaaccaattttacaattgatccagacacaaataaagggctgaaagcctcaaaaaacatcacactgactctgcacggtaagggaaactacacaggcaatctggcagtggatggctttaaaaatggtctgaacctggccgatgctgcgatgacaaaagatgagaatacgcttaataacgcgcaaattcgaatcagagaatttgatccgtttacaggagcagagttgacaccatccagcaatggcgctatagctatgccttattacggggacgatataataccacagtttattgtgcaaatcaaagaagaaaatcaagaagatggcaaaacaactacaacgtggaaaagattagattcagaatggtttaaatcaagtgatgtatcaaaacaaacaaatgtaggctcgacttatgtctaccgcggaacgattactctgtctgccatagaaagtgatcagaatactaaagtttatggagaaaagacggttcagttttatgtagagcagcacagcctttctcaaaccgatagtgacggaaatgttgataaatataagctctcgagtgatataaaggcaaatgcttcaaaaatagcaagtaagacaaatctggacgacattggaaatggacttgaacttacgctggagcctgagaatgcaaacaaatatatttacattccggaagattcgagcaaggatgctaaagtccagacttcagatgtatttaatgaaaaaaaggcaggagatgcactggcttattggagaaccccaactataagcgacaataagctcaaatataatacagactttacagtcgatttccaaaggaatgcagatggaagaccaataaatgtaggaacgattattgcaacggggcgtggaaattatgcccatgatgtcattatcacgttaggacaggatgatctgagtaatgatgacttttttatcaggtacaatgctacagactatacagataatccggctgttctacctggcattgattttgatgggaatgaacattggccatcagttcagctttggagaaaacaggttgcaggacagcagagccctacacagcttgaagaaggaaaagactaccgtgtagcatacataaatcctaatggagagatgacggatgcaaaagggtatctgataaataatgacggagaatatgtagatctaaataataataaaataaacacatacggatatactgctatagatgaatatggaaaccttctaaaagatggtaaatacattggttcaaatggaaatgcgataaatgatagtgatgtgactcttaataaaaaggatggtaatctttacaagggagacacaaaagtcgataatgccaaattagtgaagagtattcatggcttcagacaggctggaagttatacgatacagctgatcggcacagcaaccggatcggctgataaagatgaaacggcaacaacgacagacacaaaatcaagtgacacagcacaaacaggtactgatacagaatcaaaatcaggtgatacagcgacaaagaccgatgattcacagagtatgtactttggtacgagaactgtcacttatacaatagcagctagcacaactcctcttactgctacgttcactcaaaatggaatagtaaactataattatagtagtgacgagaaaaaaaataatacattaaagccagatttcgcttacgaagaagagaaggaagaagtaccagacggtgcaattcgtttaaatgtatgggctcagggtgtagcacagcctctcgtaagaagcactgatggcgttacaggagactatactgtaagatctgatgataatctcacagaaccaggccagaagatggtatacataactggaatcaacaagtacgctggtcagtcaatcacgacttcgtacaatgttgtagttaatatgagtgaaataggcagatcagacggaatgctgaaagctacacctgatttgtctaaagaagaggctgatgagaagacactgtattacgatggcggtacgactcttaaaaccggcgaaagacaaccattcagtcaatatgtgacgattaagactgatggcggcaatggaaacattgttgatgattcgaattatacagtaagtattgatggtcaggatgactcgataactaatctgtactctgcgggatctcattatatcgattatataggaaagggagcatatcagggttcttatagacgcaatattaacgtcgtagtcactagggccaatttgctctggaccggagacagcacgacgaagggcaatggcactacaagcgtaactcttccttggaaaaacgatggttacaagcttggacaaggtgcactgtcactttataaaagtgtaaatggtacggtagaaagtgtaaagctcacagacacagacataattacagtagatggaaaacagagtaaacagaaaaacagtgatggaacggtatcagaagatctgctgcaaaaagcctggaaagaaattggaactcatacagtaacgatcaaagggccgctgggatctgatgatttcacaacgctgacatttactatcctctacgatctgtccaaagttgatatcaatttaggcaaagagaaaagcactccgtacaacgggacagatgtatactttgacagtgataataataagatagacttaagccagataaaggttgcttcaggaagccagcaccttaattatgacacagattatggaatcgagagaaaatacactgctggaaatgacagcaaagcaactgactttaagaatgctggaacaatcgaagtctctctgacagaaaaaactggaaaaagtatgtacttcgatgagaacaccaaacctacagcctcctacactatttcaaggcttatggatggcgacaagtatttcgacatcagtcaaaagccgattacacatctgacatataatgggcagagacaggagccaaaagagagcgattttgatgaaaaggtaagctacagttcagctgtatttactgataaattaaaatatggcacggattatactgtaaaatacgattcagacagcacaaatgctggaagcaagtctgttactattacaggaatagggaactatggcggatctaagacaataaaggacgcctatgaaatagataaagctgatctcagcacaatagatgctaaaaatatacatattccagatcagtactttgcgggagcagagaatgcaattacaccaaaaactcttacaattgatgggataacaggtactcttgacttcagcacggactataatatttcaaatccaaggaataataatgttctgggaacagctacgatcaacattaatggtaccggggataattttacaggtactgcttcaaatgtgacgttccagatagtaaagctagatcttagttcagaaacagtaaaaaataatatcgaggtaagcgatactacatataacaagggtgcatcggttggtatagaccagcatattaagatatttgtacctgatggtaaaggaggagatggaagaattcagctgcagcgagggagagactatactcttacgtttataagtgggacagtctctacttcaagtgatcctacagacgccggaacatatgatgtccagataacagcaaaagattcaagcagctatgttaagaaccagtacacgataaaaggatttaaagttaacgcactgaatatcgaagatgtcgcagaccagttcaatgtggaaaatgctgcatggacaggcaaccctgtgacaccaaaggtgacatttaacggaagcgatctcgattctacatacacggtaacatacgagaacaatatagatgcatgtgccaagacaagagcagaaatgctgcagtataacacgagctttgatggtaataagattccgcaggctgttattactggaaaagggaactttgtcggaactataaagaggccgttccagataggtatgccatttagcgatgcgacaatcacacctacatcgaactcaaagatcatttacaatggtaattcacagagaagggagtatacagtaagctatactgatgcttcaggaaaccgccagacggttgcggcagaaagatataacgtttcatatccgacaaacacaactgatgcaggagacaaaacagttctctttactgcaaatagtggtccgctttatggaacaaaaactgtaacgtatacgatttacccagttacaggcagcacctggtcaattgagtttgatactctgacgatggatacgactggacagtatactgctcagtacaatggagcccctgtcactccttcagtaaaagcatatagaataatagcgggtggcaccagagaagaaattccgctcaagccgagtgagataacttataaaaataacgaagcgccaggagttgcaacggtatccgtcagtccgactaactacgagggaacaaaaactttaaacttcagaatacttggacttgatatctcaggtgacgaattctatgcagcatttactgacggtgtaacacgtctgaagtacactggaagtgaaataaagccgccggttatagtgacatatactggttctcagggaacggtgactctgacagaggatcgcgattactcgctgacttatgaaaataacataaatgctggtactgcagatgtaaaggttaacggcatcggtaacaatattggaacaaggacattgaccttcgatatatatgctgattttaatgacgcaacctcagtatttacaataccaaagcagatgtacactgggaaaccaattacgtcacttatgagaacgactctccaggctggtggaaatgacctgaagttgacagatgattatacgttgaatattatatcaacagactcatttaaaacaagtggaactgctatatttacatcacaaggcaaatactacgagggcacgagaagagtgcagttcgagataggaactgtggatttgaattatacagttcagggcgtagaatcgtcatatgtattcgaccataccgcgcacaaaccggtacctacagttatagatgactatggtaattcatacacagtagagaatgtaaactatgccagcacatccgatggaggcgcctgcatagatgccggtactgtccagatggaaattacgatatcgaataatggacatccggtaactataccgtacagttacactattgagcagagaaatataaacactgcaactatgtctcaggttgcagatgttgattatactggaactgcccagacgccgacagtgagtatcagtgatgggaaaaatcagctggaaagctcaaattcaactaacgatggctcagcggattatgcagtaacttacacaaacaatgtaaaaccaggcgttgcaaaggttacagtaaaaggtataaataactacaacggcgagtcaaacctttatttccagatcaaggtaaagactgctccaaagtttattgttactgctatgcctaatggccggatcaaggtgacatggaagaaagtaagtggagcttccggataccgggtattctattcgaaagccaagagctcacagaaacagaagaatcttggaagtaagacaaccagcacatatctgacaggtttgaagagaggtgtggtctataagattggaatccagagctatgttaaaaataacgggaagaagatttacagtaaatctacaacgaagagcatagctacttcgaccagtcagccgaagataaagactgcaaagagcactggaaagggcaaaatcaagattacctggagtaaggttaaaaacgccaccgggtatatggtatacagaagaaaccagggatctaagaagtggaagaaagtaaagaccactaagtcgacttcgttcacgaatacaaaactgaagagaggcagaaaatactattataaagtggtttcttataagcagtacgacaagacaaagcgaagctacagcaagtattcgaagaccagaactgtaaaatcaaaataatattttacatcagaaggctctgacaaagttcagggcctttttgactaatatttccttccgtgataatatattctcaatgagaaaaaatgagatagatgaggccatgaggccttatatagaaaaagaaaagaaggttaagtcagaagagacagaacagactgatgaaagtcaggaagaggaagtttcaactgaggaagagactgataataagaaggatgaatcttctgaagatggaattgtcgaagtaaatggcatccgaaaattcaagctgggtgattactatttcgacagttttcatgaatacaggaatgggcaggctgacttgaagaagattcagcttatagaagacaagatcgatatgaaggacccgaaccttgtcttaaggctttaccagacgatccgcgacggagaaatcactttcaagacgaagattggtgaggactatttttcacatatcggagatctggtggctgacaagtcggttggacttttgaaggataaggaagtagttgacacagctgagaaaaaagttcgtccacagagatatatcggaatggtgactattacagcggctgtagttctcttctcttattttggattcaatcagcttgatgattatctgaacacgaggcgtttgaaggatctgcaagcgcagactactactcagaaggttgacagagcgggaaaagcttcggaagagaaatcggcagagcttaaaaacggtaatccgttcaagcacaaaaagactgtagacgagaaaaagcttactgtacttaaagattacagggaaatgaaggcccagaataagaaccttatcggatggctaaggatagatggtacagacatcaactatccggtgatgcagtccaaagataactcgtattatctgacgcactcgtttgatggaaagaacagtactgcgggtgctctgtttatggattacaggagcgatgctgtaaacccgactactaacacgatcatttacggccacaatatgaacaatggctcgatgtttggcagtctgaagaattttctcagtgaaaaatacttcaatcagcacagcaagataaaattcgatacgatatacgaacacagagaatacgagctggtggctgtctgtcttgcaaaagttaaagcttcaaaggacaatactttcagatactataactttattcaggcgaataacgaaaacgagtggaacgcttttacagagagtgtgggagcgatggtagtaaacggtggtatgagtgttaaggccggagacgagctgctgacactttccacttgtaacaactatatcgaagacggcaggctgtttttgcttgcgaaaagggttgaagggtagtaaaatagaaactgtatgaaattaattgtttacagatacagggcagcataatgaaaaagagtacgagaataggatggatacttatcactctggcactcgtgatgggggtctgggctttaacttctcacaattcacaggccgaccagacgacaaatgccggatttgtattaagcgatgatggcagcagattgaagtcatatcagggatctggtggttcggttacagtaccgagcggagtcacaactatagattccggagtttttgctaataatacttcgataacgaatgtcagtctaccgaattcagtcacgacactgggaagcagggtttttgctggtgctacgaaccttaggagtgtaagccttggcaatgttacgagtattccagcgcagacttttcagaactgcatgagtctgacacaggtatctataccatctacagttacaagtattgggagccaggcgttttatggatgtgcagcattgggttctgtctcagtgccggattcggtatcgagtatatctacagatgcatttggagagtgtaacaacctgacgtcgatttcggcatcgaacagcttctactcatcttacgatgggtgcttatataacgcttcgggctcaagacttatcctggttccaccgggaaagtcatcgatttcattttcatctaatatgaaatcgataggagcaggatcattttcatacaataagaatatccgcacggtttcggtgcctggcacagcagattcaatcgaagcaggagcgttcactaattcggcggtcaactctataacgattccaaagagcgttgtacagattggctcgcagggcaactggaagccaaatgagctgtatggctatcagaacagtgaagccgctacatatgcatcaaacaacggaatcacatttatagcattagatcctggtactaacagcagttcggatactgatgattcgaattcttcagatgattcaagtgatatttcgaataatgatgaccctgatgatccggaggatgaatctgatgacgaaagcagtgcatcaggtaatgcttcaaagaaaaaaaatggagcaggcgtacttccgaataaaggatccaaaggtggcggtactgcaggaggcggaagttctacggccggaggccgcggtggcagttacaacggaaaggatataacgccgaagaccgccgatcctaacttagacccgagatacgctatgtgcggagtgcttttattacttggtatttttgtaatggtatcgggaaataagaaaaaacttacactagtaaatcaagagaaagacagataataaataccccatctggtgaatgccagacggggtgtttttttaaattctatagaagcctatttaaaaataatcatttatagaggtcaagtgaaatcgtactgtcgctaagcgccagagcactgaccctgtaatccggcacaccactgcgatcagaggaaagcttcttgaaggaaatggcacggacagagacagaatctttatcagtagcagtagataaacttacaacgtctgattcactggaaagtgtatcgagtatagtatcagacgaaatctttgtaccatctgtcctgcttcgcttgaggacaagagaatttccggatgaagagacgcttgttataagaacgtcactcttctgatatttcttgatcgtggttagtttttcgttcttaaagctgacaatattaagagaactcatataacctttatcgagatttgcgaaatttactgtgccatatacaaggtcttcattcataaagcagagggctcttagacgatctgaaccagatgcttttatcttatatactttatcaagacttagatccaggacgctgatcgaggtatcgggcttttctgtggaagtccaagcgatgtatctcatatcgtcagaaacacaatactggacatccttcaggttctttatgattacatcagtcttttttgttgcaaggtcaataccgagcagatttctgttcaacaaacagtaaaaccggccacctgaagttctgtgcagaagctctgagaagttcttccggaggtaggacaatggctcggcgctattgataaatccctcttctgtagcaatattaagagaactgtcataatggtaaatgtcaattccgctttccccctcatggcttccgctgttcatataaccatagacgacgaagtccattgagccggaagcatctatatttaaaatctgaatatcatgatcgtttatcagtgaacgggggtcagttggatcatttaaaaatgagaaaaccgaagtgatcctgttttgatttacactgtattcaaacagcgcacctgactgaacgaatgctgcgacagaaccaggctcgttggaagatacaacaggtttctcggcggaagcacctaacaggagggatttattcttgacagagaagctgtcgtaatttggaataatatcgagctttctatcgaatgacaggaggtacatacgaggtgaaccatagcgaattcggtatttctctgtagtaagataagaggctttactgccatgctccaatatataggaaatattaattgaggctgtgtctctggtcatatttgtaacagcgataattggctcagacttaattttatgagagaatccgttcattccgatgtcatttatagacgaatgaatatttacatgtgagatatttccaccagacagatcgttagaaggttcgagatatctcgataaagaattgtaatcatcagaaagactcgtattgtggaaatcctgtgcgaaatttatgagttctttcatatgactgttctgtgagataacaatctggctgtagtaatgtatatcttttctgcctgaagtcagattaagtatcagtgtgtatttgacacctggattaagcagattcgtaaaggaagtgtcaaaggtgaccttcgaggacttcttattcagattactgatggaatctgtcgagatagttctggactctgaatcagatgagcgtatctcataactggctttttctatagagtttccataggtatttacattaaaagagagtttcctgtcggtatcaagaggaataagattgtcagtcatctcggaggcgttcatcttagaagtgtagccatggagaaggagctgatctgtcccaaagctgtttacagaaacagtcgggagagtcggtgtgctcatctgggaaacatttggcgtagtgtgccgatttaataaaatatagaaaaaaacaagagcagcaagaaaaacaacgaccaggaggatgatcctgtgtttggtgctctttttcattcctgtagttctaaatttaagagccataattctcctttacataaaatgtgcgagaacaaatctggtacagtaagcggcgactataatgataagaccggtaacagagactgcggaaattttttcatgtagaaagatagtagccaggataacagtgattacgatccagagactgtaaataaggtttagccacaaatcgtagctgcagagtgcatttgcccgggacagggcaagtggggcatagtaaaatgctataccagctaagattgcaaaaagtacgtggtaggctgtgatcttcttcaagtccttgtggtggataacaaaagacagtataagagcaacaagcactactacaaacatagatgccgtctgctgaaggtcgccgataggatttttattcacatatagcttctgggccgcaagaaaggctggacctaccagagcaaaaagccaccataccgaatgtttgtggtggatgccaaatcccatcaaaaggacgccgagtgtgatcatgatatttacaataagaccaggtataccgggtacctttttagataaaacagcctgagccgcatacacaaatacagctgtaagcagataaaatggagccgtcgaaagaacttccgttacctgaaatgccaggcagaggaaaatacatccaaggcttagaagtacacctgagataataatgtcaattatattaccatgagaaaaatgttttgcactcttgaaaaaaccattgaacgagagagtagtaaatgagagcacaagcatagtgattccggcgataagtactgtctgaggcgcagaaagtccctccagcgagattttcgcaaaaacagcgacaaatcctgccagaagcagggcaactatgaaaaatccgatccatccggatacaattcctgaagacatttacataaatcctttcacttgaaaccttagccttcctattatataatatcaaattgcgagaatcaaactattttgtttggaggaatcattttgaaaagcagatggaccagattttccactttctttgaaaagtatgcactaattttacatatcccactggcgatgcttttagttctggtaaatgaatcactgagcaggcattcgctgattgaaggattgggctttattacgaatcacccgggaccttttctctacaacagctatataatctatgtgatattactgctggtatttttgtcaccgagacgactttttatgcggctcgtcatgatggcaatagtcatactgttcggaataatcaactgtataatcctaaataaccgggtaacaccattcggatttacagattttgcgatggtcggcgacctgctgacgatgcagaacacgaagtattttacagcgcagcaggcgggtatctgccttatcgcaatactgatctttgtattcctgatggtcatgcttcatatgcacggcaaaaaacagaaagtgcgctcgaagctatgggttagaatattaacttgtgctataggattcgcaagtcttttccctgtgacaaagatttgtcagaaaacaggagttgttcagacatactttggaaatctggcgcagggatatctggacaacggatatgcatacggctttgctatgtctgttgcagggcgaggcatgaatcaaccgacgggctactcagcaaaatcagtagagaatattgtagaagataccagtaaaggcaagtcaaagatggggaaggtcaagccgaacgtcatcgtagtgctgcttgagtcctgttttgatgtgaacgagtacccggctctctcctacaataaggacccgattccatattttcacaaactggagaagaattactcgacaggacatctgactgtgcctgtagtcggagccggtacctgcaataccgagtttgagatgttaaccggcatgagctgcaagttctttggaccgggcgagtatccgcagaagacagtgctgaaaaagcgcgactgcgagagtacagctgatgtaataaaaaaactcggatacggcactcatgtcgtacacaacaacggcggaaatttttacagccgtgccaatgctttctctaagatgggatttgatacattcacttcgaaagagctgctcgacataactgactacacgcctttaaatacctggcctacggacgatattctggtaggtgcgacgaaggatgcactggattcaaccaagggtccggattactgctatacgattactgtcggtactcatggcgactaccctaaagagaaagttattgagaatccgaagatcaaggtaaaggtaaagggtgtgagtgaggaaaggcagaaccagtgggaatactactgcaatatgcttaacaatatggaccgcttcctgaaagagtacactgcgatgctttcaaagagaggcgagccaactcttctcatatgctttggcgatcatctgcctacaatgggcctgcagaacaaagatgtaaagcagaaggatatttaccagacaaagtacattacctggaacaacttcggtatgaagaaaaaggaccaggatcttacagcctaccagctggtttcaacgtactttgacaggctcggtattcatggcggaacagttgtagattataaccagaccatgacagagagaggaatcagtggcaaatctcagaaatacttaaagaatctgcagatgcttcaatatgaccttctctatggcaagagatacgcctaccacggtatagacatgtatccgccatcagacctcgttatgggcatcaggcctgtaaagatcgaccgaatatacagttacgataatcaacttcacatttatggggagaatttcacaccatggtctaaagtatatgtaaatggtgaaaaagtaaatacgacttacgaaagcggtcaggttcttacaataaattcaaaaggtgtatcgaatggtgcgcacatagttgtaaatcagatgggctcgaataacacgatattcagaagctctaatgaattcgagctgaaactggcagctgaagatcaacagtaaaatttatctattaaagcaaaatccccctttaccggcagtccggtaaaaggggattttgttatataaaggggaaatttaatctgtaatcaatactcgccttttctatacttcttcagaaggttgttgatcctgtcatagggatctagaaggtgagaaatcgagcagtcgtgatttaaagtatcgataatgtaggcgatgtacttgcccatgtcacaactgatgtagtagtccctggagagaagttccggtgtctgataaatgagatttgtcgtaactaccttatagatgagaccatcctctacggctttgtcgaacttctcaagaccatttgtaaagagaccaaaagtagcaacacagaagatacgtctggcttttctcatcttcagctgtctggcaacgtctatcatagattctcctgaggagatcatatcgtctactatgatgacatccttgtcttcaactgatgagcctaaaaactcgtgtgcaacgatagggtttctgccatctacgatcttcgagtaatcgcgtctcttgtagaacatacccatatcaacgcctaagactgtggcaagataaacagcacggctggtaccgccttcatcagggcttatgatcataagatgatcgttgtcgatctttaagtccttgactttcttgcagatacctttgatgaactgataggcaggctgcacagactcaaaaccatgtaaagggatggcattctgtactctcgggtcatgggcatcgaaagtgatgatgttgtcaacacccatatttacaagttcctgaagtgccatagcgcagtcaagagactcccgcgatgtacggcgatgctgtctgctctcatacaggaaaggcataatgacgctgattcggttggcctttccgccgaccgcagcgataacacgcttcaggtcactgaagtggtcatctggtgacatatgattttcgtgaccgctgagagaataagtaaggctgtagttcataacatcgaccatgatgtagagatctaagcctctgaccgattcattgatctgtccctttgcttcaccgcttccgaatcggggcgttgaaatagaaatcttgtacgaatccgtcgtgtagttggctttgtcaacgacatcgaggtgatccgatttgcggttcttacgccatttgaccaggtaggcatctacttcgtcccctaaaggttcgcagctcttcagaggtatgataccgagaggggctacaggtttgcgtcttgacagaacatcgtcattgagtggcattttgttcctccattaatctttggcaggtttcatgtcttttagtttgttctcgatcctgccatcgaaaccaaacagatgataaaaattatacttttcagcgaggcgggagaagactctctgtgagtagcggtccgaaacctcgtttaaagtcagattggtggaaatgatcgttgacttttcggtcagcaatctctcgttcaggagggaaaaaagagcggatgctgtgaatgtattcgtaacttcagtcccaaggtcatctattatcagaagatcagccgaaaaaaggctgctgtaggcatagtcatcacggttctttctcggattaaatgagtaatctgccataacatcaaacaagcggacggcagacaaatagatcactgtatgatctgtctttataagcctgctagcaatgcagctcgaaagaaatgtctttcccgaaccgggtgttccgtagaaaaagagattcttaaaatcgctgtcaaatgtctctacaaaacgccggctctgtgaaaatgccttgctggcacattcgtaggagctgataccggaactgtctttctttgaagtatagccggaaaggtcaaaatcctcaaaactgtcagtgaggattctcctcataacaggctcgtccttatagataagatcgagtgcgtattttttaaaacagtggcacggctcgtcgtgattctcaccaacatagcctgtatcgtgacagtcaggacagtggtaaggcggatcaaggtagtcctcagggtatccgtgttcaagcaagagatgcttctcctgatcgataaatttcgctgtgagtcctttgtaattcatatggagaccacgtttgcggccggcactcctgaaagaatcctcgagctgagaaagttcaggtatattcttccgaagctctgtccgacgggatcggatcagctcgtctctgtcctgccttgcctcacggtaaatctgcatgatgtagttgtactgagtgtctgttagtctcatctttaaaaagtgttattcttcaggagcatggcctcaatggctttgctgtcgtaatcgttcttctcagagtaggagttaaagcagttcttcttaggagcctgtgtcttaccggaagcagatctggatttaatcttctctgaatgcttcctgtcgtcttcggcagtctgagacaggtcagtatagcccttgtcatgccaggtgcttaggatctcattaacgtagttccagttcgaagtgccaatgcttgtccgtgtgcggttacaggcgtcaactaccatctcctgcgaaaaatgccactggttgaaccacttgtcgatatattcaagctctgccggagcgagattcccagagacaccgagtgccttctttacagcaagtgcgtttgcactgtgctgcttcttctcgtccatggcttcctttacagtatggatgccctgcttgtaccagctgatcgcgatcttgttcatgtagttcatgatgttcatgttcgaagaacgcttgcctgcatctagtgtgctggtaataaggtaatcgatcatatcctcgttcatgccgagctcaatatgccagtaaaggatcatgttcatgccgttgttgttcagctctttcccgagatagcgctcggcaataaagagaatctgactgagctcaggatcggagtcgaggtcgtagctgctcatatcatgctgggcagcaggcggaatcccgcctccaatagagtcagaatctgcactcacgggagagtttgtatcctcggatgaggacattatagcagatttggcaaccgttttcacagcagaattggaaaccgaatcaaaagaggtggtttccttactggcatgagaaacaggcctgtcgcttgtcaaattaaaactcagctgtccatcattctcttctgtcacttctgtagagagtggcagcatctgaatatcgcagagctcgccctcatcatcataaccgagggtgacgagacctgctgaggagagcctgtcaagtgaagtgcggacttttcccgcactgatgccaaggcgctcggcggctgacgagacagaaaacacgacacctgtaccgtaaatgcagcgcaggagcataaggtataccttcagctcgtcgccgttcagaccgctcatgtagtgatcgataaaattatttgaaatacacgtaactgtggcaagtgaatctgcgtgaagattgatagaagccatccaaatatcctttcgttctaactcgcggtcattataacacaaaggattttttaaaaaaagtcgcgacccttcaacaacagcggtgtacagccattgtggataatgtggaaaacttcgtgtaaatctcttgaatacggcgtttcaaatccacactcttttgttgctgctttttacacaaaaaatgtggataaagtggataactagtctttaatgagcgcttcgcccactttatagatgtctccggcacccatagttatcaacaaatctccgtcgataacattttttgataaatatttttcaatctcgtcgaaagtcgggaaacactcgcacggagttcctagttcgcggatcttctggcagaggtctatagaatgtactccatagatatccttttctctggcagggaagatctctgcaagtactacctgatcagcgactgagagtgcattcgcaaagtcattcaaaaatgccctggtcctggtataggtatgcggctggaatactaccacaagcctcttgtgagggtatttctgtgctgcgtcgagtgaggccttaacctctgtaggatggtgggcatagtcgtcaatgactgtagctccgtggtatttgcccttatactcaaaacgtctcttcgcgccgccgaatttctttaagccatcctttatctgatcgagtgtaaagccaagctctctggctactgcgatagccgcgagggcatttccaacattgtgtcttcccggaacggacagtacgatttctccgaggtcatcgccaaatcctacaacttcaaaacgggcttctccggtctcatcgtagcggatattctctgcatggtaatcggcaccttcattgaatccaacagttatgacacgggcccgaatgccatctactatctctctatagttcggaatctcgtcatttatgataacagctccgtctgccttagtgtcagctgcaaactggtggaagctgtttctaatgtcatttatatccttaaaaaagtccagatgttctgcttctacatttaaaataacactgtatttcgcatagagctggagaaaggagttcgtatattcgcaggcttcggtcaggaaaagatcggagtcgccgacatgaatattggaatttatcgccttaaagatgccgccgatagagagcgtcgggtctttcgaaccttcaagcataatctgggagatcatgctcgaagtcgtagtcttgccatgagttccggcaactgcgacgctgttcgggtagtgcttcatgatctggcctaaaagctgtgcgcgagtcatcatcgggatatttttatcctgtgcagccttgtactccgggttatccggatggatagcagcagtgtagactacacagtctatatcatctgtgatatttgatgcggcctgaggataaagcaccttcgcaccgagctcagtcaggtggcgagtcagatcactttcggccctgtctgaaccgcttactgtgaaatgcctgtcaagaagtacctcggcgagtccactcatgctgatgccgcctatgccgataaagtgtacatgtaccggtttatcgaaatctatctgatacatttgaaaagtctctctttcctattaaatgctgtttttgttattttcgtgttaaggatacatcaaatcatttaaaaagacaagatatcaggcactgtatcattataagtgcagacttatatttttatgacagacaaactgtaaaattaggaatatttcatcgtgctaaagtgaaaaaatgatataaaaaccttcaaaaaaagattgacagatgaaaccggttaagctatagttattcgaagggattttcaggtagtttggaaaaagattatttgtgttaggaggttactagcatggaagaagaaaagactgaggctttggacgtcaagagaagaggtcgtccgagagtagcaaataagaagaagcagtacactctgactatgaggccggatatgtacgaacaggcacgcgaagaggctgacagaagaggaatttcgttttcagcgcttatagcgaatgctttggtagaatacttagataaatgaatcaaaggaagccgccgtcagcgccgaggatctgtccggttacataggtcaggttcataaggctccaggcggcttcagctatttcttcaggtctggcgaaacggcctatcgggatctcttcacagaggtcctttttttcttcttcagaaaaaatggcgttcatatctgtatcaacacagcctggggcaatggcgtttacagtgatgccggacggggcgagttccttcgccatagcacgtgtaaggaggtttactcctccctttgtggctgagtaggcagcttcgcatgaagcgccgctggtgccccacattgaagagatattgaggatagaaccggatttctcgtggatcattgttgggagaaatgcgttcatagtgtaaaaaacggaagagagatttacggacagtattctgttccattcatcattcgtcatatcggtcagcagtccgacgatagagattccggcattatttacaagataatctattcgcgggaaatgagagaggatatcagatgccatagcggatacagaggccggatcgccgacatctgtcttatatgtatagaccgtaatacctgattttctgcggagacctgcagcgaattcattcaggctctctatgcttttttcacagcagatggcgagactgacgtgttcagatgccatcttttcggctatggcccggcctattccgcggcttgcacctgtgactatgccatatttttctggaagctgactctctctattgtttaataaatctttcatttctcgttcacaattaaatcacaaacaacttgtattatataaccatcaaaggaaataaatcctttgatacggaaattgttttcgtttttcatactccccctcttttacaaggaccgccgcaaggcggtctttttttatcccatcatatctataatctgatcgcggacacggtttggaagctcttttatctcttcacggctcatgtctctggtctctattggctctccgaaggtgagagtaacgtgcgattttttaatatttgggaaatggtattcgaggatatcgcgggtaccgttaacagcgaccggaacgaccgggcacttcgctttcgtcgctatcttaaatgagcctgcatggaattcatggactttgccatcctttgaacgggtgccctcgggatatataaaaatgctgactccgtgctttatttcatcgatggactcgagaacagtattgagtcccgagcgaaggctcgagcggtcgatgcctaaacagtggagacgcttcataagccagccgagaagcgggactttgaaaacattctgctttgaaataaatccggtaagccctggaagccggctgtacgtcactactatatcgaaaaaactctgatgatttccgatgtagaggacaggcctgtcttttggaatattttcaagcccctgcactgtgaccgtagatcccgacagcttttcaacacagcggaacatccactgcacatagcaaaggatcatcttgtcacgcttctgcttgtcacgaggagcgatgagccactgaatgccggaaaccggcagagagataatgagaaagactgcaatatagacaagagttataatagtacgcataaaaactccataaaataacagaaaaaaaggcggcaggaaaaactccctgccacccgaactggcggaataaaatgagatcagaactcaggctctataagaccgtatgtgttgccacggcgcttatagacaacatttacctcatctgtctcagcgtttctgaatacgaagaaatcgtgccccaaaagctccatctggacgcaggcatcctccggatacataggcttgatgccgaaatgcttcgtacgtacgatcttaatcttcgaactgtcgtcatcgtcatctacatctacgtcgtcgatgaaatcttcctggaagaagtctgcaggttcctgctgcttggtgacaagcttatgacgatacttctgtaactgcctctcgataacctcctcaacaaggtcgattgatacatacatatcattcgatacctgctcagatctgattatagaacccttcatagggatcgtaacctcgatcttctgcctgtccttctctactgagagagtaacattcgcgatggtatcatcagcgaagtacttgttcagctttgaaagcttgtcattgatggcagccttgatgccgtcggtcagttcgatgttttttccagtaatgttgattctcatagtgaaaacccccttttctattagattcacggggtaaaaaataccctcgcattattgggttgtcatgtatttagtataacacatatcgaaccttaaaacaccataatttttggtgaatttttcatgaaagttgaaaatgaaggcggattgggaatttttgagaataaatagcggatcatcgagacgatctcggtgcatctctcatttaaaccacatcttttataatagtaatattcgcatcgaagatctttgcagaacagataaaaacctccggaactcgtaaaaaaggccggaatcatgtcgagatgccgcctcgcctcggccagatcgccgtgagagtattcgaaaaaaccaaggtttacgagaaggcagatcagggcctctctctggtaaaacaaagaattgcggcgtttttcgacgcatataagctgcccgatcagctcaatggcgcgccggtagagcacctcctgatgagtctcgatcattccgcaggctatggcgttaaacagcatcagctcgattgtagtcgggataaagtcgatctggcctatgtcgcggctgatggaaggctgtgtaaattttaaaatggtgtatgcgttctcacacagtgtcagtccccgaaacgtatcattcatattgtaatcactcatcaatgcaaaaaaagaaataagctgcatctcattgggcgacatcttctggtgctgcccggagtaacgggaaactatgtcactgactttttcccagtggtcgagatgactttcgttctgcagtacgagcattactgcgaactggtcggagatcgggtcgatgtagagatcactgtagtccaaaccgctctcgtgcattttttccataagaagagaaaactcttcgcgggtcggatgctcctggcccgattcgatgcgcgaatacctggcgggagaacagataccataagacaggtcctcctgggtaatgccgagacgtaaacgccagactttaagcgtctggccagggttcagattgttgcttaaattgtccgttactgtactttccatattttctatactcctgtttcctcctgacacaaagcgacagtaaacagcttaccactaatgggtggtgccgtgctttggtaaaataaaaattaaatttacgtaatatttcaagaaatatatttcaaagctatttcaaatttttgacataatccgaataaaatggtatactatatcttgtgttttttgaagtcaccactttcggttattagaagaagggactggaggtattttttctaatggaacagtcagagtacaacaagatccgttattcgatccagcagcagtgcggaaataaagtaaagattcagctggatagaggaaggaataaagtcgacgtacaggaggggattatacaggaagcttaccctagtgtatttacggttcttgtgtccgatgatgatgtggagcatccggatcagttactttcattcagctataccgatgtgatcacgaaagaaatccgaatggagctcgtataagagaattgagctgataaattgacagagagcggttcgccgccctctttttttttacaaaaaagcgtgttataattactaccaaatgcggttttgatatacatatgaggtgcaaatgaaaaaatttacagctttgttactggcttgtgtaatgatggcttcaggtacattttattcgccttacgtcacagcacaggctgccactaagacgaccaagaagataaagactctcgagaagaagaagaagaaagcccagactgaggtcaacagcctccagtcgaagctggtcgacattatttcgcagatcgacggtcttgaagacgatatcaaggccaacgccaatgatattaaggatacgaaggctgaggtcaaggaagccaagaaggctgagaagaagcagtacaatgctatgaagtcacgtatcaggtatttttacgagaacgatacgaataataatgtcttcaacatccttgtcggttccaagagcctgactgattttatcaataaagtttcctatatgaactctgtctacagctacgacagagaccttctcgattcatacgaggctacgagagttgaaatccagggaatggaagaggacctcgaggacaaacagctgaacctgaagaaggagaagcagcagctgaagactaagaaagccagccttaattcactgatcgaatccaagaagggcgaagtggccaatcttggtgagcaggtaaagaaggccaaagagcaggcggccagagaagcggcagcgagggctgcagctttagaggctgagcgccgcagaaaaaatgaagcggcagctgcggctgcagcagctaaggcggcgaaagctgcggaggctgcaagggcggctcaggcggcaagagcagctgctaattcagcagcaaattcgaattcgaatgctgcaaacacgagcacgaatacggcaaatacagattctaacaccgacacgaattcgaatacttctgtcaatccagcgccggttacaaatgtaagcggttcttcggtagcgtcatttgctaaccagtttgtcggaaacaagtatgtatggggaggaaactccctgacgaatggctgtgactgctcgggttttgtcgttcaggtctacaaacatttcggtgtaaatctgtcaggcgccagaaactccgcggcactgcgttcggtgggacaggctgtaagcccaggcaatattcaggctggagacattgtatgctatcccggacatgtggctatttacggtggcgccgggaatattatcgaggcacagagcactaacgcaggaattacgaataacagggcctggaaccatggtacagttcttgcgataagaagagttctatgatggaagcttttagaagctgctgcagaaggatacttgcgaagacgaagaagggcctgccatgggtcattgcggccgttctcgtagttgttattctgggaattggtgtaaaggtcggtgtcgagcagcgggcaaagtttatctacaaggatcatctgaacgatacggctgttacggtcgacggagaggcccttactttcagggacctcgcgttctatgtggtctatgaggagaatctcgttcagaaaagcgctttagtttacaatcaggaagcaccggcggattactggaattcacatgttaatggcaaatttataaccttggaagccagaaactcagtgatgaaaatggctgtccacgacaggatactgcttcggaaggcccagtcgaagggggttgtgcttacgtctgacgagaagagcagacttgaaaccagacggaccgatttttacgaagacctctatgacgaccagaaggagcgccttccagtgtcatattcggtcctgaatgacacaatggaagatatagcagtggtagagaagtaccagcgaatgctggcttcggagcgaaatgacacctatgcaagcttcgactacgatgggaaaaactacagagccttaaagaaaaaacatgatgtcgagataaacacaaaactctggaacagggtttcaatagggcgtgttactttaaacaatgcgcctgattatcaggcagctaaaggcaggcaaaattatcatatagaaggaaaaaaatgaacgcatttttaaaccaagacaagagaaaaaaagaagagaagattggaagaaatgatccgtgctggtgcggaagcggcaggaagtacaagaactgccacgaggctttcgacaggaagatcgagaagatcaggcttgaaggtcatgaggttcctcacagggatatgataaagactccggagcagatcgagggaataaagaagagtgcagtcatcaacatggcctgcctcgatgaagttggaaagcagataaaagagggtatgactactctcgacattgacaacattattaatgaagtcacatatggtatgggcggaattccggcctgccttaattacgagggctttccgaagagcgtctgcacatccattaacgatcaggtctgccacggcattccttcaaaggacgtagtattacacgatggagatatcataaatgtcgactgttcgactattttaaatggctatttctcggattcatcccgtatgtttatgatcggaaacgtttccgatgagaagagaaagctcgtcgaagttacgaaagagtgctgtgatcttggacttgcccaggtcaagccatggggtttccttggagatatggctgaggcagttcacacccacgctgaggagaatggttacagcgtagtcagagagatcggcgggcacggatgcggagttgaattccacgaggatccgtgggtcggctatctttctaaccgcggcgaggatatgctgatggttccaggcatgtgctttactatcgagcctatgataaatatggggtcagcagatatttacaccgataaggaaaacaactgggaagtctatacgctggacggcatgccttcggctcagtgggagtaccaggtactcgttacagagactggagctgaggtcctttcacactgactttgagcagattaaaataaatctgctatcttgtcagatttttttgcgaaatacagcatctagacaccgaaaagtatgcggagaaaattgtacatttttttgacacaatttactacaaaattgtcttcagagatttttttataaaaagtcttgcattttttcagacgatgtagtatattatgttagaaccaactaacgttagtaaaaactaacacagttgcctccactacatacttttcatacatacttttccagttgaacttcggctttggccggagttcttctggtttatggggaatatcatgaacaatggatttacgtcgaacctgtctgaactcggtgaattcactgagctttctgatgcgctgaagaaaggcggtatgtatgaactctccggcgtgctcgatgtcgcaaaagggcagatcatcgacgcgctgggcgaagtgactggcagccggcacaagctggttgtctttgcgtctgagagagcagccgaagagtttgctgacgaatacaggcatatagaggaaaatactgtctattttccggcgaaagatgtgctattttatcagtcggatgtcaagggaaatactctgaccagggagagactgcgcgctttaagagtactgaatcaggaagacagcgctacggtagtcaccacggtcgatgcgcttatgaacaggctcccggagcctggtgagctgacggatgcaattgtttcgatagaagatggcgaagagtatgatttttcggcgcttcagaggaaatttgtcgacctcgggtacgaaaatgtgctgcaggtcgactctccgggacaattttccgtaagaggcggtattatcgatatttttcctctgactgacgagacccctgtgaggatagaatttttcggcgacgatgtggattctataaggacttttgatgtcgtaagccagaaatcggatgacaatcttgatcgagtgcttattgatcccgcaatggaacttgtccttacaaaaaagaagctcgaccggggacttaagcttttaaagtctgattacgagagccggtacaaagagctcaggtccgacatgaagacagaggagtcctttcgactgaagacttcatacgaggatttaagagacaggcttttaagcggcgattatacgcaggctgacggctttctcacttacttcgaacaggataccgcgaaccttctggattattttccagaggatacgcttctgatactagacgagccggcgagacttaccgagaggggcggagtattagagaaggaattttctgaaagcatgcttcgccgcgaggagaacggttcggctcttccggggcagcttcagatgctggcttcatctaaggaagttctcgcgagatgcatgaatatgacaggcgttatgctgccccagatcgggggaaatgacggcggactcaaggcagatgacaggttctatctgcatcagatctctgtaaacagctacgaaaattcactcgacaatttaaaaaaggaactcgtttcctatcagaagaaaaaataccgcgtctatctgcttactgcatcgaggacaaggggcagcaggctcgcttcggaccttcgggaagaaggactcaatgtatttttttcagaaaaggaagatgccgaggtgaaaccggggcagattctgatcacgaccggatttatccgaaggggctttgaataccctgatatacgagttgtctatatcagcgagagcgatatttttggcgctgtaaaaaagaaaaaaaagaagaaaaaacgctacggtggcggagatgctgttacaagcttttcggaacttacgccgggtgactatgtagtacatgaggaccatggcctcggaatttacgagggtgtgaaaaaaatcgagcacgaccatgtgacaagggactatatcgaaatttcctatgccgggggctcgacgctctacattctggctacacagcttgataccttatcaaaatatggcagcatcggagacaaaaagccgaagctcaattctctcggcgacggcacatggaagaagactaaggcaaaagtaaaacatgcagtcggcgaggtcgccaaggacctggtagatctctatgcgctgagacagcagaaccagggctatgtctatggaccggataccgagtggcagaaggagttcgaggagtcatttccctacgatgagaccgacagccagatttccgcaatagaggacgtaaaatccgatatggaaagcccgaaaataatggataggctcgtatgcggggacgtaggctttggaaagacagagatcgcaatgagggccgcatttaaagcagtccaggagaacaagcaggtcgtctacctcgttcctacgacgatactcgcccagcagcactacaacaatttccgcgaacggatgaagaactacccggtttcaatcgggatgctttcgagatttaacactccggcgaaaaacaaagagactattaaaggcctgaaaaacggaacgctcgacattgttatcggaacgcacagagtcctctcaaaggatgtgggattcagggaccttggacttcttataatcgacgaggagcagcgcttcggtgttgcccacaaggagaagatcaaggagctgaaaaagaacatcgatgtgatgtctctctccgctacgcctattccgagaactctccatatgagtatgacagggatcagggatatgagtcttctcgaagacccgcctatggacagaactccgatccagacatttgtatttgaggaaaatgaggagatggtccgcgaggctgttgagcgggaactcgacaggggcggacaggtctactatgtcattaacaggataaatcagattgcggatgtcgctgcgaagatccaggagatggttccggatgcgaatgtcgcctacgcacacgggcagatgtcgaagaaccggctcgaggagatcatgacggactttgtcaacagggatatagatgtgcttgttgcgacaacgatcattgagatcggactcgatatcagcaatgtaaatactattattatccaggatgccgacaaattcggactttcccagctctatcagctcagggggcgcgtcggaagaggctcaaggactgcgtttgccttccttatgtataagcgcgacaagattttaaaagaggttgcagagaagagacttgcggctataaaggaatttacagacttaggcagcggatacaagatagcgatgagagatctcgaaatccgcggcgcagggaacctgctcggcagagagcagtcggggcatatggagtcggtaggttacgaactctactgcaagatgttaaatgccgccgtcgccagagagaaaggccttaatgtcggagaagagtacgagacgacagtcgatatccctgtaaacgctttcatacctccttcatatattaaagatgaggagacgaagctcgatatgtacaagcgtatcagctctattgagaccgaagaggatgaaagtgagatcttagacgagcttattgacaggtttggagaaccggcgaaatccgtacaaaacctgctgctcgtggcgcgccttcgcgctcaggcccattcagtatatcttacaaaaataaagcagtcgggctccgatgtcgtgatgactttctgggacaaggcgaagattgatgtttcacgtatttcagaggttctggatgcgttttctccgtacctgacttttgttccgacaggagagacaccggcgcttatcttaaagaccggccgtgacaatcgttttccaaagggcgatatcctgcagtatctgctgaatgtatgtgaaaagctgtctaccattctgcttaaatagatggtataataaaaactatatgaaaaaaatagcacttttgatggatagctggcaccgctatatggtggcggcctgggctatcggcacagtacaagaactgaagaagaggaagatagacgcctgtctctatattttctgctgtgcagggaactggagtctggatgaggaatacaacgagggcgagcatggcattttttcactgccgaatttcaatgagtttgatggcgttctggttgatttcagtaatatgctctctgacaacgaggaacagatcgttactgagaggataagatacagtggcattccggctatttcactccagaaacagatagagggatttacctatgtcggacctgataattactctgcgatgcgccagatgacagcacatctgcatgaagtacaccatatcaacaaattctggctgatgatgggtccggaggaaaacttcgagagcaacgtcagagagaaggctatccgggactatatgaatgaaaagggcataagtctgggaaagaacgatgcaatacatgttgatttcgactatcaggccggagtcagagggtatcgtgagcttagaagcacccacagtgatctgcccgaagctataatctgtgtaaacgacaatcaggccattgcagtctgcgaagaggctgaaaaagatgggctgaaagttccaggtgacttcgctgttacaggctttgacaattttgacaaagctggtttctattcacctaggattactacgatgtccaacgtccgtgaaaagcttgtggcgaaagcggtggacgctcttattgacgtgtggaatggatatcctgctccgaagaaaatttacaatactgtcgattttctgacgtacgagagctgtggctgccatccgcgtcatgcagacatcagagcaaacctgaaaaaaatggttcttgagaatatcaatcaggacaagtacagcactgaacttctggaactcgagtctgttatgtcgatgtgtcactctgttaccgaggtggcggaggaggcggataagcaccttgagctgcttcgtggggatgcattctatatgatggtggatccgaaactctttgctgagctaagtctcaatggagtacttccgaattccagggagaagcttactgccagcttctgcaggggctgctatcctcttcagatggagatagtttaccctgcccccttggactaacacggcccagactcctacggagcagcagtggggaatattgcacaatggaggaaactctgatgcagcgacgccgcgtgagtgatgaagtatttcggtatgtaaagctctatcagcagggaagataatgacggtacctgactaagaagctccggctaaatacgtgccagcaccgcggtaatacgttaggagcaagcgttatccggatttactgggtgtaagggagcgtaggcggtcttacaagtctgaagtgaaaaccctgggcttaaccctgggattgctttggaaactgcaggactagagtgtcggaggggcatgtggaattcctggtgtagcggtgaaatgcgtagatatcaggaagaacaccagtggcgaaggcgcatgctggacgataactgacgctgatgctcgaaagcgtggggagcaaacggattgatacctggtagtccacgccgtaaacgatgaataccagtgttgggtcccattgggattcggtgccgcagcaaacgcagtaagatttccacctggggagtacgttcgcaagaatgaaactcaaaggaattgacggggacccgcacaacggtggagcatgtggtttaattcgaagcaacgcgaagaaaaccttccaggtcttgacatccttctgacagtgatctgtaatggaacatttccttcgggacagaagagacaggtggtgcatggttgtcgtcagctcgtgtcgtgagatgttgggttaagtcccgcaacgagcgcaacccttatcttatgtagcccaattcggatgggcactcatgagagactgccaggtgaacctggagaaggtggggatgacgtcaaatcatcatgcccctttgacctgggctacacacgtgctacaatggcgtaaacagggaagcgaagctgtaaagcctggcaaatcccaaaaataacgtcccagttcggactgtggtctgcaacccgaccacacgaagctggaatcgctagtaatcgcagatcagaatcgtgcggtgaatacgtcccgggtcttgtacacaccgcccgtcaccccatgggagtcgggaatgcccgaagtcagtggcccaaccgcaagaggagctgccgaaggcaggtctgataactggggtgaagtcgtaacaaggtaccgtagaacctgcggctggatcacctcctttctaagggaaaacgagtagggattgtttcactgtccagttatcaaaggggcaggagctccgaatgataattcaacacttctggtgccgatgcgttgcgggaaacacccgttataacatcccgaacacgatggttaagacgcagacgccgatggtactgctggtaacggcatgggagagcaggtgggcgccagaatttctgacaaaggcagatggatgacatctgatggacataaaggtcgctgacagcagaagctgtgacagtgatcagagcttcaggggataccctgaagaccctgagactggatgaccagtcggaagtaccttgaaaacttcatacattattagtatatctaatgcaatgtttagtatttctactaaagaaatgctaagacatccgagtaaaaccaaagaggtctttcagagagatctgaggaacacaaatgcttttaaagcaaagatcaagagatgcaacgctatgcatcgaagaatcagaaaagactgatcaagcgaaaaagagccagggtggatgccttggcaccaagagccgatgaaagacgtgataagctgcgaaaagctgcggtgagctgcacataagccatacccgcagatgtctgaatggggaaacctgctgcgagcgatcgcagcgtcataacgtaaatccatagcgttatgaagggaacccggtgaactgaaacatctaagtagccggaggaaaaagaaacttcgattccgggattagcgcgagcgaaaccggaagagccaaaaccacggtgcgtgcactgtggggttaggaccgcataaatgatccgttgatcttagcagaactgttttggaagagcaggccgtagagggtgagagccccgtagcgaaggagagacggcatggcggtatccagataggacgggacacgagaaaccctgtcgaacatgcgagaccatccgtaaggctaaatactacttggtgaccgatagcgcatgtactgtgaaggaatgaaaaggaccccgggggagtgaaagagaacctgaaaccctgtgtttacaaacagtggaaggccgcaaggccgaccgcgtactttttgtagaacggtccggcgagttgcgcggactggcgaggttaaggcatgaagtgccggaccgaaggaaccaagtcttaacagggcatcaagtcagttagtgcagacccgaaaccgggtgacctacccatgtccaggatgaagccgccgtaaaaggcgatgggggtccgaacgcacacctgttgaaaaagatggcgatgaggtgtgggtaggggagaaattccaatcgaacccggagatagctgttctcctcgaaatagctttagggctagcctcggtgcagtttatggaggtagagcactgaatttccgcgggagcgtcaaagcttaccaaagaatatcaaactccgaatgccatgtagatgatcaccgggagtcagactatcgagatagttggatggtcaaaggaaacagcccagaccaccggctaaggtcccaaagtgcgtgttaatggtaaggatgtggatttcaaagacaaccaggatgttggctcagaagcagccattcattcaaagagtgcgtaacagctcactggtcgagaggtcctgcgccgaaaatgtccggggctgaaacacgacaccgaagccgtggaattataataattggtagaggagcattcaggagtcagcgaagctgtaccgataaggagcagtggagatgcctgaaagaatgccggaaggagtagcgagaggaaggtgtgaatccttccggccgaatatctgaggtttccagggtaaagctgatctgccctgggtaagtcggactaaggcgaggccgcgaggcgtagcgatggaaagcaggtttaagttcctgcaccctgtacagacagaactgtggggacgcagagggaaagcgcgacgggaatggaagaccgttgcaagcagaggagcgcatgggcacaaatctcccatgcaagccagctgtgatgcggagcgaactataaagtacgcagcgcgtgagccagcggccagaaaagccgctatcgttctgttgggccctaccgcaaaccgacacaggtagatgagagagaatcctaaggccacggaagaagcattgttaaggaattcggcaaaatgaccccgtaacttcggataaggggtgccttcagagatgaggccgcagagaataggctcacacactgtttagcaaaacacaggtctatgcaaaccgaaaggtgaagtataggggctgacgcctgcccggtgctggaaggttaagaggagaagtcagcgcaagcgaagctttgaattcaagccccagtaaacggcggcgtaactataacggtcctaaggtacgaaattccttgtcgggtaagttccgacccgcacgaaaggcgtaatgatttgagcactgtctcgacaatgcatccgttgaaattgaagtaccagtgaagatgctgttacccgcgccaggacggaaagaccccatggagctttactccagtttggtactgggattcgggttgcatgcacaggataggtgggaggctgagagacgagtgctccggcattcgaaagaccgctgttggataccacccctgcatcattggatttctaaccagccgccgtgaccggcggtgggacaatgccaggcggggagtttgactggggcggtcgcctccgaaagggtatcggaggcgctcaaagcttgcctcagaatggtcggaaaccatttgaagagtgcaaaggcagaaggcaggctgactgcgacaccgacgtggagcagatgcgaaagcagacttagtgatccggtggtataaagtgggattgccatcgctcaacggataaagctacccggggataacaggcttatcactcccaagagttcacatcgacggagtggtttggcacctcgatgtcggctcatcgcatcctggagctgtagcaggtccaagggttgggctgttcgcccattaaacgtacgcgagctgggttcagaacgtcgtgagacagttcgtccctatccggcgcggggcgaggatatttgagggagctgcccctagtacgagaggacggggtggacggacctccagtgtatcagttgggaaccgtcccatagctgatagctgtgtctggagggataaacgctgaaggcatctaagcgtgaagccaccctaagatgagatatcccgtagaaagacagggaatgtgttatcacagtctcactttcactgaaaaatgacgaaaaatgggctgaaagaggacatgagattgcttttgggcagaagatagtcggagagaggcagcaggccgatcacagcaagggtgagatcagagtagcacatgggtggcttaacacaggagtgttcggatcagatttcagcattttattctcaaatctgtatggagggcttgtctcttacaagaaagcaggtgttgaactgattaagaagtcgccgagacctaacttctggagacctctcagcgagaatgatatcggaaatcatatggcattcagagcagatcagtggaaagctgcttcaacttacctgagcatcaatgatggaagacgagtgtcaaattacgatgtgaaggaagatgaaaaaactgtaacagtgacatttacctattatcttccaacaacacctgaaatcgaagttcgacaaacttaccgtgtatttccggatggggcggtaaaaaccagcgttattatgaataaatccgataatatcggagaactcccgtcatacggagttctatttacaatgaatgccgattttgaaaatctcaggtggtatggtaatgggccagaagatacatacgctgatcgtgagtctggaggaagactcggcgtctgggaaaataaagtaaaagacaatatggctgaatatttacgacctcaggaatcgggaaatcacaccagggttcgctgggctgaagtcacagataatcagggaagaggtctcagattcgaaggtgacgatcttaatatatcagcactcccatggagtccggatcagatagactgtgcggatcatccgaatgagctgccgccgatacagtctacatttatcagagtggataaatttcaagagggaataggcggcgatgatacctggggcgcacgtccgctgccgcagtatataatagacaacagcaaaccgctggaattttctttctggttcaagggaatctgatatactattagaatggtaaaaagtgtttgagaaggaagtggcttatgtatttacaggacgtacatattgaaaattttgccagccgtggaaaagacatcgggatgtacatactgatgggtgtatttatagtgctgacactggcgagtcttattataggaatgggttttccggtattttacttcggtgtagtggtgtttgcactgctcgcatggtatgtaagtacaaaaagagagcttgatttcgattacgcatatacagatggaactatcgatatagcaaaggtctttaacaagagctcgagaaaagaattcctgacgtttgaaatgaaagatgtggtggcagctgctccggttggaagcgaatatcttaaggcatatcagggacgtggaataaggaccatcgatgcaagcgccagaaatccgcaggtgaagacttttgagatcgtattccgcaatcactctggaaataactctgaaaatatagtactgatggatttggaagatgattttatagatgctatgagacaagtagcacctgacgcagttcacaaagaatgaaaaaagagaagaatattgagaatctgctggatgaacttaataaggagacagggcttaagttttcgctgaaatatgacggagaagaaccagagaagactgtaaaaattctgtctgaccttttgcagagatacaagggtactcaaaaagccgggtactttttgaagcagtttctgcttggagagatatccggggaggaagcagaaaaaaaagccattgtttaccattttgatattgattcatattgggcagtgatactgcttagctttaagcagaaatatgagccatacatgctcaggatgatttcctcactctacaggccgggtgctgaccacgcggtggagatggatccgaaacacctggtgctagtccggcaacttaaaaaagagactactgaagacgagcttaaagaaatggcacaggcaatagtagacactttgaataccgaggctatgatctcattaaaagctgcatacgacgagtgctgtaccgatctgagaaaactgccgcagtcatatagaaaagtatgcagcgcagagattatcggaaatcttttttctgaagatgatgtctatggctaccacaatctcggcttgggaaaactgatctatacattacccagggagacttgtgagcagtttttaaaagacaatcttggggattttgacctttcgcagctggaccaggagacgaagaatactataaaagtattcttcgacagcgggctttcacttgcggaaacggctagagcacgatttatccacagaaatactttagtttacaggattgaaaagctggaaaaacagtgcgaacttgatatcagaaaatttgacgatgctatgataatgcggatcgcacttatgataaatgattatctgaaaaaataatggaattttttacataaaaagagactccggaagacggcttccggagccttttttctaggaaagatatatcaatctgtgatagtgagttccgtctctttgtcaaaatagtgagttcttgacatatcgagatggaatgtcatcttatcgcctgtcttagccttggtacgtggatcgactctggcagtaacctgagtgccggcatagtcgaaatacaggaatacctctgcaccgagaagctcgtaaacacgaattgtagcatcgagtgaatttccgagctcgacttctgatgcacctgcttccggatcatagatatcctctggtctgataccaagaataacggttttaccgttgtaacccttgtcaataagaacctttgccttatcagccggaactttgagctttgcgtcgccaactgtagcgataacgtcgtcgccaactttgtcaatctttgcatcgaggaagttcatctgaggagaaccgatgaaaccagcaacgaagaggttcttcggatgagcgtacagagtctgaggagaatcaatctgctgaacaactccgtccttcataacaacaattctggttccaagtgtcatagcctcggtctgatcatgtgttacgtaaatgatcgtagcaccgagtctttcgtgaagctttgaaatctcaatacgcatctgaacacgaagcttggcatcgaggtttgaaagaggctcatccataaggaataccttaggattacgaacgattgcacgacccatggcaacacgctgtctttgtccacctgaaagagcctttggcttacgatcaagaagcttatcgaggtcgaggatttttgcagcttccataacacgcttctgaatctcagccttgtcgacttttctgatcttgagaccgaatgccatgttgtcgaagaccgtcatatgagggtaaagagcgtagttctggaataccattgcgatatcacggtccttaggctctaccgagttcataagcttgccatcgataagaagctcaccggaagtgatgtcctcgagaccagcgatcatacgaagagtggtcgattttccgcatcctgaaggtcctacgaaaataatgaattccttatctgctatatcgatattaaaatctttaacggcctgaaatccgttaggataaaccttgcagatattgtgaagtgaaacactagccattgaaatatcctcttttctttttttggaaaatgtcgttatcttttttacgattatcattttactgaaaagatgattttgttacaacggcagaatgaccaaagattttttgagtttttcgtcagaataactaagaatatggcgggcgacagaatggcaggtagaaaatattttcatgaaatgctataataaactatccaatcgaacccatagaggggacaaaggagggaaaatggatccaatgaagaaaggttacatcaggacatatctgatgatacctatatacttgatacctctgtttatagtcgcaacgatagttttgtatgtaaatgcaggcattaagtcaggaaatgttatgctgatcgtgacaatctgctattcggctgttgttacgatagcttatctgtccgaaaagaaaaagattacagatgagatcattgaatttgccgctgaatatggaacagttcagaagcagcttctcaaaaactttcagctgccttatgccgtacttgacgaaaatggaagatttatgtggatgaatgaatccttttccaggagtactcaggaagatccttcttacaaaaagtctatagcaaacatttttccagaactcagtcgtgaagctttggagaagatagaaagtgagccagtctctatcagggtaaaccatggagaccatgtctatgatgcggtacttcagaagatggagtttaagccagagacagaaaaaaataacagcgatttttcaattatgctcggtggaacactattctctgtgatgctcttcgatgagactgagtatgagaagcttaaagagtcgtttaacgatcagaagctgatctcgggacttatttacattgataactatgacgaagcgatagattcactcgatgacgatgttaagaaatcgctgataattgctataatcgacaggaaaatcgcaaagtatttccgtcaggctgatgcgataattagaaaaaccgatacagacaagtactttattattttccagcagaaatatttaaaaaagctcgaagagaataaattttcagtgctcgaagatgtcaagaacacaaaggtcggaaatgaccaggaagtcactctttcgattggactgggaaaagatgccagaacgtactcccagagtgcggaatacgcaagggctgcaattgatctagccttaggccgtggcggatcacaggttgttgtaaagagcagaaaccatgtctcgtactatggagtccggggcaaagaagttgaaaagactaccagagtcaaggcccgtgtaaaggcgcaggctctccgtgagatgatggagacgaaggactctgtaattgtaatgggacatcagattacagatgttgatgcgctgggggccgctgtcggcgtatattgcgcagccagagagctcgggaaaaaatgccagattgttttaaataccattactacttcgcttagaccgcttgtcgataagttcacgccggcggagggttatcctgaggatatgtttataaacagcgagagagctatcgagctggtaaatgacaacactcttgtcatggtagtggatacaaaccgtccgtcatacactgaatgtccggagcttctcgagagaagccagagtatagtagtttttgaccaccacaggcaggggagcgagagaattgagaatccccttctttcatatatagagccatatgcatcgagcgcctgtgagatgattgcggagacactgcagtatttttcagaaaggatgcagctggcgccgcaggaggctgactgcatttacgcaggcatccttatcgatacgaataacttcatgacaaagacaggagtcagaacttttgaagcggctgcatatttgaagagaagtggagctgaggttacgagagtaagaaaacttctccgcgaagatatggccacatacaaagcacgtgccgaagttgtaagacatgctgaagtttacagagggtcatttgcaatctcagtctgccagacagacgaagtagagagtccgactatagttggagctcaggcatcaaacgagctgttaaatatcgttggaataaaggcaagctttgtaattaccgaatacaagggaaaaatttacgtaagtgcccgctcaatcgatgagatagatgtacagcttattatggagcgtctcggaggtggtggtcaccttaatgtcgcaggagcacagctttccggagcaacagtagatgaggtcaagcgcaagataaaggatattcttgatgctatgatcgaggaaggagaaatcagagaatgaaagtaatactgttagcagatgtcagatcacaggggaaaaagggagatatagtagaagtttccgacggttacggcagaaatgcacttattaagaaaaaactagcagtggaagccacaccagtaaatatcaacaacttaaagcttcataataaacacgctgaaaaagtggcagaggagaatcttgaggctgcaaaggaaatggccaaaagagttaaagactggaaggtagagacaactcttaaatcaggcgagggtggccgtacctttggttcagtttcagcaaaagagatagcagaagctattgagaagcagtatcacgagaaaattgacaagaaaaagatacaccttcctgaaccgatcaggtcacttggagttcacgaggtaactttaaagctccacccacaggttacagcaacactcagagttcatgtaggagaaaaaactaactgatggacaatccagaagaaatatacgcgccgccagaggatgatgatttcattccgccggaagaagacagcatcagccagacttcagatagtacatcgtttaaacgccaggcaccacggagccttgaggcagaacagtgtgttgtaggtgcgatgcttatggatccgcagacgattccagtcgcgacagagatcattactgaagcggatttttatcatcagctctatggtactatttttgtaacaatagtagatctctacaaccagaatgattcggtagatccagtcacagttattaatcagctgcgcgaaaagggtgtttcacaggagtatacagagccgggttttatcagcggacttatgaatgcagtgcctctggctacgaatatcaggagttactgcgagatcgtaaagaaaaaatcactgctcaggcagattatttctgtaaacgaggatattgaaaatgactgttattcaggcgagaaatcagttgaggacattctcgattcaacagaagccaagttcttaaatcttcttcaaaaaagaggagtaagcgatgcagagcctattgaggatgttgtagatgaggcactggaccgtatagaggaagcttctaaacttgagggaaatgtcaccggactttccaccggatttctggatctggattatcagacagcaggactgcagaagtcagatctgatacttatagcagcccgaccttcaatgggaaaaacagcctttgctttaaatatagcacaccatattgcagtccatgaaaagaagtgggtggcaatattttcactcgagatgtctaaagtacagcttatgaacaggctcctggcattagagtcgagggtagacgcgcagaagctccgtaccggaaatctttccgacacagagtggggagatctgctggaagctggtgacaaactggcgaatgcgccactgatcatagatgatacaccggctatctcagtgtctgagcttcgcagcaaatgccgtaaatacaagcaggagcacgaacttagtattgttatcatcgactatctgcagctgatgactacgagtaagaaaagcgaatcgagacagaatgagatctcagatatttcaagatcacttaagtcacttgccagggaactcaatgtgccggtaattgcactatcgcagctgaacagaggtgtagaacagagagacgacaagcgtcctatgctttcagatctgcgtgattccggagctatcgagcaggatgcagatgtagtaatgtttatctacagagatgactattacaataaggataccgacagaaagggaatttccgagatcatcatcgctaaacagcgtaatggtcctgtcggaacagtagaacttgtctggctgcctgaacttacaaagttcgcaaacaaagagcaccggaagaagaaaaatcagtgaacaaatgccgcaggaaaaggtcctgcggcatttttataataaaaaaggaatgccctttcggacatccctaaataagtcgtgcttaaaaagctatcagccctggctgatagaacctgtagggcaaacacctgcgcaagtaccacaatcgatgcacttatctggatcgatgttatactgtgtatctccctgtgaaatagctcctactgggcactctggctcacatgtaccacatgaaacacatgcatctgaaataacgtatgccataattctttcctccatattctacatactttgcatccatacttttcgctgttcttcaacagcttttctaaatgtaatatacaacaggttacacaaaactacaagtactaaatctaaaactttgttaataatgatgaataaattgtatgcaatctaacacttgcggactcttaaaaaagagtatatactcaaactaccaataaaactatttatgttggatttataacagactatttttcatgaagctgatactatgatttacagaaaatgacagagctgtgaaagtaaagaaaggagcaaatatggacgcaccacaggtagaaaaggacactatgataggcgagttactcgagatcgaccagaacatcgctccgatcctcttcggaatcggaatgcattgtctcggatgcccggcttcacagatggagacgatcgaagaagcagccatggttcatggaatcaatccagaggaccttgtgaccgagattaataaatttctcgcaaaggaaaacagcgaagctcaggcagctgagtaaagctgggttaagggttccccgaatggggaatcttttttattacaaataaactttcaagacactgagcatagcaaatgagataagcagtttacagtgctctctgatataaaaaagagtacctgatgaaatctcacgcgggtcgccgaattcacagaaaatatcaaaaacctttctgatatcttcgtcggaaaatttcaagaaactgacaggtacgatacaagtgccggacggagaaagatacaggctgacatatatattaaggctcccgtctaaagtgtgaagcacttttaaggcatctgagatattttcaaattcaaagatagattcagaccaggatttgccgcattcttcatctgcactgtggtgcagtataaatctgtcttcaggttcggaggaatttgatgctaatatagtgtttaataaatcatctaaggtataaccgagatcatttttggaactgctttcactgccagctgcttcatttgcgacactctgatcaggttccgcaaaattggaataacggggatcacattcatccgatgccgaatcggtagaaaaaatcatagtaagggagccatcgcttaatggaatggcatctacggctacagctggcgactctttagagccgaagctgtatttttttgcgagaaatatcgcaaggtcatgaataagagaacgcataacaggtgatgtataggtggcagtatcgagtgaaagcccacgattcttcaaatcttcaggagtgagaacgcactccatggtattttcgtctattttattaattgtcataaaatcacctcttaacaattagttccttcataataaaacagaaaaacaactttgtaaaccgtctgtgatatattcttcggattctttgtacgagtttataactgtttattatttgtttagaaatataaagagagaataaactttcggaaatataaattaaatcggagcgttttctattggcaggctagagaaatcagtgtataaaagaaagtgataagagagccaacggaaaggagagagttataaaagaaaaggcagaatacaggccggtaaaagtgctccaccattcaaagagtatggatgtgatattagcagagcacaccgggcttaaagaattgaggatcctgaaaagaatagagaagagaacagatgctgagtatgataaagctgcattccagctgcacagagaagcagagattctgacagggattaagcacgatggtattccagttatttacgatttttgggaagatcagaatgagatctgtctcatagaggagtatatacagggcatctcactgcaggagtatctgctgagaaatgatccggtggattttaagttcattttagatatgctgatccggattctagatattatggtatatcttcatggactggatacgccgatcagacatcaggacttaaagactgagcacatcatactgaggaacggcgaattagtattgattgactacggtattgcagcatatttgagaggggagagcgccgaaagcctcgggagagatgatataagcgcactaagctcgatggcgagggagattacagggcattgttccacttacattccgttctggttcagggcatcgattcgaaaggcgggggccagggacgattcagcctgttacttatctgtgaccgaatggagagattgtcttaagagacatcaggacgcagagagaaataaaagggggcttcttattaaaaaaatcgcagtcgtaggaaacgaaagaggaatcgggactactcatactgcattcagtgtcacatcctatttgaactattcgggaagaaatgcctgctatttgaacatgaccggacggccatttctgatcagaatggaagagaatctggcaaatgacttctatcagaagaatggcatcatataccacaaatggtttcgtgcaaaacctgattttggtccggcggtagaggattttgaacataatagcgaaataagtgtgatggactgcgggacggatttttcaatggcagctgatgctgatctaactatttacgttgcaggcagcaggccatggcagagcagaattcttatgggagaacagctcgatagtgaaagcactgtacttctgataacaccagctaatcccggcatggctttagcactggcgagatcagctggacacagggtgttaagcctgccatttcaggaaaatcccatgcacccggatcggagagtaaagagagtatatgatagcatttttaaaaaacttaaagaaaaagaatatatttaagagtactgtgtgctattgcctggtatcggtgacagagagatacgatatcatgtctgcatctattgcgctcgcaaactattttgcctcagcgaagggatatcgaacggctctggcggtgacagaccaggatgaaacagtacttagaatgttatcagagaaggaatgtatctcggttgatccgactggatataaggatgagtatctgacatattactgtgtcaggggatccgatgatctgaagaagattaaatgcaggtcatatgagagactcgtgctggcttcatacgcggcttcttttgacagagaacttcaaaaggaagctgatcagataaggatttttggggacatttcaccctggcagtactatgacatcagaaagaacaacagttattttataactgataaagcagagggagagcagcggtctgggaaacagctgtatactgcttcggcaaggaagtgtgacatagcgcgtctgatgaaggaattcggcaccacagtgatagagaccggttttattaaagatccctacagactcgagaagacagacctgataaaggtcgaaaagatcgtgtgaaagatatattacgaaaggaggaaaacggaaacaagatctgaatgagatccggccgtattttaccatgagatggagatagatgcactgcaatggccggatgatttttgaaagacactggaatcccgttacaggaaatctgaataacgggattccttttttagttgttgttaaaaattcgggtttggtttataatcgggctaaagactaatgaagggaatttcctgatgaaaaatacaaaaaaagtttctaataatacgaagtggctgataattctggcagtagttgtggctatacttgccctggcaacattttctatatggagagtaaggtatgctccgactggtcagagaatgagtattaaggaatactatggcatatccggagatggagcggcacttttcgtaaacgggaagcagataaaaaaagatggcaaagccgctgcaaaggtgagcgatggacacttttacattgagctgtcgtctcttaaatcgagtatagatgatggttacgtctatgacagcacagagcagattctaaggtatacgactgacaaagaggttatttcagtcaataagggtgacacttattatacttcgggccgtacgaagtctgatcttaaagagaagatcatcattactggaacttctgataaaccttacgttgcagtggatttcgttaagaaattcacagatatcaaaataaagacagctaaggatccggagaggatagttgtagagaaggccggttacaagaaaaaggtcaccacgcttaaaaataatacacaggcaaggcgctttggcggaccgaagagtaagatcctcgcagatgtgaagagaggtacggaagctacagttattgaatcctatggcaaatgggtcaagattttgacagctgacggtatagaaggctgcgtgatgagttcgacgattgatgttgcaaagcctgcgaccgtagcaaattcgttgcctgagcgttctttcaagcatataaagatggatggaaaggtaaacatcctctggcatcaggtgaccaacagaacagcaaacacctctgtaaatcatgtgctgagtaatgcaaagggtgtaaatgtcatcagtccgacatggttcagagtctcggataacaaaggcagtatttcagatatagcgagtctcgactacgtaaaggctgctcacgataaaggtgttcaggtctggggacttgtaagtaattttgaaaacaaaggaatagattcgacgctgctgttaaataagacatcctcgagggataatcttataaataatctgattggtaaagccatttcatatgatctggatggaataaatgttgattttgagcagatccagacggatgcgaaggacggatattcggaatttatcaaggaactttcactcaagtgtaagaaaaacgatattgtgctttcggtagacaattatcctccgacaaactcaagcgcacactacaaccgcaaggtacaggcgcagtatgcggactattgcattgttatggcctacgacgagcactatcagacaaatggaccaggaagcaattcttcactcgattttgtaaagaaagcagtaaaaaatacattgaaggaagtaccaaagagcagactgatactggcgctgcctttctatgctaaagtatggacaactaaaaatgatgctatgactgtaaagtcgattgcaatgaagaacataagctcatacctgaaggaaaacaatgttcaggagacctgggatgattcgacaggacaaaactatgcggaattttctaaaggtggcgctaaaattcagctctggtctgaagatgagaaatctctctctttgaagcttcaggtaatgaaatcaaatgacctcgcaggagttgccttctggaaagaaggatttgaagacagcagtatttggaacgttatagggaattacacgaaatgaatacacaaattttaaaagttgatccaaaacatccggaaattgagaagatacgtattgcagcagatattttaaaaaatggtggtcttgtagcttttcctacagagacagtttatggcctgggtggaaatgcagaagattcaggtgcctcgaaggctatttacgctgcaaagggaaggccttccgacaatccccttattgtccacatctgtgattactcgcagctggagcatatctcaaagaatctgccacctgaggctaaaaagctttcagatgctttttggccgggacctatgacactaattgtaaacaaaaatgaagttatcccgcacgagacgactggcgggttagatacggttgcagtccgttttccaagtcacccggtcgcaaatgctcttatcagagaatccggatgtatgatagctgctccaagcgctaatacttctggaagaccgtcaccaacgaaggctgagcatgttattcatgatcttaatggtaaaattgacgctattatagatggcggcccggttcagataggcctcgagtctacgatagttgatttgacagaggaagttcctacgattttaaggccggggtacattaataagcagatgctcgaatctgttgtaggtgaagtaaaagttgacccgggtattttaggcacggaaaatgttcacgtccgtcctaaggcacctggtatgcgctataagcactatgcacctaaaggtgaccttaagattgtaagcggagaagatgacaaagttattgcaaaaataaatgaacttgccagagaaggggcagaggcggggaagaaggtaggaattattgctaccgaggagacgaaagggctctaccacaatggcacagttatcagtattggcgatagaacagatgagtaccagatagctcacaatctgtttgatgttttaagacgaatggatgagattggagctgaagttatctattcagaggaattttctactccgaagattggaaatgctataatgaacagacttctgaaggcagctgctcatcaggtgatcgaggtatgagagtcgtacggcttattttcgttgacaagaagggcaatgcaaggtcagcaatggcctgtgctctctacaaaaaaatgtatgaagattctggaatagaagctatggccagaggactcgttgtgtcatttggcgagccgctaaatcaaaaagctgaggctgttatggttggaaaaggactggatacgactggctttatttcacaacagctaagtgaaaaggatataaagcctggtacgctcatttttactatgaaggagtccgaccaaaagcggattatagcagaatacagcggagcaaatgagaggaatacgttcgttttatcatcatttgtcggagaggaacttgagattatggatccatatggcggaagcctgcaggtgtacggtatctgccttgaggcactggggtctacgctcaagaaactccctgagaagttaaaggagattgaaaatgagcgataagaggaaagattacatcagttgggatgagtatttcatgggagttgcagaactctcggcaatgagatcgaaggatccgcatacccaggttggctgttgcatcgtaagtgaagatcataagattctctctatgggatacaatggacttccgaggggatgctcggatgatgattttccatggaagagagagggaccaccacttgaaaataaatatttttacacgactcatagcgagctgaatgccattttaaattacaggggtggaagtctcgaggggtcatcgctttatgtgacactatttccatgcaatgaatgtgcaaaggctattatccaggcgggtataagggaaatagtctatgacagtgacaaatacagggacgagccctccaccattgcttcaaaggctatgctgaatgcagcaggcgttaagctgagaaaatatataaggacgggaagaaaacttaatatagaagtataaaagcttgaggcataaaaggaggaaatataatgaacagagatgatcaggacctggtagaagaattgcggataaaagctaacgaacttcagcgccagataaaagaaaaagaagaggaactggccgaactgagggctgaaaggggcagatacttaaaggagatagacgcccattcggatgaaaaatacgaacagaatatgcttgaacttgtgtatcaacagagaatgaaacacaagaaatagtacaatacaataaatttttcaaaaaaaataaaaaaattcaaaattagtattgacaagacacgataattttggtattatactatccgcaccgcaaaagacaaggaattgcaagagcgatgcgaaaaaaagtttttcaagaaattgaaaaaagttcttgacaagcgccgatgattgtgatatgattgttaagtcgtcgcgcgagagagcaagacgaagaaccttgataactgaacagtgaaacaaccttgaaagatttctaagagaatttaaatcattcgagtaaactcgaaaccttttaagaacagtaaagaagaaaagctaagcttttatcttgacagttcggacaattattttaacatgagagttcgatcctggctcaggatgaacgctggcggcgtgcttaacacatgcaagtcgaacgagctttatggccacgatcccttcggggtgacggccgtaaagcgagtggcggacgggtgagtaacgcgtggataacctgccatatactgagggataacagctggaaacagctgctaataccgcataaaactgtgggaccgcatggtcctgcagccaaagctccggcggtgtatgatggatccgcgtctgattaggcagttggcggggtaaaggcccaccaaaccgacgatcagtagccgactcggtgggataaatgttcaaaagattcatgatctttaaaaatgtagataatacccgccttgttcattatgaaggggtagtaatgatgaccgatatcctgattctactgatatgaagagcgggatgtactggtcggtaaagaccattgaacttatcttaaggagcatccagagaagccgtttatcagttgcgagtttcgcacgcgatgggaaattcctgtggaggaatcagagaaacacagatcttgcgaagagaaacaggctgtaccagggtggttcatctgggattatattgatcaggctatcgagacaaaagatcgctatggaatacataatatggatatggcggagattttgacgacaggccgaatgatgggagtttcgggagacggaatctgttatgcatccgacaggcggccaacgtcaaaatgcaggaagtaaaggcggtttttctccagttgatataactatcgacgaagaaagagttataataagaaacaacaatctcttagaacttaagcgactacatctgcacgataacaagcagctgcgaagataggatacttgatattcgtaagactgcagttgaagcagatccgggaaagtcggctgtatttcctctggagtaaaatatatcagtaatgaaaagattttaaaaagaattttgtgaattgaatgaaaatttaatacaagatatagaaaagctatccacattttgtggacaagatgtggatagctttctaaaaagaattaatgatggtcattgtctcgtatctttttatacgaaatatgaccttttttttcggatgtaacatctcttctgcgttttgatattgaccagaaaatgtgacgaagaagaaatacaagcccaagaataatggcaacagccacgatgcaaacaatagctataaaaaatacattaatttgaatggttgaaactgagctgccacctttttttgtagacagattatggaaaggataactctttacatcagaactgtttgcgagaagattacaatttccaacggttttgtcaccatatttaaaattcattaatccaattacattatcacttgatgaagtggatttggaaagtgacattttaacatcagattttgacgcagacttaggaatcatgatcgtagaagaatcatctacagaaatcaaagaagaatctgcaccataattggatttacctagcttcgaaacatgctgggtgatattttctatatcggaaactttaactcttttaaaattatcgaagccccaatccattagctttctggtatcgagccagtgatttggagtttcggcacacattactacgcaaactaaagttttgccatctttcttggcataggtcacaagagtagacctggccgcgacggtatagccggtctttccaccaacgcagtagtcataaagatatctcgatgtatggaaaaaatttaacatacagtggtggttgtttaaaggagtcggatctttgtgcttgtttgtgggtggaagcaccatgtgttttgtacctgtaatcttagcaaacactggattcttataagcagcccgtgaaatctttgccatatcgagagcggaggtccagtgcttgtcatctggaagaccattgggattgtcaaagtgagtgtgggtgcaaccaagtgatttggcttttgcgttcatcattttgatgaaattcttttcagttccgccaacgtgttccgcaattgcccaggcgcactcgttggcggattcaagcatcataccgtaaagagactcttccatagtcatcttctcaccaacatctctggcaatactcgatgttccgccggcactttgagctacagctaatcgggaatatgtaaccgtttcatcaagagaactgtgttccagagcgacaagagcggtcatgactttagttatactggcagggaaatgtttgtcattcggcttttttgaataaagtactgtaccgctgtcgacatccataagaactgctgatttggactctacatcagggcctttaggccatttactgcttttactggtagcagcttgtacatttaccggacttataatacaaatactgctgcagaaaactgtagaagatagtagggcagcagcacatactcttttaaataatgaaaaacgcataaaaaacctcagttaacaaataaaatttccttaatataataatgcataatttataatatttcaatcatataaaaaatcttttaagaaaatatttcttcactgtaacaataaatatatggtataattttaccaaatagtcgtatggggttcggcaattttttagaaaaagaggaatagatgaagacagagatacctatgtacagggatgaaaaaagaacctacgatctcgagaggattgaagcacttattgaagactcaggtggactcgcaaaaacaaaggatatcacagacctcggagtggattaccgcaggcttcagcagtttgtagccgatggggaacttacaaagataaagaacgggtattactctgaaaaaaaaggtaaaatttcagaagagagactgatctttgcgatgttccacaacgatggcgtgattacaatggaaagcgcacttttctatcaggggtatttgaaacacaggccattcggatggtcgatagcgatagacaaaaatgcaagcaagtcgaggttcaatctcgactatcctatagtgcagccgtattatactaagtcaaatgttctggaaattggagtcgagacactgaagaaacctggattcgaaatgaagatatacgacagggacaggctgatctgtgacgtattgaaataccaggagaagatttctaaggatgagtttcaggaaggcgtttttaactacatcagagatgacagaaaaaatatagaacatctgatggagtatgctgaacagagacaggtaaaaaataaggttaaaactatgattggggtgtggctctgatgatgaaacgcagggagctgaaaaaatattcggaaaagaataatatcccgttcagtcaggtactgggatggtatgtcgtaggactattgatgtatttgactgaaaaagcaggatttaataagaatcttgtggtgatagagccgtactcgttagatccgaaacaggatcttcatatattagagcaagggatagcctgctactatgtagaagatgagaggattaaaccaagagatggatttgtgccgggttgcgcctataccagggattttttggcgagacttctattaaaaattcagtcaaacgcaatgaaggaagactatcccctgataataaagacagggagagggagcctgactgaaatttactatgatgacatgtatgtaccgatagagataagagttcggccaaaatcagatttttatccggaaatgacaagctacaaattttttgacccggagatagatcatgttgacctgagagtgtatccgaaagaaagtcaggcggctgactatatcttagagattatggaaaagctcgaactgataaatgaaatggaggtttacctttatctatactggtttttaaaaagtacactgctttctgccagagatgtatgccaggcagtagaggaggaacgcgatccggataagagtttaagctggcatacatacgaaattttttctacatattctgaaaataaatttatgaagaaaaaatggaaagtccttttaaggaggcataagataaaggaaccgacctgggaagatacgatggacttgcttaaaaaatttattggacctgtctgggcaagtatcacaaagggcagtctctattttggagactggatgcctgagctcgggaggtatttggaataatggaattgctcgacaaattaaaagaattaaaacaggatgatccatatcctatgcatatgccgggacacaagcgaataaggctcgattttccaaatatctacgatattgatatcacagaaacagatggttatgataatctgcacagaccggaaggtataattaaggaactttcgagagagactgcggaattatatggagccgaccaggcttttttgtctgtcggaggatcaacagatatgatccttacatcgatcttcgcggcgactagaccggaagacaaaattataattgcaagaaactgccataagagtgtatatcatgccgccgttttaagagacctgcaagtcagatacttattcccggagattcttgagctgggaataccgggagggataaaaccgtcagaagttaataaattattaaagtctgaaaagtatataagtgcctgtgtcgtcacatctccgacatatgaaggggttatttcggatgttagatcgattgctgatatctgtcatgaatatggaatacctctgattgtagatgctgcacatggggcacatcttggatttggaaattttccggtaaatccgataaaacagggcgcggacgcagtcgttataagcctgcacaagacactgccgtctctaacccagacagcctgtcttttaagaaacaaagacagcctgatcagtgcagagaggataagacaatatttcgattactttgagacaagttcgccgtcgtacgtacttatggcgggaatcgacaactgcattacatttttaaaagaaaaaggtcccgccgcatttgaaaattatgaaaaaaaactaaaaagcctgcgggaaaatctaaagaaattaaaaaatatttcgctgtttgaaccagaaaactactcttatgatccgtcgaagcttgttatcagcatgtacggcaagagtggaacagaacttgcagacattttaagacgtggtaaaatagaaccagaaatgacatcactttcatactgtcttgcaatgacttcagtaatggatacagatcagggatttgaaaggctgtttcgtgtgcttcaagctgcatccaagagtgaaactgattatggaaagagattaataaacagcgtagtacctcaaaaatctcatgaaaactcattaaatagggcatcaggcatctatcagcaggcaccggaaaaaagatatgatatcggaatagctgaaaaatctgaaattatttatcaggagaaagataagctggaaggaaaagtaagtggtggaattgtcacagtctacccgccgggaatcccacttatagtgcctggagaaatctttaccgataaggtgcttgttgatcttaagacggcaaaagctgcagggcttacagtggacggagatttcaacggaaaatacttgattgtaaaggaaaaatgatgggcaggttatatgttttgaccggaaagagcgcatgcggtaaggactcgatcgagaaggcacttttagcagataaaagccttgaacttcatccgatagtgacttatacgacgcgtccgataagaaatggtgaaacggaaggaattgactaccatttttcttcagactgtgattttgacagattacggaaagagggaaaggtcattgaataccgcacctataatacagtatttggtgactggacatattttacagtcgatgacggacagatcgacctttcaaattattcaagtataatagtcggaacgcttgattcggtcattagttaccggaagtacttcggagataagaatatagtgccgatatatattgagttggatgatggcgagagactacagagagctctaaaccgagaaaaatgtcagagcaggccaaagtatgatgagctctgccgcaggtttctggcggaccggaaggatttttcagaggaaaatataaaaaaagccgggatttcctgtcgcttcgaaaatatagacacaaaaagcactgccgagaagattgcggcgatgatcaaaggtgaaaaaaatggacgttaataaggtaaatccactgaaccagacgcagccagcggcgaatgcccaggagactacaaaatcagatggcagtttcaaatttactctgagctctaagattgaggacaaggaacttcaggaaaagctcaatggccttatgaagcagatagatgatcagggaaagaagctcgctgatcatatggatatccgcgatatgaaaaaataccgcagcctcgtaaaaagctttataaatgaggttgtaaaccgctcacacagctttgagagggaaaattttctcgacagacgtggaaggcacagggtttatggtatggtgaagcttgtagataaaaatctagatgagcttgctcaggacctggttgcagatgagaaggatcatctcgcaatccttggaaaggtcgatgagattcgcggattactactggacatttcagcatgaaaatagatgagatagcgggacagaccgcagcacttacacatttaaaaaatgctctgataaaaaatcagatttctcaggcctatatgttaatcggtgagacaggtatgggaaaaaagactattgcaaaggcatttgctgagtctatactctgcgaagagagaaaacctggcgaatacgaacactgtgggaaatgccagagctgtcatcagctggaggacgtaaaccatccggactgtatttttataaggcatgaaaaaccaaatcttattacggtagatgaaatcagggaacagcttgtttctgatgtggagataaagccgtatcagggcgaaaaaaaggtctacattgttccagatgcagaaatgatgaacgaacaggcccagaatgcgacccttaagactttggaagagccaccagaatatgctgtgatcattctcctggtcgcgaatgccgacagaatgcttccgacactcttgtcaagaagcataaaactgccgcttgctccactgcctgatgatatcatagaagaaaagctgataaaagactacgggatgcctaagtaccggacttcctcaattgtgaaattcgcgaggggaaatctcggacgtgcgatagagatgtcggaaaatgacaaatttatcgagaataaggataccgcgtcagatatcatgaaaaaagtagtgaaaactgaatgctatgagtggaatgactggattgatactataacaaaagacaagtcagagattccattttacctgggcatgttcatggactggtacagagacattctgatgatgaagtccggagccggccgcgagaggctgatgtttacagatgaggagagtgtgataagagaagaggccggggagtacgattacgaagggctgaaatactgtgttgaagctataaaggaagctgaaacgaagataagggcgaatgtgaagccgtcactcgtcatcgagaatcttttcaatacattaagcctgaattacgaagattaggagaaatatagatttatgccaagagttacagcagtaaggcttagaatagctggaaaaaacaattactatgatgctgaggattatgaccttactataggcgataaggttctcgtggaaacggaccgcggtttggagatgggcgaggtgtcgattccggtaatggaactggacgatgaaaagaccagcataactcttaaacatattgagagaaaatgcaccaaagaggacctcgagcagcagaaggaaaacagggcaaaagagacagaagcttttgaaatctgccggcagaagattaaggaacatggcctcgaaatgaagcttataagggcagattacactttcgacagaaggaaactgacatttttcttttcggctgatggaagggtcgacttcagggctcttgtaaaagatcttgcatcagagtttcgtaccagaatcgagcttcggcagatcggagtcagagatgagacccgtctccttggcggaataggagtttgcgggagaccactctgctgcagcacatttttagacagtatcaatccggtctctataaaaatggcaaaagagcagaatctgtctctcaatccgacaaaaatttcaggactatgtggcagactgatgtgctgtctcaaaaatgaagaggattcttatgagtatttaaataagactatgccgcgcagaggagatgcagctattactccagatggcgaagaaggtacagtctacaatgtaaatatcctgcggcagagggttgcggtcatttttgaaaaaaatgatacccgagaggtaaaggtctacgatgccgacgagctggattttgctccgaagggatcgagaaaacttgttccaaagcctaagaaggattcgactgacgaggcagagccggtagttaaggacaattatcaggaagctattaaagctgccataaagcgaaacactgaagagaaggctgagaaagaagaacgcgagaagaagcgcaaagagagaaacggcaaaaatggcggcagacgagacaacagaaaaggcagccgcaaaggtggaaagaattacgagggaaaccgcaagaagaatgataattaccgtcgcaagaacaatgcttcaagcgatgagcagtggaacgaatacaacggcaaaacaaataagggacacaacaactctaagaacaagaataacgacaatcgtggccaaaagaaaaacaatgatcgccgtccaaagaaaataacgaatggcggttactcaagctttgcccgcgagagcaagcccaatacagaaaacaaggcaggcagtaacaatccaaaaaacgggaacaaatcaaatagtggagataagaaagaatgaatgccgaggtcactttaaaaccaggtgaacggatcgatgatctccagagaaacgggcgggtgatcatacagaaccccgcccgtttctgctttgggatagacgcagtcctgctttccggtttcgcaaaagtaaaaagaggggagaagactatagatctgggaagcggaaatggtatacttccgatactccttgaagccaaatacgacggagaaagttttacaggattggagattcagccggaaaatgttgacatggcaagaagaagtgctgatctgaatcgaacagaaaaggtaagatttgtcgaaggcgatattaaagaggcagtacagatatttggaaaaaattccacagatgtagttgtatcaaatccaccgtatatgaaggcgggaagcggacttaaaaatccgacagacgccaagatgatcgcgaggcatgaagttcttgtaagcttgaatcaggttattgagcagactgcatcgcttctaatagaaggtggaaggtgttattttgttcacaggccattcagacttgttgacatattttcatcgatgaggcagaatcagcttgaaccgaagagacttcggctggtatattcgcagataaacaaggagccgattctggcccttatcgaagggaagaagcatggcggagtcgagctcaaagtcgagccaccgcttatattatacgaaagtgatggaaaaacctataccagggaaatgagggaaaattatggattctgagggagcgctgtatctggtggctacacctatcggaaatcttgaagatatcacgtttcgggcagtgcgtattctaaaagaggcggatttaatagcagcagaggatacgagaacatccggagttttattaaatcattttgaaatacatacgccggtgacgagttatcacgaattcaataagatcgaaaaggcggactatctgatctctgagatgcagtctggaaaaaatgtcgcctgcatcaccgatgcaggaactccggggatatcagatccaggcgaggagcttgtgaaaaaatgctatgaagctgggattccggtatactcagttcctggaccggcagcgtgcatagctgctgtcacgtcatcagggctttcatgccggagatttgctttcgaggcatttttaccaaaagataaaaaagagcacgagagagtaatttctgagctgaaaaaagaaacaaggactatcattatatacgaagcaccacaccatctgaaaaagacacttgcggagcttagagaagagcttggcgctgacagaaggcttacaatctgcagagaacttaccaagaagttcgaggacaaagttcagacgaatcttggagacgctgtggaattttatgacaaaaatgatccgagaggtgaatatgtacttgtcatagaaggcagatctaaagaggaggttgaaaaggataagcagcaggctttttcagagatatcacttgaagaccatatgaaaatttttaccggtcagggaatgtcagagaaagaggcgatgaaagctgtagcaaaggaacgtggagtttcgaagcgggacatatataaggagctgaaaatttctaaataaactattaaatttttctttgggaggcagaaagatggatgaagaaaaaataaaaaaacttcaggaaatggtcgatgaatctaaaaaaatagtattcttcggaggtgccggggtttcaaccgagagcggagtgccggatttcaggagcacgaatggtctttatcatcagcactataaatatccaccggagactattttaagccactctttttacgagaaaaacagagaagaatttttcagattctactatgacaagatgttagtagaaggtgttgagccgaacaaagctcactacaagcttgctgagctggaaaaagctgggaaacttactgctgtcgttactcagaatatcgatggactacaccagaaagccggtagtaaaaatgtctatgaacttcacggcagtactctgagaaattactgcgagaagtgcgggcagttttatggcattgactatatgcttgaacagaagaaaaagggcaatctcaacccgaggtgtaacaagtgcgggggagaaatcaagccagacgtcgtactttatgaagaaagtctaaacatggaaacgatagaaaaatcagtcaaagcgatttctgatgcagacatgcttatcataggaggaacgtctctggtcgtgtatcccgcagcaggcttgatagattacttccatgggaaacatttagtcgttataaacatgcaggcgacaggcagagataagggagcagatcttgtaataaaagaaaaaattggtgaagtgcttgacaatataaaagtgtccgtgataaaataaacgccgtggtatatgaaatccttgctctcctgaaggagtgtattctgaagaaggagggccagttgaccagaaggaggaaacttaatgaacaagtacgaattagcactcgtcgttagtgccaagatcgatgatgatgccagagccgcagtagtcgacaaagcaaaggactacatcacccgtgcaggtggtcagctcggagaagtagaggattggggcaagcagaagctcgcttatgagatccagaagatgaacgaagcatattattacttcatcccattcgatgctgagcctacagtaccggcagtcgttgagagagacgttcgtatcatggagaacgttctcagattcctggtagttcgcaaagacgaggattgattgaacatctttttaatgaaaggggaactatatgaatagaatatttctgatgggcaggcttacaagagatcctgaggttagatatggcggagctcagaacattgctattgcgaggttcagcgtcgctgtagacaggagattcaagagggaaggtcagccagacgctgatttctttaactgcacagcattcagacagcaggccgaatttatagagaagtacatccacaagggaacgaaagttgtcattgagggtgagatgcagaatgataactacacgaacaagcagggccagatggtttatggcttccgcgttatcgtgagcagtatcgagtttgcagagagtaaggcagctagtcagcagaatgcttcagcaccagtacctcagccacctgcaggaacaggttcggaaggctctgatggagagaagcagcctgcaccggacgattttatgaacgtaccggacagcgtcgaggagtcgctgccttttaactagattattggaggtaatgaacatggcttttagaggaaaaccggttcgcagaagaagaaaggtttgcatcttctgtggaaatgataatgttgttgactacaagaacgtcgcactgctgaagaagtttgtctcagagagaggaaagattcttccacgtcgtatcaccggaaactgcgccaagcatcagagagctatcacagtagctgtcaagcgtgcacgtcaccttgcaatgatgccttacgtaacagactaataaaggtcaatggttcggattttattatcacaaaagatgacctgccgccgagagtgatttatctgtctcggtggcaggctttttttttagagacatttctcttagaaaattatataataatagtagtagataaaaatgagtcagcagtttgcattgaatgccgaatcttatcagataggagaaattatttatgatgaaaaagtttttttcattgttactggctgtaacgacttcgataacgctttttgcaggatgtggcagaacgaacaattctgcatcgggaaatgcatcggggagtgcatcggggaatgcatcgggtaacgcatcaggaaatgctaaggaagtagatacaaaaaaggaagattcgaatgaactttcggtctatgcctgggacaagaattttaacatacctgcacttaaggcagccgagaaagcatatcagaaaaagaatcctaagttcaaactgaatattattcggcttccgcaggcaacttctgtagctgacgtaatttcgaaggcaggtacagcaaatgattacagtaaactcccggatatagttctttttgaagaccactatatcaacagatatgtgcatgactacaaagatgcgtgggacgatataaacgatgtaaagatcaactggaaggattttaaccaggaaaagatttcttactctacgatcgataataagcactatggggtgccggtcgacaatggaacagtaatctgcgcgtatcgtacagatcttctaaaggctgctggttatacgatcgatgatctgaccggaatcacctgggagcagtttgatgagattggaaagaaagtttatgactataccgggaaatatcttttatcgattgatggagacagcaacgatcttccatacataatgatgcaggcggaaggtgcttcggaattcaaggatggaaagccatattttgtagataataagaaaatggtcgacattgtaaatgtcatagttaagcttgtccaggataatgttctctatcttgcagatgactggaaggggtatacgaagggctctatcggtggagatatggtcgctggtgttattaacgggaactggatcatgtcctctatgagagatgtaaagaaaaattcaggtaagtgggaaataactacgcttcctactctctcggggaaagaaggctacgcgtcaaatggcggttcatcactctacatcacttccaactgcaaaaatatctctctggcaaaagactttctcgcttatacatttggtggaggagatggagcaaaagagacttatgataatgcccttaaagatggtggggtgatcaccacaaatattacctgtggtaagtcagatgcttataatgagggtgttccctactttaataaccagccggtttacaagcagatagtagaaatgggatctaagatcactccggttgagcagagtgactatttctctacagcagtaaaacaggttagttcagctataagcgatattctcgatggaaccgatgtcaagtcggcgctaaagaacgcacaggatcaggtgaactttacaatgggtaatgaatagagaattgtatggaatttaattttgatattgtaaaaaatccaaggatttttcaggaaaacagattaccggcacattcagatcacgagtggtatctgaaccgggaaaatgaaaactctgttagaagtgactgcaaatattcattgaacggcagtttcaggtttcactatgccgagaattttcagagtgttatcagaggatttgagaaaaaagacttcgatgtagatggctgggacataattacggttcctggccatattcagatgcagggatatggtgtgccgcagtatgttaatatcgaatatccgtgggatggctctgaggaaatagaaccaggtgagattccgacaaaacacaatcctgtagggcagtatgtgaagaagttcactctgccagattttatgaaaaatggcccggtctacatttcatttcagggagtagaaagcggttttgctctttggatgaacggagcttatgttggctacagcgaagacagctttacaccggcagaatttgatctgactccctatattgataaagatggtgagaacagacttgcaatagatgttttcagatatacggctgggagctggtgcgaagaccaggattttttcagattttccggaatttttcgcgaggtttatctctatacagtgcctgccgttcatgtctgggatttgaaggtaaatgccaatctggatgacaattataaggacggagtttttagcctgaagatggacacacatggagccaatgggtctgcaaagcttaccctgtacgataaaaatcggaagcatctgatatttgaaaaaactctcgaactgtcggacagcgaaaatacttacagaataggcggggtcgatcagtggagtgctgagttccctaatctctatgatctggagataactgtctttgataaactgggaaatatttcagagtatatcaaagaaaaagttggattccgccgcttcgaaatgaagaatggtgtaatgtgtatcaatggcaaaaggatagttttcaacggagtcgaccgtcacgaattctccgctcagaagggcagagctatagggaatgacgaaatacgcttcgacctgatgacgatgaagcagaataacatcaatgccataagagccagccactatccaaaccagacatatttctacaggctggcagatgaattggggctgtatatcatagatgagactaaccttgagacacatggagtgtgggaccatatagttaaagacggactcgacaagtcttttgcagtaccaggtgacagaccagaatatctggatatggttcttgacagggctaacagcatgtaccagagagataaaaatcacgccagcgtgctgatctggtcctgcggcaacgaatcattgtacatggtagataacccgtcaccttcaaaaaaattcttgacgcgttactattaaattttgaccttcttcaggttctctaagtttcaaaaattccagccctttcgggctggttattcttgcttattttttctttcggcagaatccggtattgattctgaccacggcatgagtttttcaagttcatcgcctggaactttctctcggatacttgatcagtttgagatcaggtatctcatgtattcgtaaggcttcaggccgttcgcttttgcgtctctgctatgctgtagtagagtgcgcttgctgaagctccattgactgagtctatgatgtgcagttgtgctttcctacgcagaacttccggatgcgcgttctgcatcgtgttgtcaagtggaactccggatgatcaaggaaggtcttcaggtagtattcctgattcttggcatagttcaatgcagcgcgaagcttcgtactcgatatcgttttgctgtcaaatgtttttacccacgcaaagaagcctctacgaggggcctgatgttttcctgccggttctttagcctttcctcatcagaagattctttgaacttattgtcgaggtggtaaaactgatcgatccgctttaactgcctcggggcatctcttgtgccgtgtcagcttctcgcctttctttgcagcctttacgatttctgcaaactttcgtctgacgtggctgaacacccggctactgtgaattcattgcgtttttcagattgtgtgatacggctgagatacgtcgttaccaggattctttgtagccttcaaggtaatctgtattacctcacattcccgctcccagatattcataaagatatatcggaggacctccgccttttcccggagaatgaagcacccaatgtactgctttgaattctttggcattacgaatggtgtctcatcacacgtggagcagcttcgtttaatcagctgcttcttcatcgtcagatgaaaaggtttcagataataccttagactgtatgagccaacggccatggctgccggtcaagaatgacatcatacctctgatctcctcagagaggcggttcagtgggatggcattcacatacttcatgttgaagatcatggcaaaaagccctggagtgagtatgctgtgagacagaatttctgcaggatgatctgccttttcacactgtctccatcatggttcccaccgtataatttacatgagctcaaggatcttaaactttgctggtgcattgcagctcactgtatacgtcttcgtggctcatgccatccgtgcggaaatgcagcatcaagctcttctttgagcattcgtgtatgactatctccgtcgacaccacttagattttcctttctctttcccttcttacgggtatgctctttgactttgacaacttcatctatgtctttttcaggaggaacaccgttttcagtgagagattcaggctcgtttaaaatgttattaaagagatcggacatagacatctgtccttcaatctgattctctgtttcagactttctgccaaaacggttctgggtaaggatatcgatctgctcggtaagatcttcgatctgcttaacaagcttttcattctgtgccagatcttagtgtcatttgcgctcagctggcgatacgttcacgcagtgaaggaacagaaaaatgatcgtttcctttgggagattattcagttctgagtctgtgatctctggtccgttcatactatatattttatcacaaaaagagcctgaagtccgcataaatacagcgcttcaggcaccttgtagtatgtttcaggtgcaaatatagtaagatcctgttcagtaaatccctggaggagcatctgaaataacttttttctgatcgatattcagtccctccataagccactgtactgtcgctgcgagatcacttttgcttcggctggagtacggggccattgcagctttccattagtaaaacgcttataacacatgagccagccgttgccttcataaagaagagctttcattcggtctgaacggcgacagaacaggaagatggaaccaggctcagccggatcaagtccgaaagtattggtgacagtttttatgaggccatcaatgccctttctcatgtcagtatagttgcagcagagatagatgtgcgtaaaacctttagcgtcactcagcatctttcaatacctcaaggacttcagctatcgagacttaggagtagactcgtttatgcagatctcagagtttcctgttctgatgatcatctgagtattgaactgccgcttaaatgatcagacttttttatgatatccggttcagagacggcagtggcctgtgattgaacctgaggcagctcaacaaagcctgagtcttcgatgactttcctcctgagtttgcgccgataatagtagtactgatttctagtgtagccattctttttgcagaactcatcaatcgtcaaaccactttgatttcgctcctgaattatttgaccaatctttgagggaacctgttttacaacttcgtttggattaacatccatgcctgtacctcccgtgaaaatgtttgataacttgaaaaactgagaaaaggttttctgagtttttaaagttattctaacaaagagatccggaacaaggaaggtgacgggttattaccatttacgaaaagaaggagtaagccagaaccagcagctgcatcggaaccaacaccagtatctgcaccggtgacaagtgatccgaatgctaagctttcacctgaagagatagcaaagctctttgctgcggcaaatggggataatgaatatgctacggaagaaacgtctgaaccagagaaggagcctgaaaaagaacctgaaaacacaccagagccagaaccaaaatctacgccagagccagtaattgcaccagaatctgcaccagcagcaccaacaggtgatccaaatgcaaaactttcaccagaagagatagcaaagctctttgctgcagcaaacggtgataataattcaacttcggaaaaaaaagaggaaaagaaaacagcagatgatactaagccagcagagcaagcgaagacagagactactgacaatacaggggcaaattcagatccgaacagaatgatgacaccagaagagattgaggcacttttctcgaaggtgtaatagttaaatgaaaaaaagtagaggcattcttagacttgaaaaggaatgcctctacttaacaaataactattttataaaataaaaaagactaattaaaatactataaataaagaaataagcggttgttctactaaaatcataaacaatatataaaattcgaaaaaattataaaaaaatgcttgcatttcatgtgaggaggtagtataataacacatgtcgtcaaggaaaggcgataaaaattaataaatgagcgcgattagctcagctggcagagcacctgactcttaatcagggtgtccagggttcgaacccctgatcgcgcagcagaaggcccttgttttgcgaacttcgcagaacatggacttttttttatatcaaataatacgagcagaataaataccagaaattctacaattgtaaacaaggagaatactatgagactcagaaatatccctggttcaaaagaggctgttgcagagagcagctttactatagacgaaccggaacagtacaagggaaagttcagccagacattctttaatgggaaacctgtaaggatagaaattggaatgggcaaggggcgctttatcacccagatggcagaagcacatcctgaagtgggatatataggtatagagatgtattcttcggttatcatcagaggtattcagaaactcgaggagttggaggagccgccagagaatctgaaactattgtgtatggatgccagagagcttacaaatgtctttggcgaaggtgagattgacaggatatatctcaacttctctgatccgtggccaagaaacagacatgcgaagcgtagacttacacatcaaaggtttctgaatctctaccatgtagttttgaaaaagggtggacaggtggaattcaaaacagacaatactgacctgtttgatttttccttacagtcgatagaagagacaccgggctggaagattgtggctgtaacaagagatctgcacaatgacacggtcatgaaccagggcaatattatgacagagtacgaagaaaaattctctgctaagggaaatccaatttgtaaggtaatatttgaaagagaatgaaatatagataaaattcgaaatataaaatcgcaccagaaccagagctacaccttctccagagccagaaccagcatcaaagtcagaaccagcaacagcatcggagccagaaccagcaacagcatcagagtggcataggtgtttatatttaccgcgagtgctgtaactgttccgcctaagcctgctggccctatgccaagtttatttacttcacttagcatctctttttcaaggtctgaaacccaggcgatatcagaatgtacacctgcttcacgggtcagagcctctttcgccatctctgcacatttttcaaaattgccaccgattccgacaccaactaccattggaggacaggcattcggtccggcgtcatttacagcttttaatatagcttcctttacaccatcaatgccctgagctggctttaacatgaaaatttgactcatattctcactgccaaatcccttaggcgccactttaatccgaaccttatcacctggaacgattctctcgtgaattatcgcaggagtattgtcatttgtattttttctgatgataggatctgaaacaactgactttctcagaaatccatcagtgtagccttccctgacgccctgatttacagcatcttcaagacttccacctgtcaaatggacatcctgaccgatatctaagaaaatgactgccattccagtatcctggcagattggaatcctgtcattttttgcaatatccagatttttctggagctgcccaagaatctgactgccaagtggtgatttttcactctgtttagcagaagagagtaccttcttcatgtcatcagacagctcatagttaacggaaatacacatctcacggatgtttttagttatttcacttacatctacttctcgaaccatactaccttcttgtctaaatctggattctcagtctgtaaactgcagctgtttaattttgcttgtcaattctcattcttgtcctgatcagctctgtccagcaatctatttatatcatttttctcctggtctttattgtttaaatcagaaccagaatcagcagaaactgtttcttcaggatcttctgaaatattttcagcttcttccttagcttcctcttcaagataatcacgacgtaccttggctatagatgccactttttcacctgtctttaaattaataagcttaacaccagttccgtaacgggactgaagagttgtttctcctacctttatcctgatgatggttccgttcgtattgatgatcattatttcatcatcctgatttactactttgacacctgcaaggtttccggtacgttcagaaatcgtatagcacttatttcccttgattcctctgttctttacagggaattctgagagcagagtgcactttcctagtcccttctctgaaacgataaatgctgaatctccctgggaatcaagctgcatagcgattatctcatcattttccgcaagattcatgccacggacacctgttgcatttcgtcccattggtcttacatctgtcgacttgaatctgcaggactggccgaatttagtaaatagcagaatctcatcgctatccgtaactttctttacggttataagctcatcgccgtctttcagatttactgcaataagaccatttttatttatattttcaaattcactgacttttgtcttctttacaataccgctgtttgtgaccatgaagagatagtcattctgctcatcgactttgtctcgaagggcaatagtagaagtgattttctcatcacctgccagctgaatcagatttacgattgctgttcctctggctgtccttgaagcctcaggtatcttatatgccttcagtttgtagacacgacctttgtttgtaaagaacagcagtgtatgatgattcgtcgtcatcataaattcagttacaaaatcaccgtcgagcagttcagtgcccttgatgccttttccaccacgtccctgagccttgaaattttcaatgctcatacgcttgatgtaacccatatttgtaaatgtgatgactacattgtcgtctggaatcagatcctcgtcatcgagttcttcatcgccgtcgccagcaacgatacgggttctcctgtcatcaccatatttatctttatagacaagaatctctttctttattacaccaagaagaatcttttcatctccaagaattgcctggtactccttaatcttttcttcaaggcccttgtactcatcctcaagcttctgtctttctagtccagtcagggcacgaagtctcatctcaacgatatttgatgcctgcacatcgtcgagtgcaaatctatccatcaagctctgcttggcagtggagacatcctttgaacctctgattatactaataacttcgtcaatataatcaagtgccttcagaagtccctctaagatatgagctctctcctgtgccttattcagatcgtattttgtacggcgggtaactacctcttcctggaatttgagatagtagtcaagcagctcttttaaatttaaaatctttggctgattatctacaagcgcgagcattatagctccatatgtctcctgaagctgagtgtgcttatagagtttattcagcatgatctgaggatttacatcttttctcagctcgattgcaactctcattccctcacggctggtctcatcacgaagagctgttattccatcgagttttttgttcttgacaagctctgcaatattttcaataaggcgggctttattcacatagtatggcagttcagaaattacgatacggtttttgccatttgccatcggctctatgtctgtgatgcctctaactcttatttttccacgacctgtcctgtatgtatcatttattcccttatgtccgattatctcggcacctgtcgggaagtcaggacctttgattatcgtcataatctcatcgatagaagtatcacggtcttcgtttactttattatcgattatacgaacgactgcatctatgacttcacggagattgtgtggtggaatatttgtagccattccgactgcaataccctgggcaccgtttacaagtaaattaggaaaacgggatggcagtactacaggctctttttcagtctcatcgtagtttggtatgaaatccacagtatcttttccgatatcctggatcatagcaagcgaaattttagatagacgggcctctgtataacgcatagcagccggactatctccatcgactgaaccaaaatttccatgtccgtcaacgagaggatatctagtattccaatcctgtgcgagatttaccagggctccgtaaatagatgagtcaccatgcgggtgatatttacccattgtatcaccgactatacgggcgcactttctgtgaggtttgtccggatagttgttcatctcgctcatagaatagaggatacgacgctgaactggcttcaatccatctctgacatccggaagtgcacgcgatacgataacactcatcgaatagtcgagatatgaagactccatcgtattcttcagttctacatctctaatgttgtcaaaaattttgtcatccatgctttatccttatacgtccagattttctacctttttcgcgttctcaatgataaattcgcgtcgtggctctacttcgtcacccatcagtgtagaaaataccttatcgatctctgaaagatcgtcttcatccatatttacacgtttaagtacacggcgctccggatccatagttgtctcccagagctggtctgcatccatctcaccaagtcctttataacgctggactttattcttgtcgtcacgtccgatttcatccatgatcttattaagctgatcgtcattgtaggcataccagacttttttgttcctctctatcttataaagtggaggcatagccagatatacataaccctgcttaataagctcaggcataaacctgtaaataaatgtcagcatcagcgtcgcaatatgagctccatcgacatcggcatctgtcattattataatcttatgatatctgagcttcgttatatcaaaatcatccaggattccggtaccaaaggctgtgatcatagcctttatctctttattgctgtaaattcggtcctcactggctttctctacgtttaagatttttcctctgagaggtaaaatagcctgagttgcacgacttcttgcagtctttgcagatccacctgctgaatctccctcaactatgaaaatctcacagtgagatggatctttgtcagtacaatcagcgagttttccaggaagagaagtagagtcgagagctgtctttcttctggtcaggtctcttgcttttctggctgcttctctggctctctgtgccaaaagtgatttttcacagataatctttgcaacctgcggatgctgctcgagataatatgtaagctgttcacttacaactgaatccacggctgtcttcgcatcgctgtttccaagtttttgctttgtctggccttcaaactgaggatcctcgatcttaatactgatgattgctgtcattccctcacggatatcatcacctgtgagaagctgctcattttcttttataatcttgttttccaccgcgtatttattaaacgtacgtgtcatcgcagctttgaatccggctacatgagttccaccctctggtgttataatattatttacaaaactgtaagtcgagtcgttaaatgagtcattgtgctgcattgcaacttcgaccattacgccgttcttcacaccttcacagtagataatatctggatagaggggctgtttacccttatttaaatattcaacaaactccttgattccaccttcatagtgaaagacatcttttctgtcttcctcacctctgtggtcggtaagagaaatctttaaacccttcgtcaaaaaagcagtctctctcagacgaactttaagcgtatcatagtcgtattctgtgacttcaaaaattgtctcatccggtttgaatgttaccttggttcctgtagattcaggatcacacgaacctactacttcaagatccgaagtcgtctttcccttttcgtaagtctgtttgtaaacctttccatcccttcgaacttcaactacaagccagtccgagagtgcatttacaacagaagcaccaacaccatgcagacctccggataccttgtatcctccgcctccaaattttccaccggcatgaagtaccgtaaatacgacctcaaccgctggttttccagacttatggttgatgtctaccgggataccacggccatcatctgtgacagttatggtatttcccttatttatttcgacctgtatatggtggcagaatcccgcaagtgcttcatctactgaattatctacaatctcatagaccaggtgatgaagtcccttagcagatgtcgatccgatatacataccaggcctttttcttacagcctcaagtccttccagaatctgaatctgatctccgccatattcatgttcaaccatttacaacaactccgtttcttatttcaaaaatcttgttcactttgtactgattctttacaaaatcatcgagtccggtacaagtgatcaaagtctgggtatccgaaaggctttttagaaggtctttctgccttctgctgtcaagttcagacagcacatcgtcaagaaggagaacaggtttctcaccagtctctttttccatcatagaaacttcagacagcttaagtgagagagcagcagtacgctgctgaccttgtgatccgtattttcttaaatctacatcccccagatcaaatctcagatcatctctgtgaggacccttcgtagtagacccaagtctcatatcgttatcaaatgaaaaatcaagagcttcccgcataccatctgccgaaatattcttttcgtaaaaaagcttcacatcctccctttcatttgatatttctctgtgaagtacatttatgacaggagcgatttcttcgacaaactgctcacgcctttttataatttttgatccgaattctgctaatttgtcatcccaaaccggcagagtatcgagaagttttttatttcttacaatgtctttaagcagcctgttacgctgatttaaagctttattatattctgtcagattgtaaagataaattttgtcaatctgacaaagctccatatctatgaatctccgccttttttctggcccgctctttatgattgacaggtcctcaggcgagaaaaatatgatgtttaatattccgaaaagttcagaagatttttttatagggatcttgttaacagctatgcccttcgagtgattttttttcaggtggatatcgatgcgatactcattcgaatccttctcaacgatagtccttatatgagcttcgtcctgaccaaacctgatcatttccctgtcccggctgcctcttaaggatctgctggttccgcttacgcaaattgcttccagtatatttgtctttccctgagcattgtcgccgtatataatatttgtcgaaggatcgaactctatagaaagccgctcataatttctgaaattcatcagctcaagtgactttactatcatttgacgacctttatctcttccccattgtaactaaaaacatctccatcatagagctttctgccgcggcgaagttcctgttctccattaacactaacttcgccgtttaaaatgcattcctttgcttcaacaccagaaccaactaatcccgcttttttcagcgcctgaccaagctttatgaattcatctgtttctctgatctgtatttccatcttatctctgattcaaaaaattaactggcaaaataatatagttatatgtttccgtatcatttttgaaaaatgcaggtgacttcgcatccatcagatacattgttacctgttcatcatctataacacgaagggcatccagcaaaaatctcggattgaatccgatcattaaatcattgccttcctttacaacaggaatgtcttccttcaaggttcctactgcagaattgcccatcagttccaacttgtcctctgtgacatttattatgacaggcttcttatctccctctttgaccagaagagtagcgcggttaataccttccataagctcgcggcggttaataattaccttcgtcttgaactgtgcgcggatcatctgctcatagttaaaatattccccatctatcagacgcacgaccatagtagtgttttctatgtctactatcatctggttttctgtgaaatatatcattgcttcattctgctgctcacttgaaaggttctttacaatctcgtttaaagactttccaggaattactgcactgtgatctggataaggctgcttaagttcgataactctgatagaaatcctgtgcccatctaaagctaccatcttcatctggttctcatggatttccataaagacaccggtcatcatcttgttggcttcatttacagcggctgcaaatgaggtctgagtaataatattcttgagtgtaagctgtgataaaacaaccggctcatcgatttttacgatcggaagcttaggaaaatcctgtcctgactttccgataatcttgtattcagcttttccacatctgatagttgtgtgaaactggtcgtcactttcgatatatactgtatcagctggcagattccttaccatatccgaaaagagttttgcatcaagagccacgtaaccttcttcttcaactatagtatcagttactatactctcaatccccagatccatgttacttgctgtgagcttaagtacgttgttttctgtctttaagaggatgcactccaatataggcatcggtgtttttcccggtactgctttagatactacattcacactattttgaagtgctgattgggaacatgatattttcatcaggttaataactcctttcgccagtctattaaattccgcggagcggttttgcaataataataattaaatatatagtattcttaatattatagactgtggatttgttgataagtctgttaatacgcttttttactgtatttttgatcttttggttaaaaatttttagtgttagtctggtgtgaaagtatctttacagactgtgtacagatcaagtttaatctggcttaattttattttttatactgtctatttgtttcctgtactcttcgttacgtttatactcatctgcaactttgttcgcaccgtggataattgtcgaatggtcgcgtccaccaaggagttttccaatcgattcaagtggattgtttgttaattcacggcacagatacattgcaatctgtctaggctctgtgatatttttgcttttatttttagaaatcatctgatcgacggtgattccgtaggattcagctacaacctctacaataagctgtggtgtaatctctcttggtttttcaggagctataatatttgcaagttcctgttgtgcgacttccagcgttatctccttatgttcgatatttgaataagctatcagcctgtttaaggcgccttcaatctccctgatatttgtctttatatttgtagctatgtaatttaaaatctcatcgtctaatgtaatatgttcttcttctactttctttcgaagaattgccattcgagtctcatagtctggagatcctatatcggccataagtccccattcgaatctcgaacgaattctggcttctagcgtctccatttctttaggaggtcggtccgatgtgaggactatctgttttcctgctgagtggagtgcattgaaagtatggaaaaattcttcctgagtagattcttttcctataataaactgtatatcgtcaatcataagaacatccactttcctgtacttgtcgcggaactttcccatagaagtagtattgttcgtacttctaatggattctatgacctcatttaagaattcctcagatgtaacatagagaacttttttatctgggttattttggaggatgaaatttccgatagcctgtatcaggtgtgttttacctagtcccggccctccatatatatatagaggattgtatgtctctcctggtgtctcagctacagccagagctgctgactgtgcaaatctgttattgttacctactacgaatgtatcaaatgtatatttctcatttaaattggatgcggcgtagttttgagttgttgtcacatttactttggttttttctgtctcttgtttcttgtctttagccaggataaattttatcttgtactctttacctgtaaattctgcaatctttgtagcaattggtttttcgtattttttagagatgtagtttatggccatctcgtctgtctcatcagatgctacaatggttacagtctgaccctctactgaatctactttgagagggagaagccaggtgttgaaagagacgtcgtttatttcgaagtcttctttaacgctttgaagtatttgattccatttatcttgaagctcatccatcagccgttcctcgttgtgttactttttattttatattttatatatgaagaaaattttttatcttcttaataaaaaaatgttcttttaatctcaagcgataaaacgccaatatttattttatctaaaaacgtgcatagtttcaacctttaatgaaatatttgtgattatttttgacttgaaattaagttatcaacaggtttacttttccttattttacaacgtttgttgatgtttttcacatgaaatcttcagattatccacaaatttatccacttactgttgataactatatcttgttgcctgtttttgttatcttgtgcttgacaagttccctgtttttgatacaattatagtcgttgttttgtccgtttttgtattttcaaatggatttatattttaatttattataaggaggtgtttcttttatgaagatgacttttcagccaaagaaacgtcagagatcgaaggttcatggttttcgttcaagaatgagttctaagggcggtcgtaaggttcttgcagccagacgtgcgaagggtagaaagactcttaccgcttaaatttcaggccactttttgtggccttttatttttatgaagtttactgactcacttaagaaaaattctgatttcaaaaaggtgtacagaaggggcaggtctaaatcagatcatacacttgtcctctatgttttacctaatgatatggatagtaacagactgggtatttctgttagtaagaaggttggtaacagtgtagtcaggcatcatctcacaaggcttgtcagagaatcatatcgtattcatgaggatttgtttcctaaaggatatgatttcgtagttattctccgtaaggcggcaaaggatgctgattttcacctgatcgaatgttcacttcttaccttatttaaatatcacggtcttatttgacaatatggcaaagaaatttttaatttttcttattaaattttatcgtaaaaacatttctccttttaaaacgacgagatgcccttattatccgacttgttcgacttacggccttgaggctgtagagaaatacggtgcactaaagggtggcctgctcgctttatggaggatcataaggtgtaatccgttctcacatggcggatatgaccctgtgccatgattggaggattattttgccagctatttttttaactgcttccaatactgctattattggaccgattgcccgtggccttggctgggtcatggataaactttattatttaatctattccctgcttggaattcacggtggagcaatagctattgctattatgctttttaccattgttatctatatggctcttctgcctctcacttttaagcagcagaagttcgctatgctccagcgtaagatgcagccagagatgaaagccatccaggacaagtacaagaataagagagatactgcttctatgcaggctatgcaggaagagactcaggctctgtatgataagtatggtgtttctcctatgggcagttgtattcagcttgtgattcagcttcctattttgtacgctctctatggtgtatttaacaatattccagcttatttgagcagtgttaagtctatttttactaacgttgctacaggtatttttaagacatctggttttgaatcagttatgagcaaactcgttattacagctcatcttagtaatatagattttaaggccggtgattcagctgctattaagaatcacattatcgatgttttatacaagcttcctaacagtggatggaatactttacagaatgattttcctaagctgtcatctcagattgagactgcacacaggcagctttcacaggttaattactttggagtattaaatatttctgatactccatggagccagatgatgtctggtattcatggcgccggagcaggactttttattgcagcgcttcttattcctattgtggcttatctttcacagtattttaatatgaagcttacgccacagtctgataatggaaatgacgctgcagccagacagatgaagaccatgaacttcatgatgcctctgatcacattctttatttcatttacgactcctgtcggtctttcactttactggatcgctggtgctgtgatcagatctattcagcagattgttctgaataagcattttgaaaagattgatcttaacgacattattgaaaagaataaagagaaagctgcaaagaaagctgagaaacgcggtatcaagcgtgctaacatgtatcagtacggtaatatgagtaccagaaatttatctaggagtgctaatatttctcaggataaagctgatcagcttaacaaagccagagaagcatcttctaaagccagaaaaggttctatgacttctaaggctaatcttgtcaaagattttaacgagcgtaatactaagaaataaatttatctttttggagggttttgatggaggaatttaaggaatataccggtaaaacggtagaggatgctattacagcagcatctgtaggtttgggtgttccatctgatgagatcgaatatagtgtgttagaaaaaggttctgccggcggcctctttggtatcggttcaaaggacgctgtgatcaatgccagaaagaaacagacttcatatactgataaggcgaagaatttcttagatgatgtctttgataagatgggccttacagttgatcttgagatgttctttaatgatgaagaaaattctctttctataaatatgtctggtgatcatatgggtatgcttatagggaagcgcggagctactcttgacagtctccagtatttgacaaatcttgttgtaaataagggcagcgatgattatgtcagagttaagcttgatactgaggattacagacacaggagagaagagactctagcaaatcttgccaggaatgtcgcatataaagtaagaaagacacgtcgttctgtttctcttgaagctatgaatccatacgagagaagaattatccattctgcacttcagggtgaagaacatatcactactcattctgagggtgaagatccttacagacatgtagttattgagtacgttcgcaactgatttattgattttcatctgatgtttagcctgttcctttatggtaacaggcttttgttttattaagattttatcaactctatcaactttttttgtggataaagttttatactatttttattatgaataatatttcagaaactatagcagccttagctacacctctttccgcgtctggcattggaatcatccgtgtcagtggtgataagtcaattgagcttgtagataagatttaccgtggaaaaaagcatttaactgattatgacgccaatactattaattatggtcacattgttgattttaatggtaacgtgatagatgaggttcttgtttcagtttttaaagctccacacagttatactggtgaagattcagttgaagtaaactgccatggcggcatttatgttcttcgtaaagttttatctttaatttttgatacaggtattcgttctgccgaacctggtgaattttctaagagggcttttcttaatggtcgtatggacctctctgaggctgaatctgttatggatttgattgaatcaggaagtgaagcttcttatagaaattctattcgtcagctttcaggatttctctcaaaaaaagttaaaaaaatccgctctgaaattttacacgaggctgcttttgtcgaagctgctttagacgatcctgaacactataatcttgatggttttgactcaaaactctcagtagctctgaccagatggactattgagataaagaaacttatttcttcttatcgtcagggcagtcttttaaaggaaggtattaatacagttatttcaggaagaccaaatgtcggaaaatcttcactcctgaattttctatccggacatgagaaagctatagttactgatattccaggcactactcgtgatatgattgaagacagggtagtacttggtgactttgtattaaatcttgttgacactgccggtatcagaaagacttctgatatggtagaatcaatcggagttaagaaagctataaaggcacagtctgatgcagagcttaatctatatttagttgattcgtctgacaatctttctgatgaggatatcaaatttctgtcagattttgaccgcagttctactatagttcttttaaataagtcagacttagtttctaacgttgattctgatgatatctgccgctactttaaaggacatgtggttgaattctctactattacaggtaaaggtctggatgatttaaaaaatgctgtttccgatttgttctttgatggaaatcttgataacgataaattttacattacttccgagcagaattataattatctcaatgatgctttgaaatctcttgaattagtacgttcttctatcgctaatggcctttcagaagatttctttacttcagatctctatgatgcttataagtcacttggatttattttaggggaagaagtagaggatgaccttgtaaataaggttttctctgatttttgtatgggtaaatgatttaactatttttatataggtatattatatgagtcagatttgtgaaaattacgatgttgttgtggttggtgctggtcatgctggttgtgaggctgcgttggcttctgccagaatgggactttccactataatttttactgtcagtatggattctgttgcttttatgccatgtaatcctcatattggtggttcttccaaaggtcacctggttcgtgaaatcgatgcccttggaggagagatggcaaaaaatattgacaagacttttattcagtctaaaatgcttaattcgagcaaaggtcccgcagttcattctctcagatgccaggccgataaacttgcttattctattgagatgagaaaggtccttcaatcaactccaaatcttgttcttcgtcaggctgaggtctgtgatcttattattgataatggtaagattaagggtgttaagactatatctggtgcgacatatttcgcaaaggctgttgttctttgtaccggtacttatttgaatgcgagatgtctttacggtagtgttatagagtatactggacctagtggacttaaggctgcaacccacctcagtgattcacttctcgctaataatgttaaacttctccgctttaagactggcacaccgtgcagaattgacagacgctcaattgatttttctaaaatgactgaacagtttggagatcccgttattactccattttcttttacttctgataagagagctattcaaaaacctcaggtttcctgctatctgacttatactaatgagcatactcatgatataatcagagctcatctggatgagagtccaatctatgctggtgttatagaggggactggtccaagatattgcccttctcttgaagataaagttgtaaaattcagcaataaaaaaagacatcagctctttattgaacctgaaggcctgatgacaaatgaaatgtatgtcagtggagcttcatcttcaatgcctgagtctgtacagtatgaattttatcatactattgccggccttgaacactgcaatattgttcgtaatgcctatgctattgaatatgattgccttgcttctcatcagttgaaaaattctctcgagtttaaagctatttctggtcttttttcaggcgggcagttcaatggcagcagcggttatgaagaggctgctgctcagggacttgttgctggaatcaatgctgcacgttttgtccagaagaaaaagcctatattactttctcgttcggatggctatattggcgttttaattgatgatcttgttaccaaggaacttactgaaccttaccgaatgatgacaagcagagcggaatatcgtctccttttacgccaagataacgccgatatccgtctttcaaaatatggttatgaagcaggattaatttcggaagatcgtttcgaaaaagttgaggataagatagaagaaacaagggaagaaatatcccgtgtagataaggtttttatcggtgatactaagacgacacaggattttttgaaggcttatcattctgtaccagttaattctggaattgggctttcagaacttattcgtcgtcctgagttatcttatgataagacagctccacttgattctgatcgtccttctcttgatgcttctgtacgagagcaggttaatatacagataaaatattctggttatattgaaagagaaaataagcaggtcttgcattttaaaaaactcgaggacaagcttattcctgataatcttgactatgataaggttccatcacttcgcattgaggcaagacagaagttaaaggaggccaggcctgttagtatcggacaggcttcaagaatacttggtgtttctccatcggatatctctgtattgcttatatatattgaatctggtaaatatttgaaagattgaggttttatttttggctgactttgatatatactttttgaaaaagaattttaaagcgcttaatattgatcttactgatgatcaggctggtaaattcatattatattatcagatgcttatcgaaactaataaagtcatgaatctgacttcgattactgattataaagatgttgttttaaagcattttgttgattctctttcgtgtgttgaacttttgcctgattttgatattatatcaaagtttaattctggcgcttctgtaattgatgttggaaccggtgctggatttcccggtattcctttaaagattgtttttccagagattaaacttactctgcttgattctttaaacaagagagtagtgtttttaaaggatgtctgtaaagaacttaaactttctgatgtcatatttgttcatggtagagcagaagatgctgctcatgataagtctatgagagattcttttaatttttgtgtttcacgtgcagttgctaatctttctactttatctgagtattgtcttccttttgttaaaactcatggttattttttgagttacaaatctgaaaaagcagaacaggagattaattcttctaagaaggctttctctttacttggaggtagtgtttctttagtgaaaagcttttctttacctgattctgatatttcaaggactattattcttattaagaagaatatgggtactccgaagatttatcctcgtaaagctggaaccccttctaagaaaccactttaatatttacgtttggtattttttatgatcgaagaatatttaaatcaacgtcttgaaaatcttaactctgaaaagaataaattaaagtctcagttactttctattcgttcttcaatatcatctgctaagttgcagttggatgactatgtttcatctaacaccagaccttttgaaccattttatcctagaaaagattttgcctatgatgatgagttggcttttttaaataaatctgtcactgatctttctaataattttgagaatgttaattctgccttgaaatctgttgagtctgagatttctactgttcaatcttgtattctggaatataaaaaattgaaataatgtttcacgtgaaacattatttcaattctgatttgtatttacgagaaatttttcttctcgtaattttttttacttttcttagtaataatctataatactagaaattgtatctatatgtttcacgtgaaacataatatggtagtgcgcgaaaatataaaagaaaccagataaaaactacgaataatatagaaaagtttcacgtgaaatgctataatacaaaggctattgaaaacaaaatgaaaaaattttttgggagaaaaaatgagtaaagttatagctattgcaaatcagaagggtggcgtcggaaagacgaccacagctataaatctttcagcatgtatggctgagactggaaaaagagtattgatcatagatctcgacccacagggaaatacaacaagtggactcggaattgacaagactacagtagaaaatactgtttatgagttaatgctcgacgagtgctcgataagagaagctattaaaaaaatagatatcgatggagtgaagaatctgagtataattcccgcaaatgtaaatttggcaggagcagagatagaattactcggaattaatgacaaggaatttattttgaaaaatgcagtcgactatatagcagatgattttgactatatatttatagactgtccaccatcattaaatgttttgactgtaaatgccatgacgactgcagatagtgttctggttccaattcagtgcgagtactacgcacttgaaggaataagccagctgttacatacgattgacctggttcataacagacttaacagcaaattgaagatcaacggtgtagtctttacgatgtacgatggaaggacaaatctgtcaaatgacgttgttgcatccgttaaggaaaatttaaatacaaagatatacaagacgatcattccaagaaatgtaagactggccgaagctccatcgcatggtctcccaataaatatttacgatccgaaatcagccggagctgagagctatagaaacctggcaaaagagattatcgaaaataattaaaaatcgaaggataaaaatggctagaaataataaacatggtctgggcaagggtcttgacagtctgatacctgatatagtaggaaatgaagaaaagaaagatgagtcagaaaaaggtccggagactctggttgacattaataaagtagaaccgaacaaagagcagccgagaaaaatttttaatgaggatgccctgcaggaactttctgattcaattaaacagtacggaattattcaaccccttctggttcgcaagaaagacgattactatgagataatagccggtgagagaagatggagagctgcgaaaaaagctggattgaaaaaggttcctgttgtaattcgtgacatgtctgaacaggaagtcactgaagtctctctgattgaaaatatacaaagagaagatttaaatccaatcgaagaagctcaggcctataaaagactcctggaggaatttaaccttaaacaggatgaggttgcagagaaggttagtaaaagcagagttgctgttacaaattcgcttagacttttgaaacttgataagagagttcaggacatgcttgtcgaagaaatgatcacaccggggcatgccagagcactactaaatatagatgatccagacaagcagtatgagttcgctcagaaaatcttcgatgaaaaaatgagtgttcgcgacgtcgaaagagaagtaaagaatctgaaccaaaagaagccagtggagccgaaaaaggaaaaacaaaagctggataaagagtatctaaatcagctgaagtcgattgaagaaaatctaaagcaaaagacgggaacaaaggttctgattacaccgaaagataaaaataaaggcaagattgagataaattatttttctaatgaagaatttgaaaaattagtgagctgcctgaatcagattaacaaacaataatcaatgagcaatattttaaaggaaaatcgaggataagaaaatgatcgaaaaatatttgggaatagatccggaatatatattaattggagttgctgcttttgcattaattttgcttattataataatagtacaggctgctaagcttaactctctgaaaaaaaagtaccagacatttatgaaagggaagagcggagaatcgctcgagaaacttcttatagaaaagctggataaaattgacgagttggatgaaagaaacagaaaaaatgagcaacgtatcgatcagctcgcaaaagatcttgaaccatgctaccagaaggcaggacttgagaaatatgacgctcttgacgaacagggtggaaaattgagctttgctctggcgatgcttgacgagaagaataacggatttattataaatacagttcacagcagagacggatcatacagctatataaaggaaattattgatggaaattcgataataggtctgtcaccggaggaagataacgctttacagaaggctttgaacggaactaattaaggaaaatcagatgaatgatttttattgcgcggttggactttcaggatacagtgaaaatgatcttgaagacatcttcagacaagtcgaaagccagccagatacagaaatagacgcaatcgatgatgaaggaaaaagtcccgagaaaaaaatagaaataaccagatatataaaagataatctggcaataagagagcgcggatttatatataaagatgggacatttgtacgtcagaatgtttttcctatagtagacactgatagaaaagccgcgattgataatgtagatcttattgaattgaaaaacaggagaggcagcctcgttaaagttgaaagctggaaacttggctgtattcttttctcatatgttcagaacctgtatgaggtcacagatggggtaaatctgactgaagaagccaggatgcttttcaatggaataacgctgacgggcctctccaacagtggagtagtaattcttccaaaaggagatgacaaagacaaagaactggaaaagattgaaggcaagcgtcagagaataagaaacgaactcagcgccggaaaagaagaagcttatgaagaattaacattgacagaaatggagatttattctaaaatagagaacagggtcaaaaataaaggcgtttacggagtagttcaagatactttcatgccgaagagtgtagaagaagatgtctacttcgtgatcggaactattgaagactttagaaagacaagcatcgattttaacggtcagctggtctatcagctcgacttaaactgttgtggattcgattttgttgttgcgataaacagcagagacctgtttggcgaaccaaaggttggccgccggtttaaaggcaaggtctggatgcagtccaaaatcctgatgtgataacagcggtcgaaagaccgactgcatatttgtttctgtagctcagctggatagagcgctcgcctcctaagcgagaggtcgggggtccgaatccccccaggaacattacaagagaagccttacggcttctttttttattcaaaaatatataaaaaagccacggctaatttagggggagagccgtggctaaaggggagagtatgaaaaatattggttgagcggttatccactcaacaagaaagatactaaagtaaagatgtgttaataatgtgaaagaaaaataaataatttataaatgaaaataacaaagttagttgaatcaaaagaaaattaaaaaaataatttgaaaatttcttgcatttgaaaaaaaatagtgtaaagtagaatcaaaggaacaaatatcaactaatagaaaaacgaaaattattttttagaaaggggctaagatgagcaaaacggccgagaaaaaaaataaacccataaaaatcacaccatttagaatcatctttttaatttcagcgatatgtacagtacttagtttcgcaggattgatttatagtctgatgatagacgagacacttctccagaaaatatttatcgcgttcattgtttttggtatatgtactgtaattacctttatattgctgaatactatgcaggagaagaagagagaaaaagaaaccaataacatggcgatggctctccaggctatattcgatctgacaagaaagcagcaggctggccttaataataagatagatcagatgaatgaagagtacgctgtacctgccgaagagattgtaaatgccttaaaggcactggcaaagatcacagtaggacagagcaaggaaaatgcggacgctcagatgaattcaaacgcggttatggaatcgcagctttctgaaataaagaattcgattgaaaacttatctgaatctgtgacagagattaaggaacagaataaacagcggccagctaatacagataatcttacagccgatcagataagacagattattaatgaagagaatgcttctcctgaacagctgaagaaagtttcgacatcagtagatgatgtcatccatgaattaaagcgactagaatctgacattgaaagacttgaacaatcacagaaagcattggtagagaagccacctgtaatagttgcgggaaatctcgtatctggtcaggtacctgtacaacagatgcctgctgaaaattcgtatcagcagacgccggatgaagtgaaacctactgaagaggatatatcaacagacgaagagcttgacaatgaattaagtctggataaagatgatctaagcaccgaagaatcaagccaggcagacgaatcatcagttgaagatgacactgatgaagaagagctgaatctcgacaacgaattagagccagatcaaacagatgaagaagagcaggatagtaaagatgaattagaaatagaatcaggggaaaatggaacagaagacgaattagaactcgagacagaagacagcaaaacaaacgaagaattagattttgaatcagaagaaaaaaatgacgatgaattagagctagaatcagaggaagacagcattgacaaagatttaagtctcgatgatgatctagaagtcgggaatcaagctgatgaggagcagtaatcttattgcctcagctccgagatcttcatatgcatatttttcagattttttgatgcatttcgataaaagggcacctgcgccgccgatacagcgaagtaaactgcatgatttctgacgacagcgtctagtacttctctggtacgttttccctttcccgccattgctttttcgccgagatcaagaagagtaggagcgtattgtccatacgctcgcggttgtaggacctgctgagcctataggacggccttctcgtctggcgaggggcccatagtaaattgtgcagtctttcagatctatcggaagcttctcgtttttttcgatcagttccatcaggcgcttgtgggcagcgtctcttgctacgtacactgtccactcagatatacaaaatctccggcgtgaagagatcggctttttctgccgttacaggcagttccatatgtaattccatatcaaatctcccttactatgtagcggtttacatggcagcagatatttacggctaccggaagaccggcgagatgttgtataatcttcgccccgcatcggcctgtattgataaacgtccggactgagaagcagtccatggtcccctcctccacggggcacagggactttcagtgttgggattcgtgggaatcagccagagcgggtacgaatgaatggcgtgcgaatgctcgttttccgttgtgaaggagcgcgctagctgcgggccggttgaccaccgttcaagcgaaaacgcaattgaaaaacgaaccacactgccaaaatatatcaagcgttttcgcgcgtttggtcagaggcccgcaaataggcgcgcgcgactgaacaggaaaacgagaactgagcacgacatacattcgtgcccgctccggcatatctcagaattcctatggcccctcaagtcaagcgcaccatcccgatacttacttagactttatatacggctttccgtttgctgccggaacacgaccagcacctacgaacaggatcagtacgaggatagtcacgatgtacggaatcatcgagaggatgttaggcgatacagtcgaacccatagctgaaagaacggacttgaggccgttgcagagaccgaacagaaggcatccgaggaatgcgccctgcggagtgaatttaccaaaaattacggctgcaatagcgataaagccctgtcctacgatgacagtcggacggaactgggaaacagtagctagagttacgaaagctccgccaagtccagctaaaaatcctgagagaagtacgcaggcatatcttactttaaatacatcgattccgagagtctcgcaggcctccggatgctcgccggctgcgcggagtctcataccgaagctcgtcttgtagaatacgaaccagataacagcaacgaggataaagcttacccatactgcggaatatgttccgaaaacgttgtatccgaaagaaccggatttgaagacacccttgaaaagcttagggatcttgtactctgtcggaagtgaaggtgtatcagatgagttatcaaacatagccttgcagaggaaaagcgcaagtccaggtccgatgaagtttattgctgtaccggcaatagtctggtcagctccgcaggtaacgcaggcaaatgcgtggacgagtccaagtaccattcctgcgcatccgccgagcaggaatccgatccagccattgtgagtgtagtaagctccgacagcaccgacaaaggcgccgatcgtcatcattccttcgataccgatgtttacaacaccgcttttctctgagaaaactgatccgagcgctgccagaagaagcggcggggtggagatcagcataccacttaaaataagtccgaggacatttacaaatgtatccatttttcaggcctcctttgcttctgcaagctcttttgccttgtcgagtttcttctgctgtacgcctttgatgatacgtttgaacagaagtgaaattgctatgaagaagatgatcgttcccatgatgatgtttacgatctccttcggcgcgtttacaagtgtaagcttgttaccgccgtacttcatggctccatagaagagtcctgcaaaaatacatccaatcgggtcagttccaccgataagtgcaaccgtgattccatcgaatccgaaactctcctgacctgagaactgaggaatacggcctgacataccaagtgtctggatagctccgccgattccagcgagcattccggagatagccatacttgtcatgaatattctcgaagatgagataccgccgtactctgaagctgtctttgaaagaccaaccgcacggagctgatatccgaatgtcgtcttttttattacaaaccagagaaggatcgcacagatcgtggcgatgaaaaatcctgcgtttacctcggtgcatccggtaaccgggatgagtcccttgattatcgtgcgtgctgagtctttaacgttctttgtggtctctatcgactgggcctttacacctttgtgcattactacgtaatttgaaaggtagtaagcgatccagttgaacatgatgtacgagaggacttcgttgattcctctcttgatcttcatgagaccaacgacagctccccaggctgctcctgctgcggctgcggcaacgaagcagatcagagggtggattacaggtgggaaatttccaaaaattccaacgagtactgctgcgagtgaacctactacgaactggccctcggctccgatattgaatacgcctgtcttgaatgagaaggctaccgaaagtcctgtcattatataaggtgccgcatatacgaatgcgtatactatatatttcggtcttgaaaaaatgccctggaaaagcgtgctgtacgtaagtcccgggtcaattccggccgatacgagaagaattgctcctacgaggaatcctacgatgatggaaaggatcacatagatgaaatttccatcccagatactaactttagttttcatctactttgcctcctgccatcataataccgagttccttttcattggcctcggagccctttacggtaccatttatccttccgtcgaagataacgtcgatcctgtcggaaagcgacatgatctcgtcgagctcgaacgataccagaagtaccgctctgcccttatttctctgctctacaaggtacttgtgcacgaattcgatagctccgacatcaagacctctggtcgggttcattgctatgaggaggtccttgtcatttgtcacctcacgcgcaatgataactttctgctggtttcctcctgaaagctgtctggcaagtctcttgccgcagcccttcggcctgatatcaaatttatcaatgagcttgtctgtaaacttagcgatggcgtctctgttcaggatgccgtgttttgagaactccggcttggcgtagttctgaaggatcatattctcttcaactgtgaaatccattacgaggccgtgcttctggcggtcctccggaatagatgaaactccgtcttcgaaaatttccttaggttttttattgaaaatatccttgccttcgatagtgatctttccggattcagccttcataagtcctgtcagtatctcgacaagctccgactgtccgtttccatcgactccggcaagtcctacgatctcgcccttgtgaacctttaagttcaggccgtttaaaatctcaacgcctctgtagtccttggctttgaggtcctctacatcgagtacgacctctcccggctcctgttccttcttgtcgactttgaactggacgtctctgccgaccatcatctcagcgagcttgttctcatcgactttgtcgacctctacagtgtcgaccattttaccctgtctgatgatagtacagaaatcagctgcctctgtgatctccttcagcttgtgagtgataaggataacgctcttgccatcttttgtaaggttcttgatgatctccatcagctctgtgatctcctgaggagtaagagatgatgtaggctcatcgaggatcagatgtcttgcgcctctgtagagcactttgagaatctcgacacgctgctgcattcctacagaaatatcttcgatcttcgcatccgggtctactttaagaccgtatttgtcggaaagctcgacgatcttctttctggcgccgaccttgtcgactacgattcccttcttcggctccgcgccgaggatgatattctcggtaactgtaaatggctggatcagcatgaagtgctggtgcaccattccgattccaagctttatggcttcctcaggtccattgatctttaccggctttccgtcgatctcaattgatccctcattcggctgataaattccgtagaggacattcatcagcgtactctttcctgctccgttctcaccgaggatagcgtgtacctcgcccttgtgaacgcacaggttgatgtggtcgttcgccgtgaaattgccaaatcgtttcacgatccctttcatccggatagcttctacgctcatatccgcattactgtcttttttcaccgcatttacctctcttagactaatacaacggttttaactccaatactctctgccttgatcttcagttgattcatgtaatccttcttcggaggattcatctcttttgcatatttctcccgaactcccatcggccggtacgtgatgatcttgtacctgacttccggaaaatcctttatatactctgatacccggcttatcgttccttcgacatcaaaaagccccggaaccaccacagtccttacttcgtagatcttgtgacgctccgccaggaacttcaggtttttaagtaccatttcatttgaaaaatctacgaccttcgcgtgatcttcctctgtccagctcttcacgtcgagcatcactccgtcgcagactttaagaagccccggatcctttgaaaaatcgtagcttccgttcgagtcgataagcgtcccgagccctgcatttttgcaaagtgtaaacagctcccgcagaaaatccggataaaaggtgcactctccgccagaagtcgtgactcctctgatatatgggacctgttttttgatctcttcaaatgtctcttcaggagtcatccacctgatccgtggtgaagcgtcgtgagtgcaggtcttgatgcaggtgtcgcaggctacacacttcctgtagtcgaaaaccaccttcccatcttctatagaaagcgcctttgccggacacttcggaacgcagtcgccgcagtctgtgcagagctttctggtctcaggattgtggcagtagcggcagtcaaagttgcatccctgaaggaagactgccgtcctgttgcccggcccgtcgaccgaagagaacgggatgatcttgttcaccgggtatctctccatttttctcacattcctttcgatggccaatttatcttactttcctctcgagaatgtggccgttgtgcttggcacccattccaagtgctgtggtatcctgcataacgttctcaccgttctcaagcttttcgatctctgacttctttacgagatagcccgtgatcctgatgacatctgaatccgatgcgtagaacgaaaggtatctgagaccgtccttgaatgcgccctttatgatgtcaagcagataatccgtgttcttgtgaactgtcgtatcgatcgggaaaatgtctcctgtgcctgcagggaaatacttgtggaatcttgaaagaaccctcaggtgatcgatcatctcatccggctcctcgccgatcgggattctggttccaggtgtgacatcgatatccgatgcgataccgacctgtgcgtgaagaagatagtgtcctccggtagcttcgcaataaggcgcctcgtggttgttgttgaaatcattgataatatccatgatctcgactccgaggtcatcagcttccttcgaatgtccgaagcggacgcccttcttaccctctttttccataaggatatttacagcgtctgcaagtcctacgaggccgtacattccggtgaacttctccctgtggatcaggccttccttcgcgaggaagttgttctcgaagaatccgctctcctcaacgatgaacttcactctggcatccatatatctggcctggatatcgagcacatatggaaggacatttttcttaaagtcttctatgtttttcgctctcttggcaatatttccaaggatgagtcttacaagtgtgtaggatccgccgccgtatttgagtccgttgtagcagctggcgataacatagtcctcgccaaggtcgtttacgaacatcttgtgatttgcgaacgaaggctttgccgacttaagtgtcgtctcgattccctggattgcgaaatcgtccggtgtaatatccggatcgtacttcatcgtaacgttcggcactgtatcgcaggtctctgcgactgccttcataatgatgcgtccagctctcgtagcctctggtccgatattcgaatggcagaatgaatcgaggatcgttctgtccatgtggatcaggaacatcttcgtaagcttgagtgctgtctcgtcatccacatccttcatataaggatcgaggagcttatcaagtgctccgacatataccgggaaattcgtaactgaaggtacatttttgtaaataataagcaggttgttcatggcctcaagcaggtcgtgcgccggctcaagccttaaaaagctgcttccctctcttaaaaatttctcgtaatccgggataatataacgcggtctaagcggtgcatgtccctcactcaggtcgcagatgcactgtttgtcgatcggcgcatttaataactcatcgagcccttccggcaggtctaatacttcaagaagtgaatcggccagatttgccatcgtagccactttctgctcatgtgtgagcgtagggcttttgaccgtctcaagcatctgatctcttgtactgttcactctatccatgctgatatcacgcatactattaaatctcctgttttcccttttatagtggaagagccccgagccaggtaatgtgactcgagactccaaaataatttatagctttttaattatttgatggtgtaaatacccttgccgtatttgctctcgaaatcagatctggtctttggaactgtgatctttccatcgaggatctgctgcttaacttccttaacctgctttaatacatccgggtcaaggttcttagttgtaggagcgatatcaacgccgccgtccttaagtgagaacttctcaacgccgccctttaccttgccttctactgtatccttggcaactgcgtaaactgcgttatcaactctcttcatagctgatgtaaggatggtctttggagcgatatgatactggtctgagtcaacaccgatagcccagattcctgcttccttgcaggcatcgataacaccaagtcctgtgccgcctgctgcctggaagattatatctgcgcctgctgtgatcatagcattggcatctgactttccggctgctgtatcagcgaagctgttagcgtttgcaagctggatcttaatcttctttcctgctttctttccagcatcgagaacacctgagcagtaaccaaatccgaactcgttcatagtatctgtagactgaccgataacgaatccgacgttattcttctttgtagtaagtcctgctgcataacctacaaggtaagaagactgtgatgcctcgaaaataagtgaggtaacgttcttcatgcttgcaagtgatgaatcatcgacaatagcgaacttctggtccgggtttgctgtagcctcttcctttaaggcattagcaagtgcatatccgatgcagatgatcatgtcgtagttgccatcgatgaatgtctcgatgtttggcttgtagtctgcatctgtcttagactcaagatacttggcctggatcccgagatccttctgagccttctgaaggccttcccaggctgactggttgaatgaaccgtcgtttacgccgccgacatcagttacgataccgaccttaacgctcgatgccttcttggctgaacctgatgctgctccgcttccgctcttggaagctgttcctgatccgcaggctgcaagtgacagtgtcatcgctcctgcgagaacaagtgctgcaattcttttaagtttcatctgacaaatcctcctttattaataattgtcagtttctggcagatttttctgcctgtatcatgagcctgatagcttcaacagctgtacggatggccccctccgtatcatgcacctgtgtattggaaaggcctttcgcggctctttcctggttcgcgatcgcaagaaaacacgaaccacatctgacgcctctggcggctgctactgtaaaaagcgccgccgactccatctccgatgccagagtcccgagcttcatccacgcgtcccatttgttgatcagctcatatccgaccggcatcttctccggctcgtgctgtccataaaacgcgtccttgcactcgacaactccaagatggtatgtctctttgaggttctctgctgcctgcttcaaggctgccgtcacgtcaaaatccgccactgccgggaactcgatcggagcgtactccttgctggtcccttccattctgatggcgccggtcgcaatgaccaagtctccgcctttgacgtcgagctgcatccctccgcaggtgccaactctgataaaagtatctgctccacagtggatcagctcttccatagctatggaagcagaaggaccaccaactccagtcgaagtaacgctgaccttctcaccgtccagcgttccagtataggtcgtgaattctctgttcgacgctacaaaatgcgcatcatcaaagttcttcgcgatcttctcgcatcttcccggatctcccggaaggataacgtacttaccgacttctccggcaccaacgcctatgtggtattccttacctgcaccttctgtgtaatcgatcatacacttcttcctctcgtctaaaagtagcctaagcttttctctataagagcactatacttctattgcagccgctcaaaaaggacatttgacatctttatcgcaattttatatagtctccacaaatttgtcaatagttttttgtgcatcttgcacaggacaattggcactttctcacaaagtttcccaagtgggacagtagtgggacagtagggacggttctttttgtcccactgtgcacaatcgtttttctccgtgacactcccctccaaataggttataatatcccggtaatcacgatcacgaagacgaggtttttatggaattctgggatatctatgacaaagataaaaaactgaccggccgcaccatggtgcgaaacgactggaacatggccgacggcgactaccatctgaccgttctcggtgtcatccagcgtccggatggaaaatatctgatcaccaggcgcgtttctactaaggaatgggctgccggctcctatgaagtcagtggcggcggcgtccgcgccggcgagacttccgaagaggctgtacagcgtgaagtaaaagaagagactggcctcgatataaaaaatgccgtctccggcggttacgagttcacctacaggagagacaatcccgaggagcggaacaattactttgtagatgtatataaatttataatggatgtcagggaagaggatgtccgcctgcaggtcgaagagacggccggtttcgagttcgtcgattctgacacaataaaagccctcgcggcgcaggggaaattcctgcactacgagagcatcaaacaggttcttgattgatttttaactaataaagattttcctttccgggaccccggcattctttaattctttcataagaaaatttatcatttcttcttttatcgcctgcggataaccggcatagccgccctccgtaacaaacggaaactgcgcagcctcgctgtctggctctgcctcgcgcaggcgttttagatattctttagaaatcctgaatgtcccgattccgaagtcacggactttgctaagatctacacatgtggcaagctgccccacaagctccgcgtaatctttccgccagtttttcacatagatcatcggatcaatgcagagtctcacggtcgcattcttttcaatcgcagaattcgcggcatttactctcatctcaagaggcgccgtatggtgctcaaatttctcaataatttccgtcggcgagagcgtaaaagccattataaaatttgaagcagttgaaaagttctcaaatgccggcgcgcccttcgtcctgacttctatctcacactcgggatggttcgaagcaaattcctcccagagccggcagtagccggtcaatttctcaaatgagaacaggtccgtatcgaatgagaccgacagatacattgtctgccggccactgatcccggcaagcttttgttctgcggcctcaaaaacgtcctctatatttacaaaaatgaccagatagccgcagtcatacatccccttcaaaaagcagtattcgcagtcatagaggcagtttttcatcagtgaagtgtagtagaactcgcggcgcccgtagtcctggcacatcggcgagccgcggtagataagctctcccgatgccttagccaggataagcgagcggtgttctatttgaaaatggatgtcctgctttttacgcccgaagagctccatatacctgtctatataaaaaataccgtttgagcggcatttcttcaggatctctgctgtgcgcggatgatcttttatctctttttctatataaatatgattaaactgccacattatctggtactctcgcgaagcctgatctcaaaaccttccatcggaatatctgaaacacccactccatctatcatttttatcagagtttccgctgcttttcgccccagactctgtccatcgtacctcaccgctgaaatcgcaggagcagtctgctccagaacgggtgaatcgtagaagcttgcgacagagacctgcccgggaatcaaaacatctttagctttgcagatttttaaagtccgttccgcgatatcatcgtccatgcacaaaagacagtctgcgcctgccgcaagagctgtggcaatggcgtcctccaggacttttttatcatgcatgtccatgaaaagtagatcctcatctatctcaagaccattctctcttaaagctgagtcaaatccctcaagcctctgcgccgttacaaaatgctcgctcgaaccgccgaaaagcgccggcttctttacgcctctctttataagtctttcggtcatctcccgtgacccgccgacattgtcgttgtcaatcgaaacgactccctctacctgtgagcttccgatcacaacacacgggatattgttttccgtgaggtatccgatccttttgtcgtcaataaatgtgcgcgcaaggatcacaccatcggccttgccattacgcacgatcctctcgagctcattgacccggttgcccctctccgcggtgatcagaacatcgtagccatgttcctcggtgccggaaattatcccgaccagacacctgtgaaaaaatgccagtgccgtcgtttcgttatcatccggcgttacaacagcgatattgtaggtacgcctctgtgccagtcctctcgccatgacgttcggctggtagtcgtgctccgcggcatattttctgactttctcctttgtcgcctcgctgattcttccctttccagacagcgccctcgaaaccgtcgtctttgaaataccaagtgcttcagctatatcttctatcgtaatcgtgtgcattctgtatttcctctccttaaaatattttctcactcaatgaaaattagctcccgttttttctgaacattgtgttctctttgtacgtttccgaacatttcactctatgtattctcttttatgcatttacatagtacaatatctgatataattttacaacgtagtgaatgtaatatcaattaattaggaggctaaatatgcacattcctgacaattatctgagtccgcagacctgcgcggtcatgtttgcggctgcagcacctgcatgggtcatttccgtaaggaaggtaaaaaaggaactccctccagaaaaagttgcaatgatgggtgtcggagccgccttttcatttctcggcatgatgtttaatgtcccgcttcctggaggtacgaccggtcacgcggttggaggaacgcttattgcgcttttgcttggaccatatgcgtcctgtatttcggtgagcattgccttgttgctgcaggctctgatcttcggagacggcggtatcctctcgttcggcgcgaactgttttaatatggcgtttgtcctgccttttgtaggatatgctatagctcatgccatttctccgaactggggcaaaaacaaaaaacgggacctgattggcgccggcatcggttcctacataggtataaatgccgcagctttatgcgccgcgatcgagttcggcatccagactatgctgtttaaagatgcgtccggtaatgcgctctactgcccttacggcctgaatgtctcgataccggctatgatggctggccaccttacactcttcggtcttgcggaggtcgtttttaccgttgctgtccttgcttttgtctggaaagctgctcctgattttgacaattctactgtcaaggcaaagaccgctcttcctgtaaagatccttctcggcgtccttatctgcgctgttcctgttggtctcctcgctgaaggcactgcctggggtgagtggggcgcagatgaaatttccggaaccggcgctggatacgtccctaagggaattgcccacggtatcaattatccggctctgctgcctgactattcgttcagcggactgcctgactggttcggatatatcctcagcgcagtcgttggtgtcgcgctcctcgtgataattttcagaattatttcttatattgcttcgaaaggaagccgttatgacagagcggttgcttaaagcgatcgccgctatcgttgacagtgattcgaattcagaaaaaaagccgtcacggatgagccccgctttgaggctcgccgtggcggtctttgctattgtactctgcgcctgctcccgaaacgctgtctttgtgataacggtcctcactgtcgaattgatccgcatggccttattaaagcctgatcgtatgatctatgtcctgaaaaagctggtccttccgatcgttttcaccttgttgataatgcttccagccgtttttttcgggcacagatcgacaatgcttactgtcacgatgaaagttgcggaatccgtactgatcctcctgcttgtaaatgaggatttaagctggaaggagatcaccggcgttttttccgaaatccacctgccttcggtcatcacaatgacgctcgacactacggtccgttttctggtgctcctcgggcggctcgccgagaggattcacgaagcttacctgctccgctccctcggccgcgctgctgaccgcagaaaaatgtccgccgccggcggaatcctcgggactgttttcctgaagtcgtctaaaatgtctcaggaatcatttgaagctatgcagtgccgcggctacaacggcgcctacaggcgcctttcccggcacagattctgcatctgggacgccctgtatctctgcgcagttccaatgcttgtcatttttttcataatcactcagaaggctatatgaacacgatcgaattaaaaaatgtctctttcaactacgatgacgggacgcctgccctggaggacatcagtctgtcgcttgccagcggcagatgttacgtcatcaaaggtccgaatggctgcggaaaatcctcgcttttcaggattctaaacggcctgtctttcccgactaagggtgagtattttttcaaaggtactgctgtcacgccgaaatttcttcatgataagaaaaatgctgccatttttcattcgaagatcggcttcctgtttcaggacaccgaggtcatgcttttcactggcagcgtcgaagacgagatcgctttcgggctctatcagctcgggctttcagacgaggaagtgaaaagccgcaccgggcactacatctcagcgctttctcttgaagctctgcggcgccgcgctccgttcagcttgagcggcggcgaaaaaaagcgtgtcgccctcgcctcgatcctcgctatggagcccgaggtccttattatggacgagcccttaagcgggctcgacgaagacgggcagagctggatcacagacgcgcttaaatcgttaaaaagtcctgaacggcttttgcttatcgccacgcacaacgaccagctcgtcagggaaatctctgatcagactattcttatggacaaatttcaccatattgtaaactaaaaaaactccctgggaaatcccagagagcttttcaattagtggaacggatggggctcgaacccatgacaaccaggttgtgaccctggtgctctcccagctgagctaccgttccaaaagccgcctgctgctgacacatcagtacgtctgcctacgctaaaggaaaaagctgttgtcagcacgggagccgcgcgtaacgactccttactcctcgaacaggtgactaaatcatataataatacttttctttttatttttcaataaccgcgataacttcaatctcgcagagcattcctgccggcaggtccttgactgcgacgcagcttctggaaggcttcgatatgaaatatttctcatatattccattgaaagtcttgaaatcgtcaatatcagcgaggaaacatgtcgtcttcacaacatgcccatagtcggtccccgcctccttcaagagctctccgatattcttacaaatctgctcagtctgggcctcgatgccagagacaggcttcccaacagccggatcgatcccgatctgtcccgaaagataaaccgtatcacccgcaacaatcccctgcgaatacggcccgatcgcctgcggcgccttgtcagtgctaatgtacttcatagattttctccttccaaaacaaaatttccacaaacagaatagcaccatccccttcccccgtcaactgggtcagtagggacggttctttttgtcccatttttagaattttcagactttttatgtcctggtaaaaacactgataattggacaaccggcggaccactccatacgcaaaaaaagcggtgcctttcggcaccgccaagggttttcaggttatcagctgatattcgaaatcagtgaacttcaatcatgtgtgaagtgtctgattcgatcttcttctgatccttctttgggagctcaagtgtaagaacaccgttcttgtagctggcgttgatatccttctcggtaacctcgtcgcctacatagaagcttctgctcatagcaccttcgtatctctcttttctcaggtacttcttgtctttcttgtcctctttgtcaagtttcttatcggcgctgatggtaagataaccatcttctagagaaaccttcacatcgttcttatcgaatcctggaaggtcaatggcaacctcatacttgtcgccgttctctctgacgtctgtcttcatcatgtttctggcatgtctgccataaaggactttgtcaacatcaggcatcttcggcatcctgaaatcaaaccagtcgtcaaagtcatcatcaaacaaattctctccaaaaatactcggcatcatcatacgtcattcctccaatctgtacggcacctgcgaactcttcatcaggcgctgcccaatattttttgaagctctttgcttctctctttctcatctctcacctttcgattatgttataccacgttttgttagcactgtcaataggtgagtgctaatttttgaaaaatctttttgggacagcgtgatatgtacccagaatcctggacacatatttatgatcaagcggtacaaatggatgcttcacgatattgaacaggaggcatccattttgtttttgcttgaattcgtttattgttataataatcgatatattcatctattgcaattgaaaaagacttgaagctgccaaaacttttctcattgccataatacatttcatttttaagtcgtccaaagaaagtttccattatacaattatcatagcagtttccttttcttgacatagactgaataattccatgttcctttagtctggatatatatgtggcatgctggtattgccatccctgatcagaatgaagaatcaggccattaagagatttaaacttggcaaatgccctatcaagcatgttgtttatctgagccatgtttggactgagtgacaaatcgtaagatataatctcatttgtgtgcatatccaatattggagaaagatagcatttgccccatgaaaatttaaattgtgttacatccgtagtccatttttctagtggagcttttgtactgaaatccctgtttatgatgttatcagcgaccttacccactgtgcctttataagaattgtatttttctttagggcgtttgcctataagtccctcttcgtgcataagcctctgcaccttcttgtgattgattttcataccaaggttacgcagttcatgatagatcctacggacaccatagcggcctttgttggcatcgaagatcttattgatatcattgaccaggtctttatttctgactgctacagcgtcattcttgcctatttcaaagtaatacgtagaccttgacatacccattgattttagcaggagtttcaatttgtatcctttttcacggaggtctttgatgattgctgctttttcgccttgagtagcgcagcttccttttcttctctcaaggctatctctttttttattacttcaatctgtgttttgataaacttattctctcttcttaaacggataagctcatcacgttctgattctgataatggtttagtttcttgaatactttttgacacttgttcttgctttttccctttacgtttattgacaagaccatcataaccatatctcttatatttgttaacccaagaacaaagtgttgcagtttccagatttgctgaaattgctacagacatagcggattctccagccataactctggctacaagattaaatttatcatcagctgaaaattgcctactgcagcttttatgtttgagagcatcgttcccacaagtgtctgcaagtctgtgccaaaatcggactttactttgaaaactttcttttgacacaccttctggtgtcttcggatatcgtcctttacgatgctcttcgacacaatgtagtttgaattcataagtgtagtgcatgataaaacccctttcactggatgtttttttgtccagtaaaaggggtacatatcagcggggacggttctaaccgtccctttttcagaattttcagattgtgggacaaaaagaaccgtccctactgtcccacgctgtcgaggatcaggtcagcgaagcctttctggccgtcagtcttcaaatgtgtgccgtcgctgtaaaaccattccggatgtttgctggcgagtgaaggccagtcgatcagcgtgatattgttgtgttttgtgatatatttcttcagctctgagattacggtgtcctgccactgcagctgcttgccgtacgggaggatccagtagacctgcctgtctgcgccgatggctcccattatcttttcgaaagtatcgctgctgaacgcgccatttgttccaagttcgatgattacgatatttccaagcttcccagcttgtttttgtttgatgatctcgcttgcagcgtccctcgcctggcgcgatacgcttgcatcgatcacagcatttggaaattttttccgaagcacgtcataggagccaagcataacagagtcaccaaacatcgtaacactcttgttcgccattctctttatttttttggaattgtcggccggcttctttgccggtttctttttctttgcagcatttccgctcgcctttttcgccgcagctggcttgtcaggctttgatggagaaggcttctttgccggcttggccggtttagcaggctgttccgcctgggtggcagattttttggcatttgcctcgagctgagcctggagctcggcggaatcgtcttttttcacgagtgccggagatataaaaataattatgacagcaacagccgaaagggctgctgttacaagatacccggtattttttttgaagctcttttcctgaatagtccttgccagtccaataggcgtcagatattttgaaaaaatatggagcagtacggtgcatgcaacgataagagccacttcaagcaccgcatccttatactggctgcccagtctgatcttcagtgatacgataaaaatgaccggatacatcacaagataagtctcgtagctcatcctcccgattatctgaagcggcgcaacatcgaggatccgtccggcggtatcgttgcccgaaatcagcactattacaaatgcgcagataatcgaaaagactggaagaatcacgcggtatgtgactgcatccgttccattcgtcgtaatgtataaaatcaccattgcggctataagccccgcaagtaccggaagcgctacgatattattaaaccttgggagcctgtttttttcatataaaaatgcaagtgcacttcccaggaaaagtgtcccgatccttgtaaatgttccgtaatagaccggtgtcgggtccgttcccggcttgaaagctgcgattcccgcaatgatcgacgccactgcaagtgcaagcattatcgggaagccgaggtcaatgtccgtctccttctctatttttttgatcagccagaagatgaacgggaatacaaggtaaaactgcagctcaacggcaagagaccacatatgaatgaaagccgagtgacttgacacatttgaaaaatatgagccattcatatgaatctgccagatattattgtatccaaaaataatagacgcagcttcacccctgatatttttaaggctctcaggtataaaaattgccagcaatatcactgtgacaaagagtgtcataagcatcgccggatatatacgtcttattctcttataaaaaaatctgccgaaatttattctatggtttctttcgtaggatttgctctccgacagcgttatcagaaatcctgacagcgcgaaaaacatcgaaactcctaaaaatcctcctgacagcacatcaggcagcatatgatagatcacgataccaatgattgcaattgcacgaaggccatccattccggctattcttttttttgaactaactgctggcattttttctcctataatctgttttcaccattcacaagccgaaattatatcatgcaaaaattattttgtacagtcaaaaggatgatttgccgtctttctcatgcactaaatttgggacagtagggacggttctttttgtcccaaaatcagaattttctgattttgggacaaaaagaaccgtccctactgtcccactatttcaggaaggcgtcgattccgtttgctattcctgtgacgattttgttttggtaggctgcagtctccatcagcctgtcttctgatggattcgtcatatagccgacttcgacgatcgtagctggtacgctgcaccagttgatcccgctcatggtgtcggtctgccatacatattggcggtgacagcctgtcgatgcgacgaggttgcttagtatatccgacgaaagggctgcgcttttgctgtgcagcctgccgttgtatgggtttgacgctgtctggcagattgtcatagctcctttgagagaagagtttggcgagccattcgcatggattcttacaaaagcagccgcatgtgcgttattcgcaatcttggcgcgctgcgagttgctgatattcacgtcgttcgaggtacgggtcatcaccactttgtaacctctgcgggctagttctgcctgaagcttcaatgacagctgaagcgtcagtttgtattcaggaactccggttgctaccccctgcgttcccgatgaaaccttcgctttggtagttctggcaccaggcccgaccggctccttggaagaatcgtcgtgagcctggtgtcccgcatcgatggcaacaaccaggccgttggtcttcttcttatctgatgagctgtctgtctgatctttatcagaagatgtctccacatcctttaagtacttccctgaaacgtacatcacacggtcatccatgtaaatttcgctccagttcctgtcgtactttacgacatcaactctggtatctgcatcgagcctgcagtagacctttgctttaaagcttggtttttgtctgacattgacaagctgcgttgttaccatttccttaagcttagaagtatcaacctttttttcagaatcattttctttttttgagacttcaggctttttccctgtcaaagcagcatcagacgaggcttttactttggtgacagattgccgctcagtctttttctcggttgaaatctccgctgacttccggctgctgttttgtgagccgcaggtacaaagcccgatgcacattgaaaaaatggccagccctgctgccgttcttttaaatttttttagaaaatcaaacatatcacttgtcaaatgtagatactactgaatcgccctcaaaagaagtccagcttttcgtcaggtttctgacagccttgtccagatcatccagtttttcatatccgtaaaagctcgtgttataataagagtcatctctattatagtttacgtatccgtctggaccaccttccacctgatatttcgtgcagatcgatccatctgtacctattccaacattagtgatatcagtataataataaaagcttatcttatcgctgaaatcttctgagctgtcaaaatcgtctttgtggtttatttttgcagtaaccttatataccataaatacgccattttcagaattgctgctgtcttcgccaggtgcaagtatataataccctttgtactcatacccgtcgagtttgcactcatcatcccattctgaagtggagtcctttatatccttaactgcttcctctttaagtgttttcaaagcagcatctgtcatctgatttgtggagctcagctgtgtacccaatccggaaactgtatattcctttgaagatgcttcaggaatatttccatgttctgatatatattcttctggatcgaagtcgatcgttacagtaaccttatcgccgtttttaagggatccattgttatcactcagtgaatacgtaaggtctgtcttttcatcctcataataatcttcatcgtcgtcagtatcagacgattgtgtaccagtaattaccgctgttccgtgagaggaaaggcctgaaaaaacaaccttaatatttgcaaatgcatcaaacttagttactttttcaagtcctgaaatcttctttgtaaccttgcctcctgtaaatttgattccatactctttgatcgaatcattcagattgttgaactttactgtaacagtatctccatttgacagatgctctgtcttgccagtcgtcgcatatgaaaatgcatcatatattttttcaactctgctttctgcgatttcagcatcactcatactatcaaagaacagattccagtcatcaatagtacttgcctgttttactttttgataaacagaacggtcaatttcccctttctttccgagggctataatgatatcctttgtaagcttttcttctctgacactcacatcagcgctcccataaccgtcgtactttccatccgtagttacaactatatagtcggaggacttgagtgttacaggtgcgactgctctataaaccagaaatgctatcaaagccgcaactgctgctgccgcaataattataatccgcttaaggagcttcttatccatcggttttttcgcaacagcattctgggcattatactgctgcggaccattctgctggtaatactgctgctggccgttctgctggtaatactgctgctggccattctgctggtaatactgctgctggccgttctgctggcaattctgctgactgttctgctggtaatactgctgctgagctgtattttcctctgccttcggagcttcatcagcagctgtttcctgttctgctgtactttcagactgtgtcccgacgtcttcgttttcgttctgaactgcttcttccggtccttcagatgcaagcttgtcattgtaagccggtaatgcatccgtcacgttttttccacagtatccgcagaacttcgcattgtcatcaatctcttttccacaatagggacagcgtttcatttacattcctcctcaaatttgctatttattgttttctgttccctcaggtgcaccaccatttgaattgacagcttcatcaccggaagcttcatttgtagtttcggttgcttctacatcagcatcttttttcagattgtatccacaatttccgcagaaggcttctcccccatatagaggtgttccacagttcggacagaacatgattggctgctttggcttctcttcttctgcatgagcctgctcctgctgttcctgcccttccatctgtgaagtcggaaccggcttcgggcatccgcagtttccacagaatgacatctgagaagcatttgacgctccgcatctcgggcatttccatgcgttgttcaacttgttaagctgttctaccagatcggctttgtgctgtatcagctgcgcaatattgttaaacgcctccgtgtattccggcggtacattctccagatgactgttgtaaaactcattaccgagagacgcaaaagcctgctcaatttttttgtcagtgtctcgtattccggcattgagctgatttgtctctgtaaaattctgagcgctcttctttaccttttcaccatagtttttaaaagtgttgccgatattctcaaacataattcgctccttctgtatttaatttgattttgcacggtacttttcgagcttctccagatttttcttctcatatgaattgaactgggaaaccacatcctgctgatcatcattttctgatttatagcccttcatgttctttttataataatcgttgagctccttgctcttagtgaatttataattatgacgggcatacatctcattcagggcatcctgaatttcatctttcgacagatcctctaattcgctatcggaaagtactctctcatcactgtccgggaaaatctgtccatcgactgtatcgtgccggcctttcggtgatggatccgtatctttagtgttttttgtctttttatctttgctgtcttcagttttctttttgtctttgctgtcagatgaattgtcggagtcgtctgctgaccatttatcgagattactgtcatctgctgaagaggctgacttatcctgaactgttttatcagaatctttatcagcactatcacttgatccatcagagctctgtgaattggcagcattagaatccacggcagagtcctttggcttctgggcttcgtcagacccacccgggttctttgtttcctctgttttagtgctgttggaattattaaaaataactcccttcttatacagtaaaaatactgctgcggccgcagctgctatgatcacacatatcagtatgataagtaccagatggttgtttttctttggtgccccgcctcgatttgaaggagcatttctattgttgtcacgtggcggaaccggcggagtctgccagttctgcggtggcacctgctggttattctgaaactgctggttctgtggcggaaccggtcgctcatctcttggcttgaatccggaaatatcatttatgtccggttcggcattcgactgtacatcaggttctgtatcagcctgcacattgagtttcgctccgcaatgcgggcagaattttgcattgggatttttgatttcttttccacaataaggacaaaccatttcttacctcttttaacataaatgtataaaaatcactctatgatatatgcgtctacgatctcgcctatatacgtaatgtgagtatcattttcactcgttttatagaaactgtctttggcctcgtcatcatagagagaaagttcctgctcctgtctgtagcggagcctgcactctaatgtcagaggatactcctttattcccggaactccgtttgtctcaggctcttcaagtgtaaggcccgcctcttttactttatcaatatcccgtccgcttttgcttccgcagacatcgaatatttttttaatcgagccattcagcgggacgcttactgtaaactccgggttcttgtccagctgctctctcgtgaagcggcttttgcggacataagccgtaaagcatggaactccccagtttgtgccaagagctccccatccgatgatcatcgtgtcaaatttgtctgccttcgtattcagaagaacaccttctggaattgctttaatgatctggtttgcatacccggtaatatttatttttttcttcataatatgatcctttcttctatttttccaatggagttccgcaatgagtacagaacttggctccaggcctgttctctgccccacaatttgtgcagaaaatcttctcaggctgctgtacctgctgacccgcctgaggctgctgtacctgctgacccgcctgaggctgctgtacctgctggcccgcctgaggttgctgtggtttaggctgcggtgccggacctgcgttatactgctgcccaccgtagttcattccattgttaaaattctgctgaccattccagttcatactgcctgggtttgtgtatgaagcggtaaaatcctttttgctgtaatacatgacagccatgataataaccaggataagtccgattatcgctgctgccgttatgctggctccaactgccgcatatccgtaatcttcatttcctacttccttatcaaatgaaattatcacaaagattgctgcgatgaaattcactgcatatgctataagatatggaaggacagcctgctttttgtcgaagaaaagaagaacgagagtgataatgaagcagattataagtagaattcccattaaaataaggaacggcgtaagtgaattcgcaccatctgaattaaggtcactaagtgattttattgttttcgccagagagaagaaattataattcccctttccgaaaacattctgcccgaaaatctcaactcttatgtgaaaccacggaataaagtaaaaaataaatgacaggaccgcaactacaaaagttaccagttttttagtctgtgaagcagactgataattgttcatttctcaaactcctttctgaaatgtgtccgacagaacatcagacatgattaaatatttcgaaaataattataataccggctcttttttttgtaaagaaaggtgcccttaactaatttatacgcactttacaatcaggttttcgctgtcaaaacagactgtatctccctcatttatatccttatcatacagttctttgtcagaaacctttctcgcagtttcctggccatcttcagcttttaaaacgacccggtccatagcagtctgtccatccggtatcccctcgcagccgaaatcaggctcgacgattttctccacaatatacttcaatcaaatgcctccttatgaaatttcatgctcttcatttgtctccccggtaccacttgagcagtgccataagatcttttattttatccttgatggcagcgccattgtctgcatcactgaccaggattctgtgctcatatctgtcaacaagctttgagtcggattcgatgtcagcattttccatcagtgccgattcaatccctccaaaaggctggtgcgatttgagcctgagtccgtgcgaattgtagatcagagtgtagccggccaggcctgtcgtcttgtgcatagagttggtgaaaccaccgtctattacaaagagcctgccgtcggcgcgcaccggctgctcaccctccttgactttaacaggagtgtggccgtttatgatgtgagtgtgctcaccatagagtccaaattcacgcaggatcatatcacagactctcttgtccctgtaaaaagtataatatgggtcctgcggctctttccatgtgctcttgtctgagatgaattctctctcaaatgttttcaaaattctcccgcagagcggcgagagcggcgcaccccagaggaaccacatgaaatccagatcggactggtgtctttcggtgatattttcatttaaaaaacctgtattgtgggattgtgaaaaagctctcctggcaatctcatctgcgagatccagatattcctttcccttgtagatccggtctccgtgagttattccgacaaaattgccctccgaatccataggaatgcagccatggtagatcagattgccgttgaattttttgtacatactgcccttttcataaagaaaagtaacatgatcagccagacgctttgaattcttaaaatcatccgtgagatcagatatcagcttgtcctcttcggccgtcagggcgagcggatcatttttatcgatagtcgggaactggtaagtgttcagctcatatttttttccatcgatctcaattgaaaaattcttccagtccacgcgtgagagcatgtccctgtcatccatcccgtaattcggatggcgcttaataatctgcccttccagtttaaacgagatgattcttatcgcgcgaagagcactttttattgggtccccctgatctggatagtatttcattccaaaaagcatcagatcacggagacttataccgtagcctttctcgaggatatccgtattcgagtactttaaattgttacagagtacattcgccacagatgccttgctgccgcaggccgctcccatccagagaatgtcgtgattgccccactcgatatccagggaatggtgatgtatcagaaggtcgattatcttgtcggcgctcggccccctgtcaaaaatatccccgactatgtgcaaatggtcgaccgcgagcctcttgatcagtgacgccagcgcgattatcaggtcgtcagaatcattcaggtctatgatcgtatcgattattttcttatgatagcggacctgattgtcgtcctcatcctttggcatatggatcagctcatcgataatataggaaaaatccttaggcatcgcctttctgactttcgatctggtatatttgctcgagagcagtctcgccagctggatcagctcattcaacgttactttgtaccagccctcgttaatccgtccctccttcgacagaagtcggattttctcctccggatagtaaataagagtcgcgagctccataatctccgaatccgtaagctgatttccgaagagcaggcgaatcttctcttttattacgcctgagcagctgtttaatatatgataaaatgcttcaaagtcgccatgaaggtcactcatgaaatgttctgtgcccttcggcaggttcaatatcgcactcagattgatgatctccgtgcagactgcctgctccgtctggtattccttccgcagaagttcaaagtatttctcgtgttcagtagacataactcctccctccagtcacaattaatattcctttgggttttaactattgtcctttttattatatcctactgcagataacagtaccatcactttttctgattcacattcataatggctcctcctgaacacaggtgttctgtttacatctctgttatatcactattgtctgtcaatttaaacagcaggattaatcgtatcccgaattgtcatcaatacatcttgattcactttatcaatggaataatctgtaaatttcgagtataatggtctcaaatacttttataaaattacgaggtatttatggagggaaattctgaactgttaaataaagcgcggcaggttaccgggcaggtctctcacgctgttttgggaaaagaaagggagatccgcgaggtttttctgacttttcttgctggagggcatgtgcttctgaatgatattcccggagtcggaaagaccactctggcccttgctctctccaaagccatggctctcgaattcggccgtgtgcagtttactcccgatgttatgccgtcggatctgactggtttttctgtctttcacagggaggattctcagtttgtctatcatccgggctctgttttctgcaatctgctgctggcagacgagatcaacagaacttctcagaagacgcagtctgctctgctcgaggtcatgcaggaaggccgcgtcacggtcgacggtgtcacaagagaagttccaaagccgtttctggttatcgctacacaaaatccatccggaagttccgggacgcagattcttccggattcgcagatggaccgctttatgaccggactttcgattggctacccggcttttgatgatgagctcgagcttgtactaactactggatctgacagccggctggatgaggtttcctgcgttatgagtcaggaagagcttatcgaagcccagcatgaagttcaggatgtctttctcaaagaaactgtcgcccgctatctggtgcagcttgttcgcgcgaccagagaaagtcagtatctcgagctcggtgcgagtccccgtgcggcgattgctctttccagtatggcaaaggcttgcgcctggttcgatggcagaaattatgtgacaccttcagatgtcgctgaacagctgccgtatgtcctgtctcacaggattcgcctgaactccgctgcaaaaatcgaaaagcgcgatcccaggaaaattctcgaagatattttgaacgcgacagccaggccgcctattgggatcaggcggtgatgatgtgaaaaaaatactattttttctattgatagttctgacctggtatcttgcgggcatgtatcgttttttcccgctgcttctcctgtgcatgatcgagcttctggtgatcccggccggccttattttctgccacatcctggcatcacacatttcatgtagtttcgctgccgaaaagctctggcttgaatccggaaatcccggtacccttgaaattgacataaaaaattccggccgcctgccagtcacacatattgccatttatatttcttttaaatatgccttcgataaaaagcgcacaaagcggatcctgatcaccagtgtcgggaaagattcgcagcgcgaaacactggagatcaatgctccctatgccggtctaatcaatatttctatcagacgcatccgtgtctacgactggttttctcttttcagtgccagaaaaaagacccctcagacgatagaggcagccatatttcctcccgagcaggcaatggaggcagatctgccgtcccatcctgacaaccagctggattccggcgacaacactttagtcagtaatggcatcgaaatgagccatgaactccgcgatattcacgaataccggccaggggatatggcaagacatattcactggaatcttagtgcccgctccgataagacctgggtcaaagaatatgaagcttataatgaggatacggcggaaatttttctcgatccctcggaagagccttttgttagcgctgaggattttgaaagtttcatcacttcattatctgatacgatttttggacttctgcagcagtcagcacgggttatcgtgcactggcaggaaccgggaaaaaatgagcctgttgaaatgcaggcagacagcgcagaaaagtgccgcgaaattttatacaaactgtatcaaacacagcatttccattcaaaaataagaatctggaacaggaactatgaagaagaaacgtatatccatacaaattaaagacagcaggcgttcttcggaaaagtcagaatcgtcgccttttgtactgctgtttcttctttccggagttctgggtattctctcgatttttaactctatagatggaatctcactcggacgcgaaacttttatcgccgctactcttctctgctctgccctttgggcgctctggcgctttaaaagcgatctcgtctggctggggcttgtcatctctgtctccgggactatctgctacagctggttaaaattatcgaaaacaaaaaaacagctcattcttcttggcgagcacctgacaggtcttaatacaaattccctgcaattgacagagcttggtatttttatcgggcttcttctttgcatatttacatttgccatggaatgcgtctggcatctccatcttccgctctacctgctgacaactgcagtggtagccgttgcaccgtttttttcagttgatatcaaggctcctgcgcttctttcagtaatggttttccagatttcgttctggatctggaacgcttctgtaaaaagtcacggcaaaaagaaaattcagagcgaaaacactgcttctctgcgcggccgggtcagcttgatcgctgcttttgtgatggctgtcgtctttatttttcttgggccggcactcgaactggtctcggtccctctttaccaggcggccggcaacgcagagggtctgatttacaggaactatcgctctctatccggcagcatttcgaatcaggaggcgaacggccaggtttcgttcgggaacaattatcacaccggtgcaaagcagatggaactcgtgacaagtgtcaagccgacccagcctctttacctgagaggttttaccggaagcctctacacgggtggcagctggaagcctgcagatgaaaaaaaggtgtttcacgaagtcgcaaagagcctccactgggagaagtgggaagattacatcggagagatgtactacagcatgtattttatgatcaatgccggaatgtacagcaagaaaggcagccggccaatttttctgacgatttatcagctgaacagctcaaacggcagtttttctccgtattacagtgttaaagaccagtattcaaagcgttacgattccatgcagagcaagcctgacaacagttccaggcagatgtacgtcttttacgagcagaaggatatgaatatcaactggaaaaaaatggagccgcaatatgccaattattttaaatggaatttatccctccagcgggcttacaaacaggccgctcagacgtcctacacaatggttcagaccgggcgagtcccaaggcttgtgaaacttgttcacgacaatccacagaaggggcttgacaacaccaccgcttttatcattcacacgcttgagtcccgcgcatcatacagcacaacacccggctgggcgccgttttctgaagatatcgtagaagattttctcttcgaccgcggcagcggctactgcgttcacttcgcatcaactgccacccttatgtatcagctgtacggaataccggcccgctatgtctcgggcttcagagtcgacccgaacgcttttcacaaaggaaaagatggcttttggcatgccactgtgacagatactctggcgcacgcctggaccgaaatttttgtcgacaattacggctggaccccggtagaagtgacgccatccaccgatggcagtatgagcacctcctatcctggattcaacatgaaaaaatttcatcagattcagaagagacacgcaagctggaaaatcacaaaaacctcccgacgcaaagacagcagacaatctgcgaaggcctccggctctcagttcttcttaagccttccatcgatcagtgtgaaaaatgccccggaccttttgatcacctgcataatcgtccttttatacgcctgcgcccttatccctctgcttcttatgtaccgccgccagaaaaagctctcaagactagaccagatgaacagccgccagattttcggccagctgctatcgctcttggatttcacaggagttctcagcggatacactggaaatgagccggatttcgcagcgaagctgtcttctgcagtcccacctctttctgagtcagatgccgcgaaactgacccgcatcatacaggcagcagccttcggagcagaacccgaaaccgcagaagatgctgcatttgtcagaaatttctacaaaaatgtttcaactgcactggaaagcaagctaggcggatggaaaaagtgggaaggaaaatatattaaagcattgttttaagccacatctaatctaataaaattactctaattcattgacttagccatagcacaaaaatataatggagttgtattattcccatataaacaaggtaatattttaataagattgagggtgatcacgtacgaaattaacaattattttttaagcatcatagataaggagggaacaataaaataaagaataagatcaacaactgtaatatttatagtgtaattttaaatttatgtattttcaaacagaggaaaaataatgagaaaaaaaattaaatcttctttcatattaactttggcgatgataatatctttattcgtcccgtttacaactattaatgcacacgctgagggcaagtctttatcggaagcagaggccatcaatctggatcaaattgtaagttataccgatccaactccatccgattatgaaaataaagttaattattacgtctttgaaactacttctgccggaatttatagccttaattttattaatgtaggatatggcgggcaaacgtcagtacaagtattagactcaaaatataaagaaatctatagcagcggttggctttcattttccaatgccgaaagcaagaatgttgatttaactttaaacaagaattccgtttattatgtagaagcagaaacagatgcttacacagcagatgataatgcaagtgcatatatatttagaatttccagaggctcttatattaataacgtacttagcgttggcaatgatggttcatcattggcatcaccaatagaaattgatacagatgacaagatttcttacgccgatcctacaccggaggattacattaataaatataggttctatactttcaaaacatcaaataatcccggatccaaatataattttaattttatcaataccaatcatgatggagaaacagcagcctggatattagatcaatcatacgacagtctctattcgtctgactggcttgattcttcaaatgagggttttaatatcgatcttacattaagtccaaattccagatattatatagtaggagagactgattgttacgcaggagatgacactgcaagctcctatcaatttaccgtaacagaaaaaatcaatacccaaaatccgggcaaacctattatttcttcacttacatcaggcacaaaacagtttactgtaaaatatggtactgcagcaatggcgtctcaaattatcaaatttcttataagcaaacaggttcaaacgactggagccagatttcagtacccgccaatactctaaagaaaataattagcgtatcaaatgctggtgcttatcaggtcagagttcgtggcgttaagactgttaatggtactacttatacaggcaattggagcaacaccaaaaccgtaaacgttaagagccctgttaaaaagcctggtaaatcttctatttcatcacttaaaggtgggaagaagaaatttactataaaatataaaaaagcttcgaattctccttcaaaatatcaaatttcttacaaaaagaaaggagcaaataattggaagcaggttaccgtttcttcgaagaaattaaagttaactattaaagtttccaagaaaggtacttatcaggtcagagttcgtggcgtaaaatatgtcagtcaaaaaacatatgcgggagcatggagcaaggctaaaactgtaaaagtaaaataacacaatttaaatttttcctactaaaaaggggtgcaacgttaaaaagcgctgctcccttttaatttaaatttatattttttcaaaatcagctctcaaaattaaagcacactctgctcgatacattcggacggacttttccgtcagccactgccaaatgcgccgggtttaccgaatagcctttcagtgcctcttcattttcaaaagtcgaatccagcatcaggtcacagtttgaaccctcaaggccctcggttatcacatgaatttcaacgattcccggaactttgcctttcagcccttcaagacctgcttttatctctgcttttatagattccttctcagctgcagaatattcatctttcaaagtccacagaattacatgtcttaccattagttttctcctttcatatcgcgtatcccgcgctgcggtctttttcgtccactgcactgcctcttcctgcattcaggaaatatgcaccttttttacagtgaagaagcatctctctatcaaaaatatggtatgtctgttctgtacctggcagtgtagcagcgaccacatctgctttctcaagttcagccgccaactcactcgtcggatgtatttcattcagcggttctgggcagaaatccgcccgtctcctgatccccgacagggtgatcctgttatccggaagttcaaatgccttgatccgtctcgcaaatgcaagtccggcatccccggttccaacgatcaggatgcgctttccggcaggagaggccaccggtccctcatctttccagtcgcggttcttctgatcatccatatacattgggatttttttcatcataacaagaagcatcgcgaccatatactctgaaagtgctgttccgtaagcacctgttgcagatgtaataacagcctcttccggcaccacgccgtccttcacatacgcatccacacccgaagaattcaactgcagccaggaaagtcttgaagaagcctttaggacatccggctctacatttcctatcaccgcatctgcatcgcagatatccccctctgtcactgcttcgctcgtaataaaactaatttcatccccgtaactttcagcggtcttcttaagccttgccttctgcgattcactgaaagggaccgccacaaccactttcttcatctttaagccctccttggattaatataaactcattatacacctttagacagcttatgaattccaacttttcttattaaaagccaagaacagggcgaaatttcagcaattattgactggcatttacggactatggcgtgatttccttctacaatccgtaattcccggcgctcttttacggactgcagtgtagtcttcatatacagtccgtaatccttggcgtgattttacggactgcagtgtagtcttcatatacagtccgtaatccttggcgtgcttttacggactcagaatatagtctccgtttacaatcgtaagagccaaatcgcctcctcgcgaagctctattgataatttcctgctccgcagaacttgaagccattgcgatttgaagcgttcgaacatacgaaagccttatcgaaaaaatttccagctccgcggagccggtgacatggttctttatatcaagaagcagcgccacagataggaacggactcgcgaccttaggatttttcgtcgtgagcgtgtgcgctagctgcggcctgggtggccacccgcctgaaccacaaacgtatgaaaaccatacattggccagaaggccgcaattaggcgcgcgcacgcgaacagaaaaatcctacggagcgagaccggtcatctgtggcgctgtttcgagcttaaaaagggcatattgtgtctgaataatctataagtgggacaaaaagaaccgtccctactgtcccactgcttcaggcgaacatcagcacatcttcgcgccggctgggatgtggttgtcgagcatcacgacgtggagttcttcctcgccgtttttctcgtcgacagcgctgatgatcatgccgcagctgtcgatccccatcatcttgcgcggtggaagatttacgatggcaagaagtgtcttgccgacgagctcttccggctcgtaatatttgtgaataccgctcaggatagtacggtcagtgcccgaaccatcgtcgagggtaaactgcagaagcttctttgacttcggaacagcttcgcaggccttgacctttacagcacggaaatccgacttgcagaacgtgtcgaaatcgacctgatctgcgaggaaatcctctacctttacgccgctgaaatcgatcttcgaattcggtgtaaagaagccgttgttgtcgccagaagctgttgatgccggtttgctttctgaatctgcatcgagcgacttaagagtcgggaacaggatcacatccctgatggcttctgaattcgtaagcagcatgcagagacggtcgattccgtaaccgataccacctgtcggtggcatgccgacttccatagcgttcaggaagtcttcatcggtgtggttggcctcttcgtcgcctgctgcagcgagtctgtcctgctcggcgaaacgctctctctgatcgataggatcgttcagctcagaataagcgttgcacatctcccagccattgatatagagttcgaaacgctcaacctttgaagggtcgtccggctttttcttggtgagaggtgagatctcgatcgggtgatccatgataaatgtaggctggatcatcttcgcttcgcaatattcatcgaagaagaggtttacgatgtcgcccttcttgtggcgctcctcgtaagcaatgtggtgctcatcggcaatctttttggcctcttcatccgtctgtacctggtcaaagtcgattccggtctgctccttgatggcttcaaccatcgtaagtcttctgaaaggcttgccgagatcaatctcgtgacctgtgccatcctctttgctgccatagtagatcttcgtgctgccgcagactttctcggcaagatcacggaacatgctctctgtcagttccatcataccgttgtaatctgtgtaggcctgatacagctccatcagagtgaattcagggttgtgctttgtatcaacgccctcatttctgaatactcgtccgatctcatagactctctcaagtccgcctactataagtctcttcagatagagctcaagtgaaatgcgcagctttacatcctcatcgagtgaattgtaatgcgtctcgaacggtctcgctgcggcgccgccggcgttatgaacgagcatcggagtctcgacttccatgaagttcctgcctgcgagaaatcttctgatctcggcgatgatctgggatctctttacgaaggtgtccttcacctcaggattcatgatcagatccaggtatctctgacgatatctgatatctgtatctgtgagtccgtggaatttctcaggaaggatctgcagactcttcgagagaagtgtgacttccttcgcgtgaatcgaaatctcaccagtctttgtcttgaaggcaaaaccctttactccgatgatatcgcctacatcgtattttttaaaatatgcgtattcgtcgtcgcctatatcatttctggtgacatagatctgaatgtcgcccttgagatcgcggatatttgcgaatgatgccttgcccatgacacgcttgaacatcatacgtcctgcgacagatacgactttctcagccggaatctcatcgagcggaactactttattctttccatcctcatcgactggaggcttaaactcaagctcatcaaaatgctctttgacatctgtagaatggtgggtctggtcgtactttgtgatcttgaacggatcgcggcctgcttcctgaagagccttcagcttatctcttctaatctgtaaaagactgtttgtatcctgtgaattgttattctttgctggcatgttatccctttcaaaaaccgatcagttatttcctagttctgtgagcttcaagaatcttgtactcgaagcttcctgcttcggtctctacagtaactgtctgtccaggctcatggccaatgacagctgcgccaacaggggactcatttgaaatcctgttatttaagatatcgacctcgtttgaaccaacgatatcgaaagtctcctcttctttcagttcaacatctaagagcttaactgtgtatccgatgttgatcttgcctgtatcctgcccgtcatcatctgcgacaaccgcgtactttaatatctcctcgatatcggtgatacgatcctcgatcttaccctgctcatccttcgctgcatcgtactcagcgttctctgaaagatctccctgctctctggcttcgccgatcttcttcgcgatagccggacgttgtacaagttttaaatcctgcagctcatcctccagctttttcttaccttctttggtcatcagatttacttttttctcttcgtccatgacaacgtcctttcttatgaaaaaatatacgaaaaatatttattaagccttttttgctaaaatagtataaatgtaaaagaattgaaagtcaagaatttaccctcagaagaactcatcctcgtcttcctcgtagatactgaccggtccccagtacggttcaaagtctttgctgtggaagaaatattttctctcctcttcctgcatcttcttatagtggtcttccagcgtgatatcgctgtagatgatcggctcgtgattctctgtctcatcaccgggttcgcggaacggtccgatatgatcgcacttcatctgctggtaagccgcaagtcccgcttttctgccgaattcgtgaagaaggtcctgatagagcttcttcacatcgttctgacctgtcctgtaaaccctgactagtttttcgagatcaagtgaatatttttcagcgatccgatagacagatgtctttttttgaagttcatcctcaagtccactgatactttccggcaggtccgcatctttgatgcagcccgcatagagagaggccattatcgtatcgaaacacattacgccaggcgctctgtgatgcccaatatactggatctttgcgttaggatgacgcgcagaaaattcgctgatacttttttcaatatctaaaggagcgccgtccgtctcacacaaaaagacttcagcgtctgtcctcctcaagacctcatagtacagctttggaatcgtgccggaggtattgtgatgatagatgcagatgatgttatcctgctgcaaaaaatccgcaccctccacaccatggtagtcttcgccttccacttctacgatgtaaatattcatttgttccctctcttataaaaaacgccccgttattaccccttcagaatgcagtcaaatgtgatgataccgtccttccaggatacatttatagtaccattatactgtttcaccagactctcggcaatagaaagcccgatgccatagcctcctttatccacgttgtgtgactcgtccgctctgtagaatctctcgaaaaatttggaataatcgacattttttccatttgcgtatgaattcgacacctgaagcctgatgcccttgcccttctggaggaggacaacatcgatggttccgtgatcatcacagtatttgatggcattgtcgataagaagtgtcgcgagctgcctgatctggctttccacggctttcatatagatcccgtcaccgatattctgattcagggtctctcctgcattctcagctaccggcaggtagctctttaccgtatcccttatggctgctgagatatctgtatctatcctgtctccagtgtcttccttctcttcggcccggactatcgtcacaaggttctggataagtcctgtcatcctgtcgacctgtctcatggtcgactcagtccattcgtcctttccgccgatcatctcctgaacctgggtgtttgctttaattacagccaggggcgtcttcagctcatggctcgcgttcgtgatgaactgtttctgctgctcgacattttttatctcaggagctatcgccctgtaggaaaatgctctgagtaccaggaacgagacgatcgatccgaatcccagcaaaataagagccatatacaggatcctgttcgtaagtcctatctgctgcgtgcaatccacaaacaccacaagggtcctgtgcttctgcttctcaacctggtaatagtaatttccgacgctgccaaatttgaaagcattgtcagacaccattttggcatactgcttcgcctgccccatatcgatcgatgctatcctgtcggccttcacctgaatgaaattgtcattattatccagaataacagagaaatatctcgtagcgtaccactggtctttatttgtgagtacgtttcttctggtgccaaacatcgtcttaaggaaatagttgatattatcctgaggggaatcgcttaccaccgtggaactgtcatcatttgaattgccagaagcagtcgtgttgttcgctttctggtcattttttataacggtctttaccgacgggagcgaacctccattgtcgacgatagtctgtgtgacctcgtgcgcttcccgtctcgatacaacgagtgtccctacatagatcaggccaccgacgacaaccattaccgtgataaaagacaacatggagatgacaaggaatttgtttttaagatttctgatgctctgttcattcatttgatcacctccatgtgtttaaaaaatcaagctgcctgcgaattgataagtctgaagcttccgcccttctctccttcgatagtgattccggatgctatagccgagagttttctcttcaaatatgaaatataaagccagaccgtatcctcgtttgcgtccggctcactggcccagatcttctgcaggatatcatccgtcgagatcccgccttccgaatgtgtcataagcatctgcatcagctcgaactccctgatcgagagccttacggagttctcacatgaaagttccatatcctctgctttaagcgagacgtctccaaagctcatatcctgcggattgtactctcttccccttctgacaagggccctgactctggccaggagttctctcatgtcaaaaggctttgccagatagtcatctgcctctgcatcgagtcctgccaccctgtcatcgacttctgtctttgcggtgagaagcagtaccggtgtcaggatattgtcctcgcgcatcgatttcaagaccccgagtccatccaccttcggcatcattatgtcgagaatcaccgcatcaaagctgtcctttgaaaggtaatcaagtgcctcctgtccatcgtaggcacttgtcacatcatatccctcgtgctttaaaatagccgactctgccctgtttaaatcccttgtgtcttctgccagtaataacttcattctgattcactcccttttatatcacttgtctcttcaaagatcagatcccttatcgtctgcatcgaaatatctgtagaagccagctcatcagcgcatctcttgagctccgatgtgacaagctcctcattcgtcccgctcagatcatgcttgtatttgatctgatgctcgagtgccgcccaggtatcctgcgagatcgtcctgagctgtatctctgcataaaatttcccatgcatccgaagtatcatgtgatagcttctatagccgttcggcttcgcatgcttgatgtagtccttctcttctatcacctctgctcccgggagcgccaccagatgttcccggaacttgtacacgtcgtctaaaaatgcgcagactactctgataccaaccgcatcgtagatcttcgtaagcgccgactctgtcgtgaccggcagcccctttctgacgcacttctctctcatactgtcctcatccttaatcctcgaaaggcagtgctcgacaggatccataccatttttttctttgagttcgtttctaagcgactcgatatcatctaaaagttctttttgtattttttcaagctcgggcctgtaaggtccgtagatgctctctgtttcttccataaaagtatactcctgagtctattctgtatcattataccgcaaatatttaaaaaatttgttaaagtttgatgaatgatgtgctaaaataaataaactatcttatattttggaggaaatgattatggtcagtaatagtgagttagtagaaaaagcaagggaagctatgaatatgtcttacacgccatattcacattttactgttggagcagctctgctctgcgatgacggtacgatctaccaggggggaaacattgaaaacgcatcgtacggtgccgcaaactgcgccgagagaaccgcttttttcaaagctgtttcagagggaaagcgcgatttcacagctattgcgatctgcggcggcccgaataaagacgacacggatttctgccctccatgcggcatctgcagacaggtaatgcgcgaattctgcgatccaggcaggttcaggatcctgctctccgctgatcatggaaatcagataagagaatacactctcgagcagatcctgcctgtatcgttcggcccagacgatctcaaataaggagcccacatggacaaaaataccggaattctctttggcgttggcgcgggctgcggcgacccgggcgatgtcacgataaacgccatcaaaacacttgaaaactgcgatgtgatagtttttccatctggaaagcgggcctacgatatcataaaagtttcgatgcccgaaatcagttcgaaagacttgaaattctacaattttcctatgatccacgacgcttcagcgctcaccgcccgaagaaaaaaaatatactcggaagtcagggattatctgtctgacggaaaaaatgtcggttttgtaaccattggcgatgttttagtatattcgactttttcctatatcagagatctcgcagtgggtgacgggtttccggtaaagataataaacggcatcccttcgtttctttcgtgtgccgggaggcttggcctgatcctcggacaaaatgacgaggaagtccatataatccctggctctgccgatatttccagtgctctggaccttccaggcatgaagattttcatgaaactcgggaagcaccttcctgaactaaaaaatgccctggccaaaaagccagagcatgagttccttggtgctgtaaacagatgcggaatgtctgatgaagagatctttaccgacatctccgaactgcctcttgagaaatcgtatcttatgactgttttcgtcaggtgagagcggtcctctgtgccgcccgtatcttcatgtaatcacgattctctgtcccgcctgtatcttcatgtagtctcgattctctgtgccgcccgtatcttcatctgatcacgatctcctgtgatcctgtttttcgaagataaagcgcattccctgaagagttagatcagggttatatttgtcaatgactgatgtctctctcgagatcatctttccaagacctccggttgcgatgacttttacgtccttgcagccggtttcttttatcatatttctgactatatactcggtcgcaccgatctggccatagacaagtcccgcctgcatagaggagatcgtctcgcgcgcaagtatggacttaggctttctgatctcgacttccggaagtttggcggcatcttcccagagcgccttcgcgctgatcctgattccaggggctgtgacgccatatttgaacgagccgtttttgtctacaaaatcataagtcgtggccgtcccaaaatctatgacgatcagcggtccaccgtagagctcatatgcgcctgctgcatcgacgatcctgtccgcaccgatctggcccggtgtttcagtctggatattgatcccggtcttgatgcctgctgccactatgatcggcttcgtgttgaaatactttataattccactggtcagcgaatgcatcagcgccggcactaccgatgctatgatgcagtctttaatctctttgtggtcaaggccattgttatagagaatatttctgatagtgatgccgtactcgtccgatgtcctcgaaataccggtattcagcctgaaattgccgatcaaaacactgtctctgaatactcccagcgtaatatttgtgtttcctacatctactgctaataacattttgtctcctcggcagatctttttatccatattaagaaaatttcacggaaatattttatttctctgatctcagaaaaactcgcggaaatattcttccagttccctgaacagctctctctggtccttctgaatctgcttgatcttaagcggcgctccaatattgtcgtacgtcaggtcgccctcctctgaatccgtcatcagatggaggctgccctcatcgtcgaaataaagctcgatgatcccaccgatatcctcagtaaagagcacgcacatgatctgaagctctttcttgacctcctccggaagtccgtcaaaatccggattgaggtaatattttttattgtatgcgctcgctgcgcaaagtactattttatcctgatacattattttaccattgtcgcatagatgactgctttgatcgagtgcatgcggttctccgcctcgtcaaagaccaccgaatgaggtccttcgaaaacttcatccgtaacttccatctctgacaggccgtacttctcatttatctcgcggcctatcttcgtgtcgagatcgtggaatgatggaaggcagtgcatgaagatcactgagtccttcgcataggaaagtgccttcgaattcacctgatatgggagaagatcgtgaatacgctccttccaggcgctgtccggctcgcccatagatacccagacatctgtataaataacatccgcatctctgcatgcctcttcgacactctctgtaagcgtgatgcttccaccgctctttgcagcttctttcttcgaatactccacgagctgtgtctccgggaaatatttcttattcgtgcatgcgacgaaatccatgccgagcttagcgcaggtaaccatcagggaattgcccatattgtatctggcatcgcccatgtatacgaacttcacacccttcagttttccgagcttttcttttacagtcagcatatcggctatcatctgcgtcggatggctctcgttagtgaggccgttccagaccggaactcccgcatactctgccagctgctcgactatctcctggccgaatcccctgtactctatgccgtcgaacattctgccgagaactctcgctgtatccttaatgctctctttctttccgatctgtgagcccgatgggtcgagataagtcgtggtcattcccatgtcgtgcgcggctacctcgaacgagcatctcgttctggtgcttgtcttttcaaaaataagcgctatatttttgcctctcaggtaatcgagctgtgaaactccctttttcttttcatctttgagtcgggcagacaggtcgataagtcccgtgatttcatcagccgacaggtcagtcatttttaagaaactttttccgtaaagatccatatgaactcctttttcaaacatttttatcattatatgatataagggtcattaagtcacgctttttgaccgcttgcggtcaaaaagcgtgacttaatgacccgccccacagctccagaaaagctaaaaatatagtaaaataagatttatatgtaatcagcttttctggagcttggggttttgtgagtgtgaaacactcacaaaactatataatgatttggtggtcaaccttttgaccaccaaatcattatataccatttctgtcaaatcgggcaatttttttggcatcttgacaagaatgtcataatagtaatataatttatggaatttttgcgctgaatttattctgaaaggagatgtttacatgagcctgttcactgacgctttaatcgacgctacaattgacacccttaaactcataccttttctatatattacatactttcttatggagatcctcgagaggcacacctctgacaaacaggtccagttgatggcgaaagtcgataagttcggcccggctatcggagctgctgtcggagccgtcccacagtgcggtttttccgctgctgccgcaagcctctattccggtggagtcatctccgttggaacgctgatcgcagtttttgcctcgacttccgatgagatgctgccacttttcatatcgcagcatgtcgctttgggaaaaatgctctcgatccttgtgaccaaggcattcctcggcatgatcagcggtttcggcatcgactttatcgtccgccacacgaaataccacatcaagtcagaaaagcacatccgcgacatctgcgagcgcgagcactgcggcactgccgaagacgagcacacaaatgtattcctggccgccctgaagcacacacttcagatcgtgatattcatcttcattatttctgttgtgctgacccttgtcgtagacggtgtcggaaaaaatgcagtagcttctgtcatcgctggaaatccagtccttggcgtcctgctttcgacccttatcggcctgattccaaactgcgcagcatccgttatgataacccagctctatatcgacggacttatgagtgccggccagatgatcgccggtctcgtagttggggcaggcgttggtctgatggtcctcttcaggacaaacgacaaccacatgaaggagaatatagtgatcaccataatgctctactgtgtcggagtattctggggactcatttttgaaggattggggattgttttctgatgaagcctctttttataggaaatgtcaaaatagaaaatccgcttatcctggctccgatggcgggagttaccgaccagccgttcaggagaatctgccacgaagagggcgcgggtcttgtctgcatggaaatggtcagtgccaaggcgatctgctaccacaacaaaaacaccgcggaacttttaaggatcgcagacgatgagcatccggtttcactccagctttttggttctgatgtggatgcgatggttgaagcggcagaaattatcgaagatataccttacgacatcctcgatatcaatatgggctgcccggtcccgaaggtctataacaacggcgacggttctgctcttatgaaaaatcccattctcgccggaaaaattgtctctgcccttgtaaaaacgaccgaccggccagtgactgtaaaaatccgcaccggtgtcgattccgaacacatcaacgctccggagatcgcccacattctcgaggaatccggtgcttctgcgatcgcagtccacggcaggaccagggagcagtactacagcggaaacgccgactgggatataatccgcgctgtcaaagaaaaagtctccatcccggttatcgggaatggagacctgacttgtgcttctgatattaaaaaaatgtacgagattaccggctgcgacggatttatgatcgggcgcgccgcgagaggcaatccgtggattttttcacagatcctgtctgaactcgatacgggcgtgacagtcccagagccctctaaagaagaagtcatggctatgcttttaaagcacgccagactcgaggttgagctcaaaggcgaagaccgcgcgatccgcgagatgcgaaagcacgccggatggtatactgccgggcggcgcaatggtatccgcttcaggcgcgttgtaaatgagattcacacatataaggagctcgagaaggtgtgtcgggagtttatgctttcctgaagcttggaacaacagcttccacggcaacggctctccaggtcatgtttttctgttcgctcgcgcgcgcttattagcggccctctgacaaaacgcacagaattgcttaaaaaattgctgtcgcaattttttaagcaattctgtttgaacggttgtcacccgggccgcagctagcgcgctcgttcacgacgaaaaacacgacaatcgtttgccgtttaccgtggcagctgttgcatcgaaaattcaatctcacaaactaacaggctgacatagattgcaaaaattcaaaaagcattacgccttctttacttctactgtattgtttttatggtcgagatagaaaaggaactttccgttttcgttttctctgacggcgacttcgactccttttttcactccctctgcggctggctttatgccggccttttttgttacctgcttcatgaagtccttgtagaaatctggggtggactgggtgccgatgtagtaggcgcggccctttccataagagttctctgtgatgaccggggttcccttgtagaaatcgtctgcgtaggttccgtcgactgtcatatctcctgcgtcttcggatatctgataggccgggctcttgaagtagtccagttcgccgagctctttcttgttctcttctatcagctttttaagctctgagagtggccttatctggtcacagatcagctgcgcctcgtactcctgtccatcccactcgaagtggtctggcgcgtctggcgcgagcgcatcctgctcctcgacccatagtccgaacagttccttgaacgggcccgggtaaccgccctgatagaacaggtagtccttgtccacatatccggtcaatgccgaagcgataaatgcgccgccgttccttacaaaatcttctattttttctgcatagtcctttgatgccatgaaaagcatcggtgcgactacgaccttgtatttcgaaaggtcgtcatcgagtcctatcacatctaccgggatgtgattctcaaaaaatcccctgtaatagttcaggcattcattcttgtagtctataagctcgttcgggccctggagcgcgtcgactgcccaccagttttcccagtcaaatacgactgctgcctgggatggtacagtgcttccgaggatctcgttcattttttcaaggcgtgctccgagcttttcgacctcgtcaaaaacccttgtgcctgcgagtccgacatgctcgataaccgctccatgcatagcctcggcagcacctctggaccttctcatctggaaaaactgtacagtatctgcgccatgtgccacagcctcaagactgtagagcgtcatctggcccggcctcttaagtgggtttatgtgctgccagttcgtaactgacggtgaagactccatcagtgcaaatggcttctggccgccgactccgcgtatcaggtcatgtgccattgcaagctctgccggctccgtgtccatatgcgggtagcagtcccatgatacgaaatccatgtatttggcccactcgcggtagtttaagccatagaagaaccacatgaagttcgttgtgatcgggatgtccggggttatttttttaatagcatccctttctatcctgtactcatcgagcatgatatcagaattaaagcgcatatagtccaggaactggccctggacctgcgttattttctttccgccctctgatacgaagttctcacttctctcatcaggtatctggatttcgtcccagtcatagtaggtatggctccagaatgaggtgttccacgcgcggttcagctcgtcaagagtaccatattttttcttaagccactcgcggtagtttttctggcagttgtcgcagtggcactcgccgccatactcgtttccgatgtgccaggctacgatgttgtcgtagtccttgtatctctctgccagtttctgagcaaggagcggcgcgtattttctcatagtcggcgacgacgggcagaagttatgccttgcgccgtactttctcttcatgccgtttccgtccgttcgcaggatatcaggatgcctctttgccatccatggcggagttgcagctgtcgatgtcgcaagaatgactttgaaaccgttggctctgacgagctccatgattttatcaagctttgaaaaatcgtaagtctcctccgatggctgcagtgccgcccaggaaaatacattcagggtaagctcatttatgtgcgctttcctgaacatcttcatatccgcttcccagacttcctccggccactgctccggattgtaatccccaccgtataaaaattccttaaccttcatgtacatttccctttctgagttttctctgtagtaccggcgcagcattagttccactctgaagcactttagcgcagcatcagttccactctgaggcgtttaagcgcaaccggttgttcttataatgacactatacactctttgagcaaattttgcaacagaaaaaataaaataatttaaatcgaataatggaggcagtaatcaaagccaatccttaaaaattttgtgtctgcctgactcccaagcacactgcatatctgcgatgttctttgcagagttttggaaaaatgtcaaaatccatatgaatttcccatgtaaaaaagtcaaaatcatgctctaattactatggaaaagtgtcattttatgctataattttatgtgtaaaacgcacaaacgcaatggaggtacagctgatgctgaatcgtaagattgaaaaagacataaaacactggattcaaaacagcgataaggctctgctcatttatggtgtccgtcagtctggaaagacctatatcatcaggaaatgtctaaaggatgccgactgtgattttgtcgagttcaatctgattgaacagccggatatcgttcagattcttgatggcgcaacgagtatcgacgacatgatcctaaagctttctctttacaccagccagagaatcacacctgggaaaaccatatttttctttgatgagattcagagatataaagaaatcgtcacaaaaatcaagtttcttgtggaggataagcggttcaggtatattttgtcaggctccctgctcggtgttgagctcgtaaatctgaagtcagctcctgtcggatatctgcagactcttacactttatccgctggattttgaggaatttcttcaggtatttaatgtagaaaatcctgtcatagaacagcttaaggacgcttatttttcaaaaaaaccggttgatgaagtaattcataaaaggcttatggaaatttttaatctgtatctgatcatcggtggtatgcctgctgcagttgaaaaataccgtaccaccggcaatatcgacgatgttatggatgaacacagagcaattatggaattgtataagcttgactttactcaatacgaggctgagaaccgcagacttattctcactcatatctacgagcttattccggcagaacttaatgagaaaaataaacgctttaaaatagctgatatcagaaaaaatctgcgatatgaccgaattgaagatagtttcacctggctgtggaaggccggcgttgccctgggcgtattcaatacatcagagccgactgtgcctctgaagctgaatgaaaaaagcaccctctttaaaatgtttatatctgatgtcggtcttcttaccacagtttatggcaaaagctgcaagcttaagatcatcagtaatgacaccgatttaaataaaggtgccgtttatgaaaatgtcgtagctcaggagcttcacgcccatggttatccactttactactacaacagcaagaagcttggtgagcttgattttgttgttgaacacgatggccagatactccctatcgaggtaaagagcggaaaagactataccagacattccgccctggataacgtttgtgctattccagaatatggcatcaggcaggcttttgtcttttcaaatgataatgtaaaaacagatggtaatctggtgtattaccctatctacatggttatgttcctgaaggaaaactcgggtgaatttcctgatatttctgtgagcagatattaaaaaatataatatttgtggccggcagtctgatattttgcatattcactgccggccactaccagattaatttctgactttaatgacttacctcaggcgtagccatagagtccacggacgtggacctcgcctgagtctactgctgttatggttccgtcatctttttttatcaggaggcggccgtttggatccatttcaagggctattccttcgaagtcgtgtacctggtggacgacgcgaacgcgcttgtttttattggcgaggcggctgttgtagctgtctaaaattccttcaagacttccgccgttagctttgaaaatctcgtaatgctttaaaaaatgctgccagatggcctcagttatcgcttttctggaggctcgctggatttctgagtcttctacagattctgaagtctgctgcgtttcattttcaaaattgaatgaatttgatcgcagatcagaattccttgttatagtctggcgttttcctgtcacttcactcacacctttttgttttgccagttccagatccagagaggttgccatatccctgatttctggcgcgaaatcctcctttttctgatggacgttcactccgatgccgcagactacctgcttcgcgtgtccattctcagcctccatctctgtgagtattccacagatcttcctggaatctataagcacatcgttcggccacttgatctgagtatgcagcgggtaaagttcctcaactgcctctgctactgccactccggctacgattgtaagcctaggcaggtgctccattggtatttccttcggatatatcagcatacttgtagctactgaaatcttttcgggagatatccaggtatgaccgctgcggccacggcctgctgtctgtgttcctgccgaaataacagtaaattccggcgcaccagcctcaccctcgcgctttgcttccagatttgtggagtctatttcttcaaaatatttaaatattggttctatcataatcaatcctcagtcaaatcgtgttaacaaaatttctgcgttcaacctcatcttttcttaaaagctctgccgcatcgatttcaacttttataacgatatcatcaatactctggttttgcaagaagttatcctatgccttccacttatcttgattacggactcagaccaattttctcctctgagtccgtaattctggctgggattttacggactaacaccagcttttccctctaagtccgtaatcatgactgggattttacggactcacactaattttctcctctaagtccgtaatcatgactggaattttacggactcacactagttttctcctctgagtccgtaatcttgatagcttctttacggactcacgccgagttctccatctcagtccgtaactctgttagcttctttacggactcgcaccagcttttccatctgagtccgtaatccataacacaattttacggactcagatcaagttttccttttcagtccgtaattatattagctttcttacggactcgcaccagcttttccatctgagtccgtaatccataacacaattttacggactctgatcaagttttccttctcagtctgtaattatattagcttctttacggactcgcaccagcttttccatctgagtccgtaaccagtgcacaaaaaagggtgccgggattcgcgattgcgaatcccggcaccctgggcttaattccttaattgatagtcttatgaaaaagctcgattgacatacgcctctacatatactccatccggacggtactcctcttttatgatatgaccgtattcgtgaagtctttcgaggcgggagccctcggtgtatgggattacctcgtttatttgcttcatgcctgacatcagaagctttttcatggcacgttttaagtcttcaagtccctgacctgtctttgcggatatatgcaccgcaatgtctgcgtgtccgtcaaagagagggcgggcattttcagccttgtcgcccttgttaaagactgtaagtatcggctttccgctgatatgcagctcgctcaaggtctggtacacgacgtccatatttctctcaagcgcaggatccgctgaatcgaccacatggattatataatcggcgtactttgcctcctcgagtgtcgagtggaacgcatcaatcaggttatgcgggagcttgctgataaatccgaccgtatctgtaagcagaacctgccagccgtcgcccaggtccatcctccttgttgtcggatctagtgtcgcaaaaagcgcatcctcctctaatacggatgagcctgtcagcgcattcaaaagcgttgatttgcctgcattagtgtaacccacgattgcaaaaacaggtatctggttctttgaacgggattttctcgtgttttcgcgatttttctccatttctttgagctggcggcggagagatgagattctgtccctgatccggcgtctgtcggtctcaagctttgtctcacctggtcctctggtgccgattcctccgccgagtctcgacatcgcgattcccgcgcttccagaaaggcggctcgatttgtactgaagctgcgccatctcgacctggatctgtccttccttcgtggtggcgtgctgcgcaaaaatatccagtatcagcatagtgcggtctatgaccttcacatcgagcgctgcctcaagatttcccatctgcgcaggcgtcagctcgtcgtcacttatcacgccgtctgcatcaaaagcatcgataaactcccgaagctcttctatttttcccttgccaatatatgttccaggcgacggtgcttccatggtctgcgttacctgatagacgcactcggcgcccgctgtgtcgagaaggcgcgcgagctcggcgagagagcttttcgtgccatccatgtcacggccgtcagtcacggcgatttctatgtatttttcttttttctctgctgttagtatcatgcggtgataataccactattttgctataaactcaaacgctttgacgcaggcggtttttaagttataatctgcattagaaaatttaaaaaattgcttttgttgcttctacaacataaaataacccggtttcgtattatcctattatcatatcaaatgaaaggagatcacaaatgtctaagaaaattgacctgaataaaacagtattcgaactcacaaaacagtatcctgagcttattgatataatggcaaaactcggtttcaccgagatcacaaagaaacccgtattaaattctgtgggaaaactcatgacgatccctaagggagcaaagatgaagaacatctccatgatggatgttgtgtctgcccttatggcaaacggttttgaacttgagggaaaaatgcctgagataaaaatccctgacgcatcacctgctccggccgctgactctaaggcagaagcatcaggtgacgacagccgtacagagcttctcaagtcatatcttcgccgtctcggagatggagaggatttagagagcgttcgcgctgatttcgtcaaagaattcagcgatgtagatgcctcagagataatgaaggcagagcaggaactgatgcaggaaggcactccgctctcagaggttcagcgtctctgcgatattcattccgcacttttccacggcgctacccgtgaggagcagattgcaaacgctgagaaggctgtcgaagaatccattcagcagaagaagattcaggaggaacttaaaaagagagattcttttccaaagaaagattactcaaataaaaaagaaaaagccgccgctcttgaggaaatttctggtcatccactccagacacttaccgaggaaaacaacgcgctctctgatcttcttgcaaaattcaaagagacccgcgatgagtctctgatttcaaggatccgcgagatttccacccactatgcgaaaaagggcgatctgctctatccgcttctcaaagtgagatacggcatctccggcccgtcagacgttatgtggactgtagatgacgagattcgcgacgaactcggtgcccttgaaaaattaaacgaccatgacgaatcctggaacgagcgtcttgatgcagttttacagcgtgctgaagagatgatctacaaagagcagaacatcctctttccaatctgcgctgtaaatttcacagatgaagagtggcagagcatctaccaggattccaaggattatgccgactgcctcggtgtaagcagaaagacctgggatgaaggtaagaatgccacaaagccagcctccgcttcttacgatggagagatagtcctgcctggcggtcattttactatagagcaacttaccgctcttctaaatacaattccactcgagataacttttgtggatgctgagaatatcaaccgtttcttcaacgacggtccaaaggtcttcaagcgtcctggaatggcgatcgacagagaagtcttctcctgccatcctccaaaagtcgagcctatggtccgccagatcatagatgatttccgcaacggcagacgggatgaagttcctgtctggatgaaaaaaggcggaaagacaatgcttgtcaggtatatggcagtccgcgactcaaagggcaattatcttggtaccgcagaattcgtccaggatatggaatttgcaagagagcactttgaagaggaaaataaagattaattttttccttttatctacaacttctccggatatttcctgcccatcacccacgcaaatgcctttgctgtcctgatatctgcgtctttaaaatggtttccatgattccattccagaactgtatcgatcccctgatttttaagaagctcatatgcttcgcgtatgcagtctcctaccgtagccatcacaggatttctggttttctcttcattatcgcccagacttaaatacacagactttgcatgaatcctgttttgtctcatgtaattcgtaaattctggaaaccacacagacggagatgctgccgctacagcctgaaatacgtctgtcttatatgatgcccacagagcaaacagccccgccagagaatatccgcctatgatataggtcttgtctttatcagtacagtatttcgaaacctctgccaaagtatcagctgcaccgtctccgaaatcctgcttgccgaatactgctggcgccggccatggtgacagatcaaaattccagtccgaaacctttaaagcgatcagataaaaatcgctgcccgcctgtctttgtatctcagccacctcagactctattccctcgaggtcgtggtcatcgaccatctgtatcagaactgttttcgcatcttcttttccatatgtaatcgtttgcatagcttcttctcctgttttcagattaaaaaaattatacaaaagcatccactgatttacaccataattttcttttctccaaataattttagatttttggccaatattttttattttattttgtgatttcctagaattttgccataaaaatatttttttattttatgtctttaaatctaaatcaaacaggtatacaatgcacgcataagaacaaaagaacaagacaagatgcaaaggcgcatcgatgctacagttacggactttccgtacgtactatcggtgcgcctttatgcgtgcacagaaagaaggaagctatgttaaagacaagacttgaatcagattcgattggttccatgatgatcccggcaagcgtttactacggagttcagtcacttcgtgccaaccgcaatttccagatcacaggccagcagatgaacgatgatttccttcgcaatctggcactgatcaaaaaagcagccgctatcacaaatgcaatcacaggagaccttgatgctgacaaggcgaatgccatcgagcaggcctgcgacgaagtcattgctggaaagctcagaaaggatttcatccttgacccggttcagggcggcgctggtacttctgcaaacatgaacatgaacgaggtcatcgctcaccgtgcttcagagatccttagcggtgacaaagacaaatacatcgttcatcctaacgacgatgtaaacatgggtcagtcgacaaacgacacgatccctaccgccggtaagatgacagtcctcaccctcgcaaagccaatgcttgctgagctcacaagactttacaaagctctcgacaaaaaggccgacgagtttaaagatgttataaaaatgggccgtacacagcttcaggatgcggttcctatgacacttggtgacacctttcatgcttatgctactatggtaaagagagccatcaagcgaattgaagattctctcgatgagatgaaagctgtaaaccttggcggaacagccattggaagttgcatcaatgcttcagattactatgtaaagcatgtcgttactgtactttcgaaggtttcagatcttccactgacacaggccaacgacctcttcgatgcaacctcagatatcgacagttttgtcgctgtctccggtgcgatcaaagccggaatgatggccatttcaaaaatgtgcaacgatctccgtctcctttcaagcggcccccgctgcggtctccacgagatcaaccttcctgcaaagcagaacggttcatctattatgcctggcaaggtaaacccggtaattcctgaagttgtaaaccaggtcgcattccttgtagccggccacgatgcaacaattatgatggctgcagaagcaggtcagatggagcttaacgcttttgagcctgttacattctatcagcttttcgagtctatcacagccgtaaccggtgctataaggacgcttatcaacaactgcatccttgacctgactgcaaacaaagaccactgcctttcacttgctgagcattctacgggaatcgccacagcattaagcccgaaggttggttatcagaaggccgcttctatcgcaaaggcagccctccacaacggcacgtcagtccgcgaggaagccgaaaagaccggacttttctctaccgcagaactcgattctatgctcgatctctcaaaggctgtcggaagaaggacagcagaagccagagtcgctgtaatgtgagttagaaagacgccgactcattatacgcaattgatttttcactataatttcttattcaaataatttaaagctaatctaaaaaacttccggctccgcagagctggaagttttttgttacaaattatcatagcgacgagctatagtgaaaaaggactcacgagcaccaattaaacaggaatatcccggtgctcgaccgatgtcgagaacacgatcagtgtctttgtatgtccatatttctggattacgtttatcagatggtcgagttcctctgttcgcttataagcgacttcaataatcatcgagtaatcaccggtcacgcaattgcactctatgacgttcggaatctttgcgatgaaatcatagaaatctgccttgtccttcggcgcgacctccagatttacgaatgccttgatattgtaaccgaactttgagagatcaattgatgcatgaaagcctgtaatgataccattttcccgaagccttctgatcctcgctgagactgttggcgatgtcaggtaaagctgctttgctatctctttgaccggcattcgggcattctgcatcaacagatttataattttccggtcagtctcatccggtgtataatccttgttttcttctgccataattcatcgcccgtctttttattttgtttttttattttcttcacgtgttctcccaatgctttatcaatctttttgtcctgaggtgtgattttttaaagtaagtccgccagctgtaacaccagcttctccgtctttttccagccgaggcacggatctgtgatcgacttgccatatacgccttcgccaatcttctgtgcgccgtcttcgatataggactcgatcatcaggcctttgacatattttctgatggattctgaaacactgcggctgtgcattacatcctttgcaatacggatctgctccaggtatttctttcctgaattcgaatgattgcagtccacgataatagttggattcttaagctccgggtgctttttatactgatcaatgacgcctatcaggtcctcatagtgataattcggatggctctttccatctttgtcgacatatcccctcataatacagtgcgcatacggattcccggttgtatgagcttcccatcccctgtaaataaaggtgtgtgggttctgggccgctatgactgaattaatcatcacagaaatgtcgccacccgtaggatttttcataccggccgggattccaattccgcttgccgtgagcctgtgctcctgatcctctaccgaacgggctccaatcgcaacatatgacagcagatccgacagatatctgtgatttcccggatagagcatctcctccgcacaggtaaagcccgtctcctctacaactctcatatgcatatggcggatggcaataatcccgccgaggagatcagcccccttctccgggtctggctgtgtgaacatgcccttgtatccaagccccgtcgtacgcggcttattcgtatagacacgcgggataataaaaatcctgtccctgaccttgtcctgaagagcggcaagacgcgtcatgtaatcgagcacagcgtcctcattgtcggccgagcaaggccctataataagcagaaatctgtcatccttccctgtaaaaatatcaaagatctcctgatctctcttctctttcagttccttgtcttccggcttcatcggatatttatcctttatttcctgcggcgtcggaagcttacgcgtaagttccatctgcatgtccatgttaaaagatctccttttttcactttaatgctttaaagtatagctcttgaactgcctgaaatcaagccacctttcaagctttgcctgaatatgttaaactgaaggaaatattttaaggagaaaaatatgctgagtattgttggtatcgggcccggcggttacgacgacatgaccgtcagagctgtaaatgcaataaaaaatgccgatgtcataaccgggtacaagctctatgtcgaccttgtccgcgacctgaccggtggcaaagaagttttctgcaccgaaatgcgcggcgaagtcgagcgctgtaaaaaagccgctgaattcgccatttctggaaaaaatgtagcactgatctcgagcggagacgcaggcatttacggaatggccggtcttgtacttaaaattcttgaagatcatcccgaggtcgaaaccgaagtaattccgggtgtctctgcctgccagtccggcggtgcagtcctcggagccccacttgtacacgattttgccgtgatctcgctaagtaacctgctgactccgtggtcacttattgaaaaaaggcttgaagctgccgcttccgccgattttgtcattgtcctttacaaccccggcagtcacaaacggaaagactacctctcccgtgcctgcgatatcatgctcagacacaagtctcctgagactgtctgcggcctcgtaaaaaatatcagccgtgacggtgagacaagctccatcacaacccttgaaagacttaagagtactcctgtcgacatgctgactactgttttcgttggaaacagccagaccactgttatcaatggaaaaatggttacaccgcgcggatacagaatctgactccgctatatcttgcgtttagactttcgaacatcagtgctattttgcgattgacttttcagaacacacgtgctaacatttaatcatcgaacgtttgatctttttcgttgatggaggtgcattatgtttgatagagatgctataatgaaaggagataaatctaagcgtatttatgtgacagtagagtcagtctttgaccagaccgggtatatgcagccggtttccatcacctggaaccaccatgttatccctgtccaggtccgtgatttccgtccagctgcctctatggcaggcgaggggaagtcaggagactgctacactgttttgatcggcagccaggagaagcacctgtttttcgaacgggcgagccacctgtttccatcgcgggtgggccgatggttcgtagaagtggattagccacgcttccacttccctgaaggttttttatcttgttttctgctatgctgccacatttttgaaaggaggcatacctgtggcagaccgcatatatctagctattgatctgaagtcatactatgcctctgcagagtgtgcctggagaggccttgaccccctcacgacgaatcttgtcgtagcagatgcttcccgcaccgagaagaccatatgcctggcagtgtccccctcactgaaggcatatgggatttccgggcgggcccgcctgttcgaggtagtccaggctgtcagacagattaactctgaccgactccgtaaggccagaagccttggatactccgactttacaggggaatccttcgattcagaggcactggccgccgatccatccctgaagctttcgtatattgtagcaaagccccggatggcatattatctgaagaagtctgcccagatctacagtatctatgggaagtacatatcttcagatgacactcttgtatatagcgtagatgaggtatttctggatgtgacatcatatcttaagctctacggtatgactgcacacgagctggccatgaccatggtccgcgaagtcctgtacaccacaggcatcaccgcgactgcaggtattggcactaacctctacctggcgaagattgccatggatattgttgctaagcattctcccgctgataaggatggtgtccgtatcgctgagctcacagaggagtcctttcgctacgaactctggaatcatcgtccgctcacagacttttggatgacgggccacggcaccgaacgacacctgaacagactgggtatcttcactatgggtgaccttgccagattttcactcacgaatgaagacctgctcttcaaggaattcggcatagatgccgagctgctcatagaccatgcctggggatatgagccctgcactatgaagcagatcaaggattaccgtccttctacgaacagcatctctgaaggtcaggtactcgccagcccctacacctatgagaaggcccgcattatcgtctcagagatggctgacagcctcgtctggcagctgacagggaagggacttcagaccgacagcattacgatggatgtaggatacgaccgtattaatgtcgatcagggcacatataccggccctgtccatatggactactatggccgccttgtacctaagggagcccatggcagcactcatctcgacaagccttcagggctttataccgatatagttccagcgtgcgaggctctgtttgacgagatcacagaccattctcttctggtgcgccgtattactatctctgcgaacagagtcgttgcagacagcggttttacacagatgagcctgtttacagacaccgaagagagccagaaggagcagcgtcttcaggacgctctcctcgatatgcgccgcaagtatggaaagaacgccgtcctcaagggtacgaatcttctcgatggcgccacgatgatcgaacgaaacggtcagataggaggtcacaaagcctgatggcagatacagaagactattcagactctacatcagctccccgtgttactggcgacagccgtgagtctgctgatactaatgcttcatatggcgaaagctgcaagactacccctacaggcatcgctactgccgcgaagtacgccgatatcatagctatgcctcgtcccgaactccatcatcagcggatggacattttgaaccgtgcgaagatttttgctccattcgatgcgcttcgcggctttgacgaagagattgacgaagtggataagaagacagcagtagataactccgtgacttacattaaagacgatttttcagaataggatttttcaagctttaaggctcagaccttatgcagcattttttgtaaaaaacagcagtcacatggcggcttaaatgccccaactgcggctgctgtattttttaccacttttttaagtctggcctagattacctgacccagctgctttagcactatgccggacaggcatcagatctcgagcagtgaagcgtactccttgagtgcatctgacatatctccagcgagaactttcttcgcaagagtctttccgagctgaacaccctcctgatcgaagctgtttacattccagaggaatccctggaacatgaccttgttctcgaagtgtgcaagaagtgctccaagtgcctcaggtgttacctgctcacctactatgatacttgacggtcttccccccttgaagttcttattcagattcttgtctgtctttccacaagagaaggctacgatctgagctgcgacatttgccttgagcttctgctggcttgtcgagccctcgatatttacatcattctcgagctggctcttcttgaatccgatgaactggagaggtactatatcagtcccctgatgaagcagctgatagaatgaatgctgtccgttcgttccaggctcaccgaagatgatctgtcctgtcttataaggtacaggctcaccgaagcggtttacagacttaccgttggactccatatcgagctgctgtaagtgtgccgggaagcggcttaatgcctgtgagtatggaagaactgcagtgcaaggatagccgagcacgtttctctcatatacaccgatcagggcatcgagcatctcagggttcttcataggatctctctcggtagctgccttatctccttctgcagctcccttcaggaattcagcgaagacatccggtccgaaggcgagcgaaagaacggctccgcctactgcggatgtcgaagaataacgaccgccgatatagtcatccatatagaaagcagcgaggtaatcagggctctttgccaacggagaagtctcactcgtgacagcgatcatatgctttgctggattgaggccttccttcttcagtgcatccattacgaacgactgattagtcagagtctcaagtgtagtccctgacttcgataccaggatgaagatggcatgagctacatctacatctgcaaggactgctgaagcgtcatccgggtctacattgctgatgaagtgagcatccatcaggaatttgccattcttctttgcccagttctcaagggataagtacatggcacgaggtcctagatcgcttccaccgataccgatctgaacgactgatgtgaacttctcacccttttcattgacgatctcaccgttatgaaccttatctgcgaagtctgcgatcctgttctgctgctctacgtagaagtctctcttgttcacgccatcgactactacgtcttttccaagctgtcctctggtcagatggtggagtacgagtctcttctctcctgtatttaccactgctccattgtacagctcctcgaacttatctgaaagctgtgcttcatttgccaaagctgtcagggtttttaaaatatcatcatctacaggtctggctgcataattgaatacaaagcctgctgccataggtacctgatattccttcactctcttcgcaccgctctctccagtcataacgtcaaccagatctaccggtgtagactgctggagctctctaaaagaggccagcgtgtccaagttgttccaatttatcatatttgctacctccaataatccgacaagctttgttgccggatgacttgacattttcctaatgaattgtatcataaaactggtggtttgaacaccataaactcaaatttaatgacagaggtttaacctgatatgaaaaaaataatccttaccggcggaggaacagccggacatgtcaccccaaatcttgcgcttcttccagcattaaaagaagccggctatgaagtcgagtatattggctcgtataacggcattgaaagaagccttatagaaaaagaaggcatcccttatcacggcatcagttctggaaagctccgccgttatttcgactggaagaatttttctgacccgttccgtgtcatccacggctatggccaggcccgttccctcattaagaaaatcaagccggcgatcatattcagcaagggcggatttgtctccgtccctgtggttctggctgcaaagtcgctccacatacctgctattatccatgaatctgatatgacacccggacttgcaaaccgtatagctatgcgtggcgcagtgaagatctgctgcaattttcctgagactcttaagtatcttccagaggacaagggtgtggttacaggttctccgatcaggcagcagctgcttcacggcgacagccaaaaggcccttgagtttaccgggctctctggtgagaaaccgatacttcttatcattggcggatcacttggatcggtatttatcaataacgctgtaagaggcgcagtagatgaacttctcgagagatttgagatcatccatctctgcggcaagggaaatctcgaccactcactcgacggcaaaaagggctacgtccagtacgaatatatttcaaaggagctgccagacctgttcgcagcagccgatctggtcatctcgagagctggagccaatgcgatctgtgagcttttagctcttcacaagccgaatatcctgatcccgctatctaaaaatgcttcccgcggcgaccaaatactgaatgcaaactcattcaagaagcagggattctcatatgtgatagaagaagagcaggtaaatgagaagacgctctcagaggcgattcactatgtgagtgaccacgcagaagaatacaagaaagctatgaccgacagtggccagatggattcgattgcaaagatcgtagatcttatcaaacaatattctaagtaaaaagcagacaaaagatggcgttcatcccacaccgtgtgagatgaacgccattatcattttatcatgatttgatgatacggatctttccgatcagcggcacttctttcatagtcccctggcaggccgagatcagcccgataacccataacactactgtgaaaatgcgccatatccatccgacaacaggaacaggaatgaatcccagcaggccgaaaagccagattaccagcgcctggttgatatggaacttgacaaactcactgcggtggctgctgtctgtggttgccatcgcaataatccatccgatcagagtaatgtaggcaacgatagccatattattgtcgtcattttgagaattgtactgattattcatttttatctctcctcttaaaaactattgtatttaagctgctggcgttcgtccgaacagcagctttagctgattagttcattcttagtttatcgcagatctccttaatctcgtcatccgaaagccccgcatgtgagaatccgagcagagtactgttattcggagcatcattgtatctcgggatcagatgcatatggaagtgaaatacagactgtccagctgtctctccattattctgaaggacattgaatccgtcacaatggagcacttccttcatatgcgaagcgatcttcttcgccagcggaaaaatagctgcggcttccttgtcaccaagttcatagatatttgcataatggttcttcggaagaatcagagcatgccccctgctgaccggatcagcatcgagaattactgtgaacagatcatcctcatatatcttgttcgtaggaatatctccgtttgcgagcttacagaaaatacagttgtcatctttcattttaaatagcctcctgtcatgagaagataaatatatcatcgagaaccctgagatcggcaaaagtaccctttgccgtcataagccccgtattaaaagccctctgaaaagtcatcctgcccgaagtgatctcattcattgttccctcggtcaggtgagccataactttggcgtcattgcagtcttcgtatgcgacatcgatatcactgctgttcacttttacgaccagaggtttttctctgccaactataagaaaagctgcagttatcgataaatctttcctgctgtgaaagtgcgactggaatgcattcacaaattcggtctcgaccttctcaccgtctttgccaaggagatttctgtacatcgaagagagctcaatgatgtcttccttctgctgtgccacataagcatcgtcagaggcgtattccgaaagctgctcgctctcctgcggagtaagctgcatcgtgcgggtcctcagcacagatcgtcttaccgcctggttgctgctgggaagactcttcgtatgcgatgaaatcgtcctgtagagattctcagcctttttttcaatgatgcggtgatagccgggattgtcccgaagagtagcgacaccgtcgacatatccgcagaaaccgctgcagagctgtcctccaagtatctgccaggcattttcgagagtcagcacagcctctctctcaccataagtcgtagagatgacaataggctgcatgtagatcttcgcgatctcatccttatcgccatagagccagcaggcatcgagaaactgtgtcatatagccgccaattccgagccactcaaccgtagtagccagaattatgccatcaactcccttaagagtagacggaagcgtcgaaatggaattcttggcttcgtaaatattgtatctgtttacttctacccgaagctctcctaagactttttcagtctgcgaaagcacatagatggtcggatcgtcgagaactccccgacctccatagtagatatttatcttcatgaataaaccctttatttatacgcatgtttaatacaagctatctctattagtataaactctcgggttgataaaatcaaataatatgataggccacatctgcgaaaacaatctggtccattctgttcagcttcaccttgtcatgatagggaagtaaagtgccatttacatatgttccgtttgtagaattaaggtcttcaataaagaaatcgttccctgagcgcgtgatcagggcatggtgcctgctgacaacccgcgaatgcagcactgcctcattgtccccgttctggctgccaatccgaaaattgtctttctttatgtagtgatctttctcagcgcccttaccgtcgtaaataagaatgccctggaatacggcctcgccacgatcttttctgccgtctgcactgtcttcatccggtttcataaaggcagtctttgtcagaagatctgtgtccggatcaaaaacaaaatcctgtgaaaaatcgtgagcttcctcctgttcatttgattcctctgcctttttctttttagctttggacagaaccggccatttttcaaggaaatagttaacgatcctttgctttaatgacggcttgtcccacctcttgaccttcttttttggaattatctccgggtctggctccatagattgtgcattatatgtgccggaattgtcagagacagaatctgccattttatcagtgtgttcagttatcactctgtcttcggacggagtaaattcttcagtctctatcggtttaagcaccggctcttcgatcctatcctgtggcagttcactccggagcatatcgacaagttcttcgagtgataccggatcctggcacatttcatagagcttgtagaccatttttgtcacctgctcttttttatggtctacttcttccatgaaaaaagtcatcagattctgaagctgcatctcgtaatcatcgtgctcgagcgggcaatagcagagcttgaccattggcggctcatccctgttgaaatatacagtatcaggcccgataacgatatttttctggctgataaggtactgcgaaagcatagaaaaagccattgcaatgccattaaaaaacatgtgtaaattttccaaggtaaccccttcctgcctgacaatgtctctgacagaacggagtctcgtgatgtcataccacacctgaagtccgtggtccagatccaccatgtaaaatgacaaaagcatagcgacttcgttctgccttaacatctcttcttcatagccttctcccgattctttgcccgacaggatcatataacttctgttaggacttctctgatagcttacatccattttcccctcctttatgccgctcagcctttttcgccggtgagcgtaccggccacatccctcataacattaatcttccgaaactcctttacagcctcaattttcgccgggccaatcctctttatctcatttactgtctcgtggtacagattaaaactcaaaagcagaattgaaaaaaataccacgatcgtcagtccgaacatccagaccgcctcaactgtaaaataagccccgtattttttctttaaaaattccagaatcctcctcaacatagtctcaccccttcaaaaatgaaaaatcctgcggtaataaacggtatcagtggaagtgcggtttctttatcacatttaaaaaatattattgcaatttcaccccctatgcctgccacaaaaacagaaagcaaaataagcagcaggttatcgtatagcccaagaaaagcccctgttgatgcaaatactatgccgtctgcactcccgatcacaccattaaaacacagcgacagaacaagtatgaaagcccctgagacaattcccccaaagaactcatcagccgaaaactgccttacaataaaataatacagacacccactcgtgaaaaaagccagaagtatcgcaaggtgcacctctttccatatgatatcctctacacttaataccacaagaaatgccattacaataaatatttcggtcatcgctttctacccagcgcacatttgctgcatggcctgtatttctttatggcttcgctccgcgggacagtccggatggtgcgcttcaatttgctgcatgtaagcgaggaatgtgctctcgtcccgtaatccgtgtaatagcatatttctccgatttttgcgccgcactcctcacaggggtaatatttattgccatttttggacctgacatatccaagtgctgaaatttttccagtgtgaatggagagtttgagatagctgcagctgaggctctcatggtatgctctcccctgagccgtcacatagacaacatcatttccactgtcaccgccattcgacggatcaaaaccattccatcttctgacacagactctgctgccgagttcatatcccctcttcccaaaggactttccacctgcgaggaggggcatcattgtattgactcttacgtcaatatccctgtcatttacttttgtttttgcaaagtccagggcattgagcctgtgccttaaaaatttctggctcactttatttgaatttattttagcattgcaagtcacatacacactggccgggtttacaacctggattcctgaatttccattcctgcctttattgcctacgactatctttccgtcaccgaaaagcgccattttaccggctgcctcatataccgactctgtcagcccccactgaaaagaaagaaccctgaaaagcagcagaaaaacgagcgagaaaaaagtgaaaagtggaagcagtatcgccgcttcgtatgtgaaaaacccctttaattttttcataatcccccaatagcaggaaaagtcctctttaggcagtgcccattgcaggacgaattgttcaactgtttaatatgcgtgtgcaccattgttagaacaaagcaaaaagggaggataatgacctgaacaggcactccataaagaggaccttctcctgctgctatttagttaaataagtcatttttttcgtcttttcgaatttcatcgttggaaaattccggtcggacagagcgaaaagtgagaaaaatgctggaactgagctgtacctgtatttgaaatcagctcctgtcacaagctgatccagtctcagattttcatagtccctctgcatccgcaccgaattttcgagcagatccaaagaacgtagtccaagcgtcttctggctctgcatacccgataatataagcaggtaatcttcgtatttaatcccaatcccacactccttagcttttttatttacatcaaaccagtcagccagttccagcagattatcagtcgtccactcatctgatgacttaaaaacagaaacctttccgccactcagcagaagccgcacatccagcacactctcggtataagcccaggccgcagtaagtccccagaatactgcatttattatcgcagtatttcctgtccagccagccagagtcagagcatgggtatcagcctgggcaattttcccctcatcggccatcaggctcgcatagttttccacttctctcgcaacaagaagttttgatacggtcgatgcaagattgtccttatctgaatccttaccacagagaacatactcccactcatagttcaatccatcgtgtccgagatttttcctgtaatttgaaaaatggctcttctcgtactcagcaaacagtattttctcagatgcgctcagcttctcttcagatgctttactccccttagacagcgtccttttggatacagtctccgaaagatctgcttttttaaccgatatcttcgttgaagaaggcaggacctgcgacaggataccattgttcttccactcttttatctgctctatcggattcacctcatccggccccggtttcgtgtattcttccgaatttccctgcgtttcagtctcagaattttttgcagatttttccatcgcacttgagccatcgtccaccattttttccacatccccattttcatttctggactcttttatctgttcgattgcatcttttgtcctttttacagcatcagccgcaatttcagatttctgctgctctgccgcctgctttaaaaatgctctcccactatcatccgtaaggaacacatactttgagacctcgcatacttccgtagtcagctgataaaaatctctcccctttgtatcagcagacaatccgttttttatcagatactcctgcatcctcgactccatcagcgaaaagtcggctcccccaccagttccgtatgaagcatcaacgccaagtatcctgtaattatcccagaggtatctgttataatcggcaaaaacactctgcgccgctatatctgagatcaggtccgcctttttcctctgaccttgaattctcgccagatccagaagcagaaaaaacaaaagcagcacactcgcaagcgaaagtgatataaagactgtgatagagcctttcctttttctcttcatttaattactttattgctgtcagaagttatcttttgcagagcattattcactatcgtctttatcttgcctctgaagatcactacgagtgcaacgataacagccaggatgagtaccacctctacagtacctatcccatcctcctcttttaaaaattccctgaatcccatattgtttcctctctttaaaagcctgtcagctcatctgcatgaacgcaggcaccataagcaccacaaaaattatgcccataagcccaatcatcgggaccagaagttttaaggaagcttcctccccttttgtttttgccccgatcctgcgctcgtcataagctgatttttcttcctgttcaagctgatcgcgaagatccttatttcctttcataagactttgcgacaacagcagtgtaagtttcctgaagcctttgtgcctcaggcaatcccccagattcttgtaagcagttccttcgtcctctccgtcctttatcttcctgttcattcgaacgatttcttcaaaagcaggcctgtctggatgccccctggcttttcccttgatgtaagcgtttcccagctgaacaaaagcggcttttacagaaaatcctgctccgatgtataaagacagctgcgagaccaccttcgggtagtcgtaagaaagctctgactgccattttttctcatcatccttcgacttctgatgcctgtagaaaatatagagcccaagtgcaaatgccatcagaatcacaagtttaacgccgtcatcttctctcttctctgaaaaagctatccttttatctccgatgctctccggaagttccatatagtttttcgcacggtctctcttatctgcctccgtaactgcttttttaagataataggaaaagccctctgccgtatctagtggaaccggaacagctgtgacagagagctttactttccctgtcttattctgacatttgagatatcctctgatcgtcacctgagtttcctttttgacctttgaattatcgatcttcccctcttcgtcaaaaatatcgtatggcgtaatatcccaactggcttccacatttccgttgtattcttcctgtaacttaatatctttatagacaaaatcggcacttttattttttccgaggtactccctttttatctgtttctcaacagcttttacagcttcctctgcccctttttcagtgagttcccgctcagaaatctgaagagtcagtttctcttttttatccccctcaataactgtcacttcgtgttcttccgacatcgttccaggctccggtcttttgatttttgagatagtctgatttcccgagccgcccgcaaggcttattatcgtccccacaatctcaagtcccacgatacagactgcaatttttaccgggatcctgttctttcctctgttcagtgccaggatgaccgctatagttatcaccgtaataattaccgatgccatatttttaactcccctctgtcaaaacacagaatttttttgtattctcctgcaaaaatcccctaaactctgatatctatgatctttctccccaacgctatacagcccacatagaccgccagacatgctgtcattactacaattcctataaaatttccatatgacggcgtcagaaattccggcgctgatattttcatatatgcgagaatccccagcggcatcaccatcatgaccttaagctcaagctgctgctgggctatagaggcccttatctcctgcttgacttccaccctctccgatatacgcctggtcgaactcttgatattttctatatagtcgccgcccagcctctttccaaaacgaaatatctccgcgaagtccgacagatcttcgctgtcaaatttttccgaaagctcctcaaatgcctgctcaacaggttttctaagccggactttactgtttaattccacaaggtgtgggagcagtacacttttttcaccgtaaataatcctcagtggctctgtgctctccaaaaacgctctctctatcgaatatccggtctgaagtgaaccagtgatagaaataaacatctcccggtattcgagttcaagctgctttgaaaatttttcgcccgcctcctctttcatccgcttcgtattaaaccaaaccacaatcggaaaaagcaaaatcccccagaggctgttgtaaaaaacccacgccagagctgccgtcagtccgacattttccgctaagagcagcagcttctggcttcgtccaagagtccggccatcgataatttcctggtgttttcgagtttccctttcctctcccattttttcgttccatcctccgaatactgaaatatcggcgaaataacgatctcaccgtcttctatacccctgacttcagagacctcgagcagctttctgctcccgtcggaaagtctcccgagatgcacaagaatatccacacctgatgctatctgcgccctgatcgcagagaccggaagctccattcccataagaaccatcgtctcaagccttgagagcatatcctttgccgagtttgcgtggcctgtcgataaactgccgtcgtgtcctgtgttaaatgcctgaagcacttcgagcgcctcggctcctctgcactccccaactataattctatccggcctcatgcgaaggcttgcttttacaagatctctgatcgtcacttcgagatttccctcgaggtttttgtcgcgggcttccagccgcaccagattttcaatcccaatgacttgaagttccgccgaatcctcgatagttatgactctctccccttttggaataaattctgtcagggcatttaaaaaagttgttttgcccgagcctgttcctccacttataaaaatattatatccagcggtaataagtattctcagaaaatccactatctctgtactcacagagccaagctcgatgagttttttcattgtgatcttttctttcgggaaacgcctgattgtgagcactccctgattcagcgctatcggtggcagaattatgtttattcgcgaaccatccggaagccttgtatccagaattggcgacgactcatttattatcttgttcctctcagctgctatctgctggatcacatccgaaagtttctccttcgatgaaaatttcaggggactcttaaaaagatgaccttttttttctataaaaatattttccggtccatttaccatgatctccgtgatctcgtcgtcagataaaagttcttccaggatatcgagttttcgaagggagttgaatatccgctcctccatcaaaatcctctcctgaagcggaatttcatattcgtgcccctcttctaaaagccactctcttatatgacttcttatctcatcatccgtcagatcccgtgagacatccacatctccgattatctcttccctgatatgctcggacagggcctcctcgttttcagaaagccgccgcattcataaactcctttctgacaaagccacccaggttcccattcagcattgtacgaatatggtaatctccaggctgctgtgagaccgacatcggtaggagaagctggtggcattttttcgtaagcccctctttttcaagttcggctgtaaatgccctcatgctcttatcgtaataagagcccggcttaccaaggagcagaatatcgtcggccgactgcagcagtgcatctccgccctgtaccatctgatccatcaggattataatctgctcaaaatccgttctgctcagattttccataagtgccatccactgttctacagtcacacaggcgagagctgtcagtcccttcattggtgccagatagtaaaaattctcatagaatccaaggaaatccgtgatatttttaccgtcgtctgtttttcccatgatatggtacagataatcgcccaaatctcttctgatgtttcgctctaaaagctttgaaaatactgaaactccctccatatcgacaaacagtgtctgcgaactttcacctatgaccttcgccatcgaaagtgagaacggaagcgccagttcatggtgcattggtgagtagataatctggattctctgcccctttttgccactgaatgatgcctgttcagaagtctttatctggaaagctctctgaatctgttctataaacaggctcatcttttgaaatttatagattacctcgtatcccctctcgtctccctgcacatctcccttcaggtggaggatgtttccgaactgtctctttttctcaggatttttttctactatatctatgaactcatcacccagaagagccagcgagtagtcattcgattcactaaggaaatcattttcttcagtaaacccgctgacctcatagtgaccacctgcaccaatcatgtacgtgactaacgcactcagatatgccttgtccgtgtccgcaataagcagccttatttttttcatctgaactcctttcccaatgccaatgccaccaaaaagccgattgaaatatacaatgcgtagtgaagattccccttatctccagacgttctgtaacgaattaatttcttctggctaatgcagattccaatatgtgagaaaaattcctgaaatctggctgccgcttcgccacttttcaaaagataaattgcagccacgacaccggctgccaaaagtgagtaaaatgctgtccgtactgcgaatacaattcccgaaaataatccgatcactgaaagcagttttacgtcacctgccccgacagctcctgtcaaataaaaaatataaaatgctgctagtgtcagaagaccttccagtattccaagcgccaggcctgctggcccgccttctgtgattcttatcataagaccggtcaggtatccgaatattatcagcttatttggaatttttcccctcttaaaatcagctgctgtagcagcccccagaagtgccgccaaaaaaatatttttcatatctccctctctttcagatccggattcgataaaaggattatatttcatgttcgattccgatgtcacttgctaaattttgagcttttttattaaaatagcattatgtattatgcacaaagattttatttttccactatgcacaattttattctctgaaaaagccgctgtttttgttcaaaactcacaaaaattctgtcatttgctctatatcgtgttatttaactgatatatttccatgattctgtcaatccatatattgttttacaaaaattttattttttaatttttcccaatatcttgtttttttataaaaaaagaaccatggttttgccatggttcagatgttttgtcaattttgactaatgctattataattataaaatatatttagattaaaaatcctctgttcgaatcaggggctatctcagcctcatttacatcggtccttccataggtgtaacctgcgactgtttccggaacattttccataagcggagctgaattatcgctctccgcaatctttgcgtatgcctctctgagtgattttatcagatcacgggcttcctgtactgtatcgtagcttccgttgtaggtggcctttgaaagcagctcctgacagtaggtatagatggaaaacagcctcttgcagagttcttcatcatgtgaaaaatcaaggtcatttctcaaatgatttaatacatctgaggcatgctctaatgcttctttgctggcgtcatcgccttttttcccgtctgcgtatccgctctctgcctctttggcatactcatcgaacatatcatagagtatgactaaaagctctactgcattggcgtgcgtgatcctgtttgtaaactgctgcttcatttcgtctgtcattttgtcgttcctttctctttaaaagagttcgcccactgtttctacaaagcttcttgctatagagtacagcgttttcgtctggatctcatttgttttatcatctgtcgtctcaaagcccggatcatcggtattgtagaatactgccgaagcatcagtcctgccgtcatactctgttacaaggcttactgagccctgtcctaatttttcctggattttttctgcgagcatgccaagattttcacttaaggtgtcgcggcttatacgcctgttggtggttatttttccatcaatgccgccatcctcagatgctctgaatttcgcgtaaacctctccagtcgtatcggaatccatcgcgatatcgataaggcccttcttttcgtcctttccgcggacgatcttcaggttcatattgccgagctcgtcgccgaccattaccggaatcgcgtactcttccttcttctgcgaaagctctttcatcactgagagctggcggactgactgctgtataagcctgatgtctatttttccggcggctgcgtcgtctgccaatgacttccggagggcattctctgctgtgtcgtagagctccttttgagcctcagccatctcctgcggcgatttcaaggcctcggagaaatcgtttataagcttctcccatccctcatccaaagtcaggccatcgccaatgcccatactgtctgctaatacatcaaacggctggcggccattttctccatagagccttgtatagaaaaatctgtggtttttgattacctgatttacggcctgaatgttcagcggtgaaactgcaacctctgaatcattcaggatctggtatgtcctctcgtccgcttctgccactgcctgctctatctcagccttcttcgcctgataaagctgttcgtctgtttcactctcgtcagtattgctgctttcggcttcaagagcactcgctaatctgtccggtgacatcggcatataagccttttctccaccgattgcctgaaggcgctccggtgtagcaagagctttggcgtcgcgggttctctgtgtctcgaattccttttccttctcaaaggccgtgcttatctggtctgttatagaattcgtgatagaagaatccggtgtgctgaagctgtcatcaactgagtaatccatcccctcatttctggtggagcggaccgcctgcatcagattctccatcgtgatatcagctccctctgataaaagcgctcctatcggtgctccatcagtcacatctatctgattcatcagtcggtaaagtcctatatatgactgcttctcatcttctgtaatctttccgctgttttcagccttccagaggaagtcagcatagtcagcagcgtccttatctgctgacgagccgctcgatgccatgaccttctttatctcctccgtcttgtcatagagctcgtccatcgacatctgaagtggattttcgccattttttataagcttcattacaactccaggcttaaggttattgaaaaccttctgaaccttttcgtcggcagcctttacgtctgagacatttttttctgttatttcacggctgttatacgcgagtattcttaccgcacggcgattctcgtcgtttgcctcgaggcctgtctcacctaagatatcatcgacattcgcaaatgccttctgtatcgaatctcccaaatccggccttacctctgtactcaaagtctcataggcacttccggcttttttaagcagatcatttgtagtttttcctgaggctatctcgctcagcccacttgaaaaaataccgtcgtatgtcttataacacgatataagcgctgccggcgactgcttcgcgttctctatcgcatctgtcgtatcatcgaaaagagctgcctttttgatgtcatccgggaaaagtgcctctcccagagtcttctcctgcgccttaagctgctcgactatatctgagagctctgtcgtatcgacagagattccctgctttatcagacgatagtttgcctcagttgtcatcatgaggcgggcctcctcgagctgccttttggctgaaaccagctttaactcatctgcactggcagaactctgcaaaccactgttactgccagaattatctgagccgctgatgtctgaattatcggccatagcctgcttcagattttctatagtcagtggcttttcgtctgctatgacgctggatagatcctcgtctgtagctttcgatatgacatcagctgcatctctggacttatccatatctgaaaagcccattactgccatcgcttcgagcggactctttccttctcttaccgcatccgttatggcctgcggaagctcctgagctgtaattgtctttgctacgtttaatgtattaaaatcctggatattttctgctgtaagcggtacattattttttaacagaaaaacagcatttgaaatctgagtttggtctgcgtcaagcccggcctcttcgatttttccagtaatctgaggcatcaggttctctatatccttatcagaaaggtctgtctgctgcgacatatctgtatttccggcaaactcagcctttaagacattgtccactgttggctgctggtcattcttcagcagataagtgctggtatccgcgcttattgtatccggaagttcagctgccttcgaaactgtctcctttacctgccgcatcgtgaccgtatccgtcggcaggtcagcattctgaagtgctgtctgtacatttgaaatggtatctgctgtctgcgggcctgcactttggggtgcactcttaacattcgatactgtttctgctgtggatggagctgaagactgcggaaccacagactctcctgaggactgctttatcgcgctctctatgctgtttgcttcagccgccgagcccgacactgcctctactgccgccttagatacgccgcctgtaatcgacatatccttcccagcctttgccatgtttatacggatcttatctgctatcgtaacaaaggtcttagaatccgtatctgccggatcaaagcctttttcgatcattttcttatagtcctgtttcgacatcgtatgagctgcaagaatcatctcattctgaatatttttctcaccggctccagactgaagctgcttctcatatgcctcagcctctgttttgatagtctttttattatagacaggtgagcgcatcaggccctcgcctttttcaattactatgccctgcgacctggcgtcagtatcgacacccataaggcttatgccggagttatttttcttatactcagctatgtattcagccgctttatttgtatttttatctgtcgtattattttttacaataaggtcttctatctgcataaaacctccgcagcactccctattatttatttcggcctgataatcggtttctttaacgcaaacttcccatataaaaagagggcatagtgccctcttttacaaaaatcgtacaacaatgttttatatgatataggtcttattaaaaaaattgacatcatcatgagtcagttttcagcttctcatagttcacttcatcgtcctgcagataattccagccagggtaatctgccatgatatcattatagagatcctcgtaataatactccctcataaagcggttttcgcctttttgatatgacagattgtacctgccatctaccgcgacattatagagctcgaccgcgacaacattctttgtatgcagaaggtcctgatccgcggaataaatcaggtaggcggcctcatggtctttctcatccgagtcgtatgatggcgccagccgtgtaatcattccccggtattcgtaggatttgtattttttcccgttctgcttcagaattttctttgccaccttatccagttcgtccctcgccgatatgatatgtcgatttggttcatcgagatcgcttgaatctctgacataatctggtgtcctgccgaccttatacgtttttatcctttgcgaataataacggttgcgcagcaggttatttttctttttgaattttacataaaagatctgcccctcgtaagaaaaaacagccttattactgtccttagttgaaaaagtaaaatctcttgccctgattcctgccggcgcgtctttcgtcacctcggcccttggaatcaggtacggctttgccccatcgaaggatatcgtaagatacttgaaaggatccaccgagacagcagctttccagatcagcacgacgactattgccagcaggacggccgcaatagtcgtcagtaccatttttttaattggaaattttttctccttggaagcagactcccttttccccttcatattcattcctcgtcatcaaaataatagtaccagtcatcctcagaagtgatgttgtacttatcgtcgttgctgttatcctcgtcgctctcagttccgtcatcgtagaagtagttgacagtctgggcgttttcaaactcttcccgctgtgctttcatatcctttgcgcgttctctttggtctgcgccagcatcataattgctgatggattctatcataagcataaaggaataaacagcaagaaaaaataccaatatcccataaggtccccttctaagggaaatcctcgaacctattctttcacgatatgcattaacattggcctgctcgctcgaattcagctcgccgtcatgattgtagtcaaacatctcatcaatagaatcattaacgtctctgtttgaaaaatcatcgaatgacatatttttaccaccctcttacaatatgacaaaagcacccggaccagccgaatgctcttttttacgtatttacagttctttacgtccctctaatgcgcgaagaagcgtaacctcatcgatgtattcgagatctcctccaaccggtacaccgctcgcgatacgggacacctttatccccgtaggctttataaggcggcttatatacatggccgtcgtctctccttcaagcgaggagtttgtcgcgatgataacttccttcacctcatcagaggagaggcggctcatcagctctttaagtcttatatcttccggaccgattccctgcatcggggaaatggctccgtgaagtacatggtaaactccattgtactctccggttttctcgtatgccgctaaatccctcgtatcctcaacgaccataatcgtactgtggtctctcttaggattcgagcagatcgggcagatttcctgatctgtaagcgtgcagcagactttgcagtagcggacattttttctggctgattttatagtgtctgccagtttgtccacctgatcggctggcatagataaaatatggaaagccagcctctgcgcagtcttctcgccgattccaggaagagaagagagtgaggcgataaggtctgagatctgctttgaatagtaatccatcagaatggcagtcctccacccattccgcctgtcagaccacccatagctttctgtgtttcctcgtcaacctgcttcatcgcttcgtttgaggctgcgactatcatatcctcgagcatctctacatcatccggatcaactgcatccggctcgatatgaactgccttgatctctttcgaacctgaaactgtgacttcgactgctccgccaccggctgttcccttgaattccttttcagcaagttctttctggctctgttccatctggcgctgcattctctgcgcctgcttcataaggttgttcatgttgccaggcattccacctggaaatccaccacgtctggacatatttaactcctattctgtgtcttcttctatgtctattggcatatcagttccaattatctgctgcatatcccggctgggatcatcgattttctggaacgtctggtttttttcattgaatttaaactcgattggcacctgttttcccaggatctgattcaatttcgcggaaaatgcatcgaaatccttgttacagatgttcaagtctcttttattgtcaaaatatacgacaagcttgtcattttctacaaatggctgatgcctctggtctccccagcctgccctgaaacttccagccatagtttttgccacatcgtttagaactgactttgcctctttaagatcctccggaacagctgtcggcagcggcgttatctcgaccggttctgcctgctgcactgcggcattttttacctgtatgtcacctgaatcaatcctgtgttcaagctcatctatgcgatttacaagtgcatagttgtcactatccatttccgggtgcataagccttatcagagaaacttcaagcagcactctcttgtcctgcgcaaaacgcatctggttttcaagatcactcagtatacggatatagcgtatcattgcctccgcagataatttatcgctgtcctcaaacagcctcttcttgttctcataggtcatatcgaaggtatcggccatcccgggggcatttttgtagaggagcatatcgcgcagataccagacaaagtccgagacaaaggaattcaaatctcttccctctgtcattactgagtctataactctgcagactcctgcaatgtcaatatctactatggcattgtaaatccgggaaaggacctctgtgtccaccgcaccaagcacactcagtactttgtcgtaggtcagctcttctcccagataaaaattgatacactgatccagaaggctcagcgcgtcacgcattgagccgtcaccagctctggccacgtaattcagagcttcatctgaagccttcactccttctttttcacagagctccccgaggcgggctgatatgacatcaactgaaatcctgtggaaatcgtacctctggcacctcgacagtatagtgactggaattttttgaagttcagtagtagccagaataaaaataacgtatgatggcggttcctcgagtgtctttaaaaatgcattgaacgcgccggggcttaacatatggacctcatcaatgatgtagaccttatacttacctgctgccggagggtattctacgtcctcgattatgctcctgatattttcaacaccattattcgaagccgcatcgatctccatcacattcatcgaagcgccctctgctatcgccctgcaggtatcgcactctccgcacggactgccgtccggaagcggatgctcgcagtttaccgcccttgcaaaaatcttcgctacagttgtctttccggttccgcgggttccggtaaaaagataggcgtgtccaattcttccggccttgagctcatttttcaaggtcgtcactatatggtcctggccctttacatctgaaaatttctgtggcctgaactttctgtacagggccatgtatgccatattaaatcatgctcctttttacaagtattcccgtcaggctcagtctccaaacgagattccaatccgtttagcttcctgcaccatcctgctcttaggatctaccatcttaagctttccagctacttctgcaagcggtacaagttttgtctcaccatttataatggcaaccatgttgccgaatttgcgatcaacgatagctttggccgctgccgatccaagtcttgttgaaagtatcctgtcgtatgggcagggacttccacctctctgcatatgtccagggatcgtaactctgacctctgagcctgtagcctgcgtgatcatgtctgcgatcttatacgataccgaaggccatttcttggcttctttggcaagcttttcttttctctccttcttcggaagagctgcgtcgtcttttgaaatagctccctctgctactgcaagaatagtaaatcctttaccctgcttgtgtctcttctggattgcatcgaggatctttacattctcatacggaatctccggcagaaggatgatatctgctccggaagcaactcctgcgtatagcgtcagccatcctaccttatggcccatgacctcaactataaatactctgttgtgagaggctgcggtcgtgtgaatgcagtcgatagtctttgtcgctatatttactgctgaataaaatccgaacgtcatatctgtgccatagatatcattatcaatggtctttggaagatggatgacatttaatccctcttcacgaagcagatttgccgtcttctgcgttccatttccaccgaggatgactatgcagtccagtccaagtctcttgtaattcgacttcatggcctcaactttgtcgagtccgttctcatccggaactctcataagcttgaacggctgtctcgatgaaccgagaatcgttcctccctttgtgagtattcctgaaaaatcagctccagtcagcttcctgtagtcaccatagataaggcccttgtatccgttcaggaaaccgtaaatctcgaggtcatccctgcaaatattctcgagtcccttgaccacacctctcattgcggcgttcaatgcctggcagtctccgccacttgtaagcattccgatcttcatcttttcgcctttcactttttataagttttgttgtccatataggagacaaatacattctctcccttcaggacgtctacggtttcccattcccatttgttcttaagagagacctttttcctctctaagatcatctcagctttgccgttgccatcaaccagcacttttctcctggttcctgccgtggtgccgcaattaaactcacgcatctgcgtcttatcgcaaatgaccttgagccttactctcgataacggagtttcttcttcaatctcaaacaggtactttttaccgttctgctttaccgcagtcttgcttctcgtgagcatccacatatttgaaaaattgtactcatatgtttcgccatcgaggaagataccgcctgcaagagctttttcagtatctatcgttccaactttgacctttgtgccttcgccgaatgcgaaagcgctgtttttaagtctgccgttctttttactggtaagattcgagcagctgatataatcccagctcggtccagctgtctttccccagaccttgtcggcgtatccattcgagttctccggctttactttgtatttttcaccgttccactcgatttctccggaatactctgtaataagtccttcggtgtgccaatacgcatccattatctcggaatcgcgcaaaggtccggatgtgctgtatcccaagttcagcgctacgcgtttattgatcttcaagtcccagataagatttccagcctcgctgtaatccagcggattcttctcgaccatctccgatgtgactttgatcctgcccatcgtcctggtctctgaaaggaagcagtcctctgcactcgcaagcacatccatctcagttccaatgctcacagaatcccatggaaagtatctgaccagaactgatccatcttctccgcctacagtcgcaagcaccataaaaaatgacggcttttcatcttccctcgaaaaaaccggctcatcttcccgaagctgtggatttactccgccaaaatctatcgtaaaactccgctctttgcctgtagtctcactgactccgtggaagcagtgcctccagaggtcaaatccctgtttcgccagtgccccgcgaagcataaaggagtcacggtccagatcgtgcttgttaaaactcggacctgcggcatccagaggtttttttaacatcttaggaaggtctgtgattgccattttttctcctttctgaaaaagttcttgtcaaattcgtttttttatagtacaataagtcactgttggagacgtatcgaagcggtcataacgaggcgcactcgaaatgcgtttgccgcccaatcgcggcacaagggttcgaatcccttcgtctccggtattttgaaggttccctttcgggaaccttttttagtagctttttatctggtcatcttcgtctgtagtagactcgtctatatcctttatgaccacatcatatgagtaattgtcatttaccctgacagtgacggtgtctccgacttttttaccgtagatggctttgcctagaggggactctatagagatcttgttttcgagagaattaccgcggatgctcgtcgtgatcttatatttctcagtctcatcatcctccggaatatacagagtcaccgtattattcataccgacagttccctcctcagatttgtcggagatgactgtggcattctgaagcattctctcaaggtagcggattctgctgtcattacgatttttcgcccgctttgcctcgtgatactcgaaattctcagacaagtccccatgtgcccttgtctcctgcacctcagctataagtttcggtctcttgttgaactttctgtcgtctatttcagcctgaattttctttacatctgactctgtaagtttttctcccatgtcctgcctgctatactacttatttgttgtattttttctctatctctgtgatcatgtcgattcttgtctggtgacgtccaccctgaggaactgcattcagatagctgtcaactatgtctttcgcaagctccggtccgacgatcctggctccaatccctaagatattcgcatggttgtgctctcttacgaggtgagccgttgtggtatctgagcagcatgctgcgcggattccagggactttatttgctgcaagtgtgattcccactcctgtaccacagataagtattcccagatcaccatctccagccataagtgcctctgcgactttctgtcctatctcagggtagttcactctctctgtcgtatccgtcccaaaattttcgacttcatacccttcttcctgcagatgctccataatttcaaatttcagctcagtacccgcatgatcgttccctattaaaatcttcattttcactccttagattctcttacaacttagattatctcataaactgttcttgtatgataggtttttcctgcctcgataactggctgatcgtattttggtacatttatcgcattcgggaaaaactgtgtctcaaaagcgagtccgccgcggcgtacatagagcctgccgctctttccatactcttttccgctaatattgtttccagcatagaactggactcccggacggtccgtaatcacattaacctgtaatgacttgtctggaagtctgaactgagctgcctcgtattccttcattccgtcgtggtcaaatgccggtctgtggtatttctcatcctttaacagttcatagttgtggtcatatccgccagcccacttcagctgatcatagtctgcatcaatcctctcgcttatagcgtggaattctctaaagtccatcggagttccctccactttagtgtctgtgccgtgcgggatcgactcctcatctgtctctgagaaataatctgcatgaatgcagacttcatggtcctggatatctccgtttccctctccgtgcaaattgaagtaagagtggttcgtcggattgaaaacagtctttttatctgaaatccctttgtaatccaggatcaaatggctgtctgaatcaatggtatatgtggcctctatgtccatatttcccgggaaaccaaattccatatcaggtctgtggtaaacaaaggtaacgtggtccgctgcctcttctttagtctcccacatgcttctctgaacagaatgaaaagcactgtggagattgttgtggccgaattcattcttatcgagctgatactctacgccgtctattttaaatgaagcgccgccgactctgtttgcatttggtccgataaggcatccatagttcggatcattgtcaaagtactgttcaatattcttgtagccaagtacgatgtcgcggtcctctccatctgccatcttcacatgaagttccatcagattagcgccgaaattcatgaccttagcatgaagccttcctccggaaatctcgtacgcaatgatatcttttccatcctctgtttttcctataacctgtcccattgttaaaacctcctagtttatttatttatcaaaaataacagtggattattcatatagagtatatttaatacctcattctttgtaatctgtgctgtaattttctggcagagcgacgtagtcgagaagcatgtgacaatatccataaacagccagagaataagcagcgctacgatgactccccagataccgccgagcacctttgaaaaacctccgatcacaggtacctttcccaaaatctgcgctacaagagaaagaattctcgttatgataaaagcgatcagaagcgaaatcagtatcgcaattcccttaaccatcagtgtcgccacctgtgtaccaatggcatccgagatagtctggtttgcagctgtgatttttttcgcatttgatgcgttgatgtttgcagtcatgtttgctgcatcattggtctttttatttatctttttcgaatagtaatccgaagcctttatcggaactttaatccccagatcctccaggaagtccttcatactctgtgagtctgacaatacaatatctgctttcctgggcttttcgatatcatctgaatagatactgtcagtttttttctctgcctcctttttcagcgcatctatatatttgttttcttttttgaccagaccggctttaacgttctctgaaaccgaattacgaaagtttgtataagcgccacccttcatcagatacttttcgatcggtggtgccacaaaatataaaaaacctattatgatagcccagttaataagtccacttacaatcccgaagagtcccctgtgaaaaccaatggcaaacgccgccacaaacagtattattgtcaatatcagtacagaattcaatctatttcctccatatcagttgagttttattatctggctgttctccggctggataaggaaataatctctctcgtttccagcagcctcgaaagctattacttcatctgggaaagtgtagctgaattttgtctttcctctgacatcgaataaccttattttctctcctgtttgttctatcagcagatcgtctcttaaaaaactgcatctcttatacgaggcgtcgagtttttctgtacaggtctttcggccgttatcatcataaacctcgagcactttgtcatttttcaccgtacggtgtatgagtccgaaatacccaccgctcattataacactttcagtctcgaaatcagtttttatcttcttcttttcttttacatcattgccggatgtgtaaagcactgcgccagaatctgtcagtgccgctgcacttccatcagagaaaaaagctgtctgagggcacactgtgtcgtcatacttaaatgacgctatgatattatccttcttctggtcaccagcatctgtaaaatcataaatatttatctgtgtggccagagaatctgtttttataactgatagagacataatgagtctcgtcccgtcgtctgacatggctatcgacattggatatcctgtctgcgacagatgaacctgtccgtctgccaaagacgttccatcagccttgtaaatatttatatatccagtgtcctcttcctcggtaagtactgccgatatgccgtttgacgctatgtctgcctgtactatcgggtgagtggtcgaaataacggagatctctttctgtggagacatgatcacaaatgtgctgcctcctctgtcgtatatcagaagcctgtcgccactgatcctgacctcgggattctgcatattgtacgattcattccataatgtcctgccatcggaatcatacagttgtgctccatctcttgaataagccatcagcccatctgcaaaggatacaaaattctgcgccgaagcaccatttgtcgaaaaactctgctcgacatcgtaagaatcgtacgatctgtcattctgccacagtgcgatcactatcactgccactaccaggacagcagctgtaatcagtgtgataactctccgcttattaaaaaatgagttcatacatcataatcaaagctgaaaagcgccacaccaaatgccgggagcggatatccgatcgaatagtcccgtccgtcgcacggctttctctccggtgtaaagctcttcttttttctcttcttctgctgaggctccgtgtctccggtatactccggttcgtcgctcgagagtatcagctcatgtttctgtgtacttactactccgactctgtaatcaggatatgcgactggtgtgaagtttacgacgcagagaatattcttctttccgtccttgctcttcctgataaaactgaatatactcctgtagctgtcgtttgcatttatccactcaaaaccattccagttgatatcctgctgccagagggacggatatttcctgtaaatatgcagaagcttctttacccagttctgcattcccctgtggcgcggattctcgagctcataccatgagagctcccatttctcactccactcgtgagtctgggcaaattcctgacccatgaaaagcagctttttgcctggatggcacatcataaatgcgtaccctgcgcggagatttgcaaacttctctgcctcgtcacccggcatcttctcgatcatcgacttcttcaggtggacaacctcgtcatgcgaaataacgagaatgtatttctcgtattcgttatagctcatcgcaaaagtcatgcgattgtgattgtccttgcggaagaacggatccagctgcatataatcgaggaaatcgtgcatccagcccatattccacttatacgaaaagttcaggccgtcatcttctacattccctgtgactttcggccaggctgtcgactcctcggcgatcatcagaaatcccttgtatctgcctgtcatcagtgaatttatatgtttgaagaattcgatggcttcgaggttctcgtttccaccgtttttgttcggtacccactgtcctgcttcttttccataatcgagataaagcatcgatgcgaccgcatctactctgagtccatctatatggtagttctcaacccagtttatagctgaaccgatcaggaaattcttcacctgcggcttgccatagtcgaaaatcttcgtgccccattcaggatgctcgccctttctcggatctgaatattcaaaaagcggctctccgtcaaaatctgcgagaccatgagcatcttttggaaaatgcgccggtacccagtcgaggataactccgatatttttggtgtggaaagcgtttacaaggtacatgaaatcctgaggtgtcccgtaccttgatgtcggagcatagtatccagtgacctgataaccccacgatccgtcataaggatactctgagatccccatcagctccacatgtgtgtagcccatgtctgctacataatctacaagccggtctgcgagctccctgtaagtataaaagccatcgtcatctgttcccggatgtctcatccatgaacccaggtgaacttcgtaaatcgaaagcggtttctcatagtaaggagtgtcatctgctctctctttgagccagctgctgtccgtccatttgaaaccatcagtcgtccaaagcctgctggcagttcccggcctgagctctgcatactctgcgaaaggatcagccttgtagaggttctgatcgttgcttccatggatcagatatttgtacatctggccttttttagctccagcaataaagcactcccagacaccgatttcttctggagagatctttgacatcggagcagcctgctcgtcccagccgttaaactctccaataacatggacttccttcgcatgaggtgcccaaacatcaaaccaaaagcccttctgtccgttaaccgttcccggatgtgctccaagttttctgaagatgtcgtaatgcgtcccttgcccgaataagtatgcatctaaatctgtaaagtgactcatttccccgcctccatctaaaattaaattatgctatgatgtccttttcctggagaagtggtctgccgtcttcatcagatattctcgcagaaaaatgactgaaaaatcccttgctcctttttttgtagcgagcgattccctcgtctaatatctcctttacatccttaatactaactggattatcgcctccctggagcatgccaatcctgtcataaagcgccaggatccccatgtcatccatagaatatccgcagtcaaggacataaatttttccaaaattgaccagttcatcctgtgtcatctcaggaatcgacaagtgctctgtgaaatatttccagagcttaggtacaccttcagcaagcttcttcagctcactctcactgtcttcaagtataaataatgtaccactccggtcattttcaatcataagtgccagcgagacagctgtgtcgtaattcatgccaccggccttctctatcatcaggcttccaccctttaccttctctatcagggcattcaggtcctttgaattgatcttctcacccgtgatctttccggcgccagcgcccagcttaccggtttccatctgtactatctgtacaagcttgctcgcaagagccgtctttccgcttccgtctgagcccgatatagtgaggtttcctgtttttatactgccatttgattcacacttgactttaacagcattgagggccttctgaatctgtacgctcatgccatgcacatctgtaaaatagctgaggactcccttctcttcgtcagtaaattcgacttttacccgatcctcatccaacgcttcactttctatctgtctggctaatgtacttatgtcgatattaaacgggcgtgtcttatcatctatcgggctgaaatgttcgggtctttttccagtgaatggttcgatttcttcctctggttcttctgactcctgctcttcctcagctgcttctgactcttcctcttcctcagctacttcagtctcttcttcttcctctgaagcttctggtctctcttccttagtctctgtctcttgctctgaagcctctatcggctcttcctccagagtttccgtttccggttcttcctctgtgtcctctgattccttttcctgagtttcttcgtcttcctctgaaatttctttaacttcctctggagtttccgattcttcatccgaaacttctggttctattgtttcttctggctctggcttttcttcagaagtctctgctccggcttcttctatatcctctatctcttctgaatctttctcaggctctgctgcaccttgattcggtgtatcatccgacatcgtgtcaatctcgtgctggagcatatcattgacacctgcaagtatctgtgctgcactctctacagtcttttcatcagcatttccaatgatcttcttgtcaggctcaactggttctggttctgattcttttaaatattcctctttcagaatctcttcaggggcaactcctgcctcgagctgagggcttatattcacgagacgatccataatctggtttgcctcgcggagtgctttctccttcgcctcttcaagtttcttcttcctggcgtcgttcagtgcagcttccatagcacgctgctgcctggcccagtcatccagaacatcatctatcgtgagctgtccttcgatctgctcgtcattctcgccggacggaagattaagtgccatctgcccatcgtactcttcagccagatactgatggtaggagtcctctatcggagtcttcgactcttcctgcactggctcttcagattcagccgtctcagtactctcactggtttcctggtctgtttcagagtcaggtttatcttctgtaacatatggaatatccccgacgagatctttgatggcgtccatattttcagaaacttcaccggcttctgtcgccttcattatctcctggatattcttgcggatctcagcctggagattcactgtgtcgaacttccccggcttatcctctacctgcggtatagttatagtatcggacagttccttctcttttttggacccgacactgcttgtcccctttgtaagccttctgtactgttcttcctgctcgggagtcagaggcttgtacatcatcttcatctcgagggatttttctacataagggccttctccaaaccacagtgccactttatcacagagtgccgtgcatttgtcatcgtccccatgctttctgtacaggcaggccagctcaaatgcccacttatctgtaaaatcctcatcacagagctgctctaaaatagcgataagttctgtaatatcggcattctgcgcttttcttatggtatattttataacgtatttcaggccgtcgtgcggtgcaatgtctgtgaattcatcataataagtctccgcctcgtcaatctctccaagttttacagagattagcgccagacggtagattatcatcctcgctataggagatttctcgtgagcaatctcgagtatctccctgcccttttcaggctctcctgcttcctcggcaatctcactggcgcggagtagaacattcacattcctgatcttgtggtagtttagagtatctatgacatctagcgcttccttaagatcaccctgacggaccagtgtttcagcctgatccatctttattttatattctgtcttctccaattaatgtacacctcgaaaaagccaatttcttcccttttgtaaaaatctcactcatattatagtaccatagcaatgcttgtttttcaaacattatcactttttcggtgcctgttttttccgcttgtccagcatctttccaacgattcccatatacttcttgcttttattctctttcttctgtacatactctccggtctgtgggtctacgtagtccagattctggtagacggctgatgatacgaccatttttctctttctgaggaaatgatcagaaatccgtttgatgatccaaagaatcagcgaaaccatcggcacaccgatgatcattccaggaattccgaagagccctcctcctacagttatcgcaaaaattacccagaacggggaaactccagtcgaatcgccaagaatctttggtccgatgaaattgccatcaatctgctgtaagacaataacatagatcaggaaatagattccctgcatcgggttggtcacaaagatcagcgcaaccgttgggacagctccgatatacgggccgaaaataggtattacgttcgtcactccgataatgaccgagcatacgactgcatacgggaagtgaagtatgagcattgaaaaatagcagataattccgataattatcgagtctatgatctttccaacgataaagccatagaacacctcatctgcttttctcaatgtctgcataacataatttgccggctttaccgggaaaattacataaatcagcttctttgaccagttcttgaatttttccttctcgataaggacgtatacgtttacaaaaatgccgatgattatattgacaataacttttccggcattcattccccactttgtaagagtagataatgtctggttctgactctgcagattcaaatattttcttacgatctcaacacctttgtcgatcgtattgtcgatatttttgttgtcacgcgcagagtccatgacatccttaaatctgtaatttgtaatcttgtctgcccagtctatgacgccgcgcactttttcatggatatggttgataagctcgttcattgtcgaaacgaactgcggtactactgtgactataaaaatcagcactgcagccagtatcacaagcgtagctattattgtagaaagtatgcggatccactcaactggttttccgtccggatgtttttttctcgttttatgggtgtgcttgtaatacaagtctacaagcttatttatgatatttgaaaagaatttcattaccgggttagtcaaataagccattatcaggccgataactatcggctgaaatactttcgtgactgttccccagcccctgctgataactccccaccttgcgataatgaaataaatgagaatgagggcaagtcctacgacaaatgccctctttgctattactttgtaacgtgccttttcctgatctgagagataatcttcggcgcgtttctttttttcaggtgtctgttcagacatatcgtcttcctttagtgcttggttttagttgaactcgagtgtgatcggacagtgatcactgccctcgacttttgtctctatcgtagaatcggtcacccttggtgcgaatctgtctgagatgataaaatagtcgatacgccagcctgcattgttttcgcgggcatgaaaacgatatgaccaccatgaatagatgccttccctgtccgggtatagcattcgaaatgaatccctgaacccgctacctaaaagttccgtcatcttctgtctctcttcatctgaaaagccggcatttttatgatttgaagcgggatttttaaggtcgatctcttcatgagcgacatttaagtcaccgcagtagactacaggtttatttttatcgagctccatcagatattttcgcatcgaatcttcccactgcatcctgtaatccagacgcagcaggccctgcttagaattcggcgtgtagcagcatacgaggtagtggtcatcgaattcacaggtgatgactctgccttcggaatctccctccggttctccaatcccatatgtcactttaagcggctcttttttagtgaagaccgctgttccggagtagcctttcttttcggcataattccaatactgatgataacccgcgaggtccttgtcgatatcgacctgtccatcctgcagcttcgtctcctgtatgcagaaggcatccgcaccggcttctttgaaataatcaaagaagcctttttttatgcaggccctgaggccatttacattccatgatacgtatttcatttcgattattttgcgttatgcactctatagtaattgatcaggcagccgtcctcgatgatctctctctcatcgtcagtcagttcgcccatattcaatgtgaatggaacaagtcctccatcctttacgacataggcctcgatctcggtctttttattcctgatatcactgaaaacatccggaataaatatgtaatctccgttcttgaacggaagatcgccagccgggatcgtaaatggaagcatgccccagttgatgaggttgcttctgtaacgcttcgtagcgtactcattggcgatatttgcccagcctccgagcaccttctggcagcttgccgcctgttctctggctgaaccgtcacctggctttactgcaaagatagtgcttccgacaccgatattactcctgttcacgtcagcaaactttgtgtgaatagctttcatgacatcgtgaatctctgggagtgcatctccaggacatgagtcggcttctatagctttctgagccttctgaacttcctttgccctgccgacatatgccgggtcttttcttgaaagagcaaattctgcaagtgccattgggttcgatctgtatgatgaagtctcgcctgacgggataagctcatcagtagtcgtaacaggatcatggatctctgaaacaaccttaaggatcatgttcttcggaagcgggctcatctcaggccagtccttgatgttcggtccaaacttgatctcagtatcaggatctgctatgccgtggctgtcaaatacacggttcttgtaaatatcaccgtcgaagaagtacttcggcttgctgaagtcgacatctatctcatcagctcctgtcaaaaatcccctgttcgctgctgtcgctgcgatagagcgggcatccatcagtgctactgatgcgatctgtccgttctggacctttgatccctctctgttcgggaagtttcttgtagaatggcggattgagaatccgttattggcaggtgtatctcctgcgccgaagcatggtccgcagaaacaggtctttacgatggctcctgttgccagcagatctgcaatgcagccattctttgcgagctgcatcatgataggtgtagatgcagggtaaacgctcagtgtaaagtcgtctgatccgatgctctttccgcggaggatatctgctgcatcgcagatattttcataaccgccgcctgcacagccagcgatgattccctgatctacatagaacttcccatcgtgtaccttgtccttcaaatggtaatcgacatcgtcgccgaatgataccttcgctctcttctctgtctcatcgaggatatccatcaggttttccttgagttcagcgatagtgtatgtattcgacggatggaacggcatagcgatcatcgggcggatctctgagagatcaatctctacgcagccgtcataatatgccacatcagccgggtgcagaggtttataggcatcttttctgccgtggatctcgtaaaattcctctgtcttctcgtcacactcccagatagatgagaggcaggtcgtctctgtcgtcatgacatcgactccgatacgatagtctacagagagatttctgattccagggcctacgaactccatgactttgtttttaacgtagccgtttttgaatacttttccaataatcgagagtgctatatcctgaggtccgactccctttatcggcttgcccttcaggtagatagctatgactcccggcatcttgatatcgtatgtctttccgagaagctgttttacgagctccggtccgccctcacccatagccatggttccgagacagccatatctcgtgtgagaatcagaacctaagatcatatctccagtacgtgtcagcatctcccgggcaaactgatggatgactgcctggtgtggcggcacgtagattccaccatatctcttggcgcaggaaagcccaaacatgtgatcgtcttcatttatagttccgccgactgcacagagactgttgtgacaattcgtaagcacatacggaatcgggaatttctcaagtcctgatgcacgggcagtctggataatgcctacatacgttatatcgtggctggtcagtttgtcgaacttgatctttaagtcctgcatatttccagaggtgttgtgtgcctttaaaataccataggccatcgtaccctctgatgcgctcttcctatcagcctttttgccaatagcagaaagttttgcagcagcttcactgtcatctggtatgatctgtgtaccatctgccagatacactccggtgtcgtataacttcattgtttcctccattcttttccaacttgaatattgttataaaatatatcactttttaaatacgccaaagagtcctcttttctttggctcggattcagtatcggaatcgccgttatttttccagtcaaagtactcacggtccagatcgtcgagatttatctgtttctcaatcttttccgaaaggtcgccggtatcatcgcttccaacgccatctgcaaccgtacccgcaggaatatctcctccctgaaaaaatgccggattcacatgtatctcaggcttaatatttgcataggatggttcgtcagcctcttccgtaaactcgcccgatttctgttctttctcgaggcgcttgttctcctcttcgataagtctcaggtactcctgcgtgtccttcaagtctgacagctgccctttcagttcatactgattggtctttatcttctttttttcttcctcgatctgctccatcatatcggagtggatcttgtctatcttctcagtagcctttgtaacaatatcgctgatcagatccagggcatggtccgagtacatcagtgatcccgcatagatgtcctcagcttttttgcgtgccctctcctccgtcagatcagcctgcttctgctggcttctctctgcctgctgcctgctcgatttcgacaattcgctttcgtcaagcatcgcataaaggcagtctccgagttccctcaaaagtgtctgggcctcgtccttgtcaattataatttttgagttgctcccgggttcgaactctgcgttagctatcagaatatgcattgccctgagagcatcttcagttctgtcctgtgcgctcatatcagcctctcgtcacttcttcagatggaaatggggtcagcactctgccgagaatcccattcaaatatgctatcgcgattccataattcgtgattggaatcccttgtgccgcggcagtatcaagcctgtgccttatctctctgaccggcagcatgcagccaccgcagtggataataagagaataaggtgtcaggtcatctggaaaatctccgccgctggtaaattcaaagtcaaaatcctttccagtcttctccctgatcaggtttggaagcttctgcgttccaatatctccacactgtctgtgatgtgtgcagccttcacagattaggatcttttctcctcctttaagattctccagcttcttcaccccgtttgtctgaagggtcaaatctcccttgtatctgctcatcagtatcgaaaaagatgtcagtggcacatcgtcaggaactatctcagctacatctttaaatgcctgggaatcagtgatcacaagctttggttttctcttcaggctcaaaagaagcctctcaagctctccagtctgcgcgattgctatcgtgcctttcgcgtcgagaacatcccgtatcacctgctgctgtggaagaatgattcttcccttcggtgcggcagcatcgatcggtatcacaagcaccaccagatcattcggctcaagaagatcttttaccagatgattctcatctttgtgctcattagctagctttgctatctctattcttaaaaaattggcactgacttttggattctcgacagtgcttatcagcattatcttctccggtttctcgccgagagcatccgctaaatcctgctttacctgatttttattagcatcgtgcagaagatcagatttatttgccacgataatatacggaattgtccttttttttagttcagccaggaattccttttcgtcggcaaattcgtagccatccgcctctgcgacgaggatggcgatatctgtcctcctgagcaccttcttcgtctgttcaactctcttctgtcccagttccccatagtcgtcaatgcccggagtgtcaataaaagtgacaggtccgattggcagaagttccatggatttagctacaggatcggtagtcgttccctttatgtcagatacgaccgccatgttctgtccagtcaaaagattcagtatagatgacttgccggcatttcttcttccaaaaataccgatctgcagtctttctccagtaggggtctcattaagtcccatttaacgcctcctgaaatttttacactgcgttttattttatcataaaaatgctgtagaaaaaagatgcttgttgacatagctgaaagaaaaatgtaaaatggacaaagccgagcagccgggggatcagcggtcccctgtaccggaatatccgctatatgccggggtgttttctgttcgagggcttttctgaaatgatagctgccctgagtaagtgacgttgatacccgggtcccgagcaatgggtgcccgtgaaccgtgtcaggtcaggaatgaagcagcactaagcgggatttctcatgtgcctcggggtcacctgggttgagttaactgcacaggttacgtatcatgacaggagttcgacagcagaagcccggcctttttttaatcatctctttcgtaaatatactcgtcgagctttttcccattcagtttcgcatagctttttaaaaatgctattctcttaaaccccagtccggaaagcagattttgagatggaatatttgttgtaagtacctcagccttgatgtgtctgacaccgtattcccgctcgatcagcggtatcagagtagaaattgtctcccttgcataccctctcctcctgtattcaatgtcgaccttgtatccgattattgtagaagcatttccgtttttatccagctctctgaagctcacggtaccaacagtcttgaacggatcgtacttctcaaacatgtagtatctgattctcttcccttcaatgcgaaaattgtcctcaagttccagaacttttcgctggtatctcgttgaaagagacattcgcctggtaagcggttcatattttgcaaaatcgtcaaaatttctactgtaaaaagcagagactataacagcctctgctggtcttaaagttctaagtatcaggtgttctgtctctatcatgttctgcatcaatccatctttatcggaggtttcccgacatcctcttctgccattctcttttcttcgcgcagctctctgaaaaatcccgtgatcattgccgcacagtcgtcatgaagtacatcataagtaatatcgcactggtggttgaaccccggctgttttaaaagattcatgactgatccggcgcaaccagcctttgcattctgggtgccaatgacaactcttggaattctcgcctgtactatggctccggcacacatcgggcatggctcaagtgtcacatacagagtgcagtcttcgagcctccagtcgcctgtctttttgcaggcttcctttatcgcaataagttccgcatgtgaaaggacacttctgtcattattgcggcggttataaccggtcgctattatcctgccgtttcttacgataacacagcctataggcacttccctgatagctgctgcgcggtgggcctgttcaatggcggcacgcatgaatctctcgtcagcctttttctgtctggcggtgtctttctcggccctctttatcgcagcctgcctctcgcgaagagcctgtttttcattcttggtctgctttttgccggcagccttttcttctttggctctttccagctcatcctcgcggatctgcgccttttctctcattttatcaaaaatactcatagagtctcctttttttattccgttttcccgcactgaaatatattgcgtttatcttcaataagctggcatttttcccggtgggaaagctgttttatcagcgcttcccgcgacatagcatcgtgtcgggcagcatattcttcgtagtaaactaattctaccggtctcctcgacctggtatactttgctcctttttttccgttgttgtgttctttgaccctgcgttctaagttagtagtataacctgtgtacaggctgttatcggagcattttacaatgtaggtgtaatacatcagctgtcatcttccatctcagtcaccagaacgccttctgtatcgtcgtaattccccgaactgtatatcggaagatgtccgaccataatactgtttcggcttttggtcttcactttatacaaaaggccgtccgcctggtgcaaaaactgccagatgctcctgccctcttccgggattccccagaaaataccctgtgaaatagtgataaacttcgaattggtacgcgaatattcgtgtacaacgtgtccatcgtttatgatcttcttaagatcctttgccagtgaaaacacttccttctcagtgtacccctcatagatcaggacaaactcgtcgcctccatatctggctgcgaaaatattgagattatcctgcagctttttaatgcagtccgctatatattttatgactcggtccccagcctggtgaccatagtggtcgttgtattccttgaaaaaatcgacgtcgagcatctcgaccgcgattcccacatggtttttaagtccacgctggtaaatgacatcgccctcgctgttcagcctgaaacggttgtacatgctggtcagcgggtccgtctcgctctttctttccagagatctggacttggctgcgatatagctgttctcctcggccagcctgtaaaggttctccctgagctttatcatgctctttatcataagatcgttctcatgggacatcatccgttcattttcatagtaatgaactgcagcctctttgtaactgtccttatcacccacacttttgaaaaattcgatcatcagatgaagcagtttctgctcaatatttttgactgaagttttttgagccatagcctttatcggaaccagaagactcgcaaatgtcgtatagtctccggtttccagaagaagtgacaggaaatcgtacaaatcatcgaaaaaatcgagtattgctatgtctgacgaaaaggcctctacgaccttttttactgcgcgctccttttcatcaggttctttttttatgtagtaatatcttgcgagaaaacagtatacgtttatctcctcgtctttagaaagaaatggtgtacattgaacttcaattatggactcatatttgtcagcatcagccatatctttattcatcagatagcttcgcccgagcccgactgcggctgccgtaaaagactcaataaactccgggatatcgtctttgtgatctatgatatacttgtaggctgcttcgtagtgttctatcgcttctccggcacttccgaccgacagaaaaagagcacccatattcatctgaagtacccattctatatctggaagactgtactgcttgcagatagactgtgccctgtaatagtaatcgagtgcaaacggtgcattccctcggtttaatgacataatgcccagcatattgtcagccatcgccagatagccccattcgcctatcctctcaaatggttccatgcacttaagcatctcgcggtagaatcccagcacatcatttttgcggtagtagtattctcctctgacaaagcaggcatatcctgtcagtgcgtcatcgtcctgcatttggccatatttctcaagcttatcgcaaagagcgatggtgtttttactataagtctctttttcccgatttatctgtcttatcaggttggctatttctgtcctgtatgacgatatatccaattattttaccttcagcacttttgtaagcttaatatagtcatcgagcgtcagcacttcggcacgccatgtcgtagtaatgcatgaattccacatggcatcctccatctcctttttcgacatgtccgaaatacccgcattgtagattgcatttaccagtgtcttgcgccgctgattaaaagcggctctgattgtcctgaaaagaggcccctgaatctgcttctgttcctctgtcagttcctttcggtgcagagtaatgacagccgattcgaccttcggcctcgggacaaagctctccggttttactgtaaaaagtatctccggatccgtatagaactgaaccgcaagtgtcagcgccccgtactccgaagtacccggtttagcctgcatcctctcagcgacttcacgctgaaccataaccgttatcgagtcgaaatcgatatctctctgcaggattccaaggattatcggagtagtaatataatatggaagatttgccacgaacttgaccggccctgttatattttcatccttgaaaagtttttcgaaatccacatcgagcacatcatcgttaatgattgtgacattgtcatattctgaaagcgtgtcgtgaagtatcgggacaagcctgtcatcgagctcaatgcagatgactctgcctgctgcctccgccagatactgcgtcagcgagccgactcccggaccgatctctatgactgtgtcatactcagtcacctctgcgccttcgacgatatctcttaaaatgtccgaatcgatcaaaaaattctgcccatattttttcttaaagtgaaaatcgtacttgttcaggacttcaattgttttactgtaactgtccagttgcggcatttatccccctgataatcatcatgatattgagaaaaaatcgtatccattttttcttgtcgtctccataaccctgtactcggtcagctcttttaagcctgcaatatatttaataatatacggcagatatcccgagtcatttctcattccacggaacggctccggcgccatgtaagggcagtctgtctcgactaaaatcctctcgagtggaatctgcctgacgacctcttttatcttcttcgcatttttgaaggtgactacaccaccgactccaatgcagcatcccatatcaatatagtccatcgccatctcaggtgaatacgaatagctgtggataactgccctgacgcctttggcacaagcctctttcattattgaaaaagtgtccgctgcagcctccctggagtgaattatcacaggaaggtccagcttaagagccagctcaagctgtgccttgaaaaaatactgctgccaggccctggcttttctgtcttttacccaatagtagtcgagaccgatctcaccaatagctttgcatctgccatcctgcgccaattcagtcagttcttttatagtcggattttcctgccattcaaagtcttccggcggcatttcatccgggcagaaattctcgcatggccggccatttacctcatcagataccatcctacccggtatgccgaaatccctgatctcttcaggatgaattccgacggctgcatagatgtaatcgtgcgacttcgaaagctcaagggcctgcctgctgctttccagagtcgagccgacgtcgactatcgtctcgatcagcccactgtggattttgttcaggagttcctctctgtcaccgtcaaatgctttatcttcgtaatgtgcgtgtgactcaaatatcatgagatctcagctccagaaggcatctccttctcaggagtcataagcgcgagattgccgtcagcatcctctgcgcagagcagcatgccctgagactcaatgcctgcaagcttccttggagcaaggttggtaaggaccattaccttctttccaaccatttcatctgcagaatagtatttttttattccagaaacaatctgaagcacatcgcttccgacctgaaccttggagcagaggagtttctttgacttcggtacttcctcacattccaggatctttccaatgcggaactgaagcctggcgaaatcgtcatagctgatctcaggtttctgctcgacgtctatcggattttcatccttttcgtcgtcagatgaaacagctccggtcttcttatcaccctgcatatttgcaacagtgagctttccagccttcttcagattctcaaaagctatcttctgatgctctttaaattcagttttctgtttctctgtgatctcgtcggtctgttttaaaacctcatttacatcttttctggcaaaaagcatctccggcttctcaatgaccttcgttcctgaagggtatagtcccgtcttgtcgagatcgtcgaaatcacggagagtggtattgaactgcttcgcaatattctcagctgtatcaggcataaacggatagagcagtgatgcccctgtaatgatcccgtctgccaggttgtagagaacagtagcgagtctgtctttctttgcctcatccttagctaatacccaaggctcagtctcatcgatatatttgttcagacgcttaaaaatcctgaagatttctgtaagtgcatctgcagcgtggagcgtatccatttttttgatacagatatcgcggactgcggtaacaaccgacttcaaatcgtcgtcaaccggttctgcggcacccttgtcacaaacgatgccgtcaaaatacttgtttgacatcgaaagtgtacgctgtacaagatttccgagcgtatttgcaagatctgaattgtatctctcgaccatcagctcccaggtgatgacaccgtcattctcgtacggcatctcgtgtatacagaaataacggactgcatctacaccaaacaggtcgatcatatcgtccgcatagataacatttcccttgctcttcgacatcttctcgccaccctgcataagccacgggtgtccaaaaacctgctttggaagcggctcgccgagcgccatcaggaaaataggccagtagatcgtatggaatctgacgatatcctttccgatcagatgaaggtctgccggccagtatttcttatataacggtccactctcaccatccggatcgtaacctagtccggtgatatagtttgaaagagcatccagccatacatagacaacatgctttgagtcaaaatctacaggaattccccatttaaatgagcttctcgatacacagagatcctgaagtcccggaagcaggaagttgttcatcatctcgttttttcttgaaacaggctgaatgaactcaggatgtgtatttatatagtcgataagtttcggagcatatttgctcatcttgaagaaatatgcctcttctgacatctgatgaacttcgctgccgcagaccgggcatctgccatcctcagtaagctgcgactttgtataaaaggcctcacactcagtacagtacatgccgtcataagagcccttgtaaatatcaccctgatcgtagagtttcttgaagatcttctggacacattttacatgatcgtcatcagtagtcctgataaaacggtcataggaagtattgcacatatcccagagacgcttgatctctgccgctgtcttgtcgacgaactccttcggtgtgcagccgtcttctatagcacgggtctctatcttctggccatgctcatctgaaccggtctgaaaataaacatcgtaaccttctttccttttgaatctggcgatcgcatcggcgaggattatctcatatgtattgccaatgtgtggtttcccagatgtgtatgcaatcgccgttgtaatatagtatggtcccttgttcttcaatttaaaaaactccttatttataaattttccggatattctgattatttttccgtagaatcagctgaatcttccggtttatctgatgtcttcacatcgtcttcggctttatcgtcatctgacgcctcatcagccttatcgtcctgagcttcgtcatcctcaaaaacgtcatcataatctgccgtctctgcatcagtagtatccgattcttcgaaaatattcatgtcctcaccacagttcgggcagaacttcgcattcttcggtacgtactctccgcaattcgggcagactacttcgccccgaatatcagccagttcatccttcgtatcagaaatctcagtgtaaatctcactgatacgcctgttttctgctgtattttcattcttatgcttctcgtaatacttcttacccaggttttcaaattcctgcgtcagtttatcgtcgagacttctgagtctgacattcagttttgcggttcttgctgcatcctttgcagctgctccaaatccttttccggcttcgtttaaagaatcaaaaaatcccatatcagtaggcctcctttttaaaaatttcgtcactttgtctactattatacaacattttatcgttctatttccacaagaaatattttctattgattttcagtttgcaatttcaaaaatccccggttctcttcgagtatctcgaatatatttttattattctactatattctcaaatattccgctatttttttcttattttagtatgcttagttcatattttttaatctcgtcaaattttcaggagcgaactgctatgttaaaagacaatcctctgcacatcttttctgaaagactgtcctctctgttagaggaaaataatattaaaaaagccgatttcgcgaacgaaatcggtatttctccaaccactttaagtggctatctgtctggaaaacactgcccggattttgaaacacttatgaccatctgcaaaaagctcggtactcaccctgattatcttctcggaatgagtaccaacaagcttcaggatccatctactttctccagtcaggagaacgaactgctcaaatactacaaacagctgagtgaaaatcagcagtatttcgcccttggcgaagtaaagatgctttttaaaaagggaaaataatttttatatattttacaatatttctattttcttatgcagatatagaccagatatgagacatacatcgcgatcatcgcaaaaccagccggctttttgatagctttgctcttaaagcagaagagccagacgacaaaagagaatacgatgagtacgaccgcgtcaatgatattttcaatgctgatcgcaaccggtgtgataactgctgcaacacccagaattgccagaagattaaaaatattggatccgactgcatttccgactgccatatcgagctcgttctttttcgcagcaacaatagaagtcgcgagctccggaagcgaagttccacaggccacgatcgtaagtccgatcagtgtctctgaaactcccatggcacgggctattttttcagaagaatcgacgactaagtcaccaccgaactttatcgctataattcctccgacaatgtagataatcgtcagccaaagtggcataatccgaaaatcctggtcgagctcctcgtcctctgccttttccgcagctgtctttcttgaagtcatcgtcctgtggatcattgaccagataaaaaatgcgaaaaaagcgaggaatactattccccagatcctgttcacttttcctgtagtaagtccgatcagcacgataagtaacgccgcaaatatcgagaacggaaggtctttttttatgacagatttcgataccgaaagtgttgaaaaaacagccgatgcaccgagcactaccatcaggttaaaaatatttgaaccgattacattgctgactgcaagctgattgtgtcccgcaatagaagaagtgaccgacaccgaaagctccgggagcgaagtacccatggctacgatcgtcattccgattacaagtcccggaatgtgaaactctctggccagtgacgaacttccgtctacgaaaaaatccgccccctttatcaggagcacaaacccgactacaagcaaaataatcgtaataaacatctgcataaattttccctcctattcaagtcccatcagatgagttatcagaatccttgttccaattgctataagtaccagaccgccaataagttgtgccttcttttcaaattttgaaccgaaaatatttcccagataaactccgccgtacgatattgcaaaagtgataactccgatcagcgaagatgctcccaaaatattgaaatccttgataaatgagaaggtgataccaacagccagtgcatctatactcgtggccacagccatcatcagaagttcttttacatcgagaggcgggtcaagtttcgcgacattttccgtctcattccactccttaatggcatcgattaccatttttccaccgatatacaatagaagaaaaaacgctatccaatggtctatactcttgataaatctcgcaaaggtacttcccagaagccacccgatgacaggcatcaggaactgaaatccaccgaaagcgaaggatattgcaaaacactgtttcctgttgacctttctcattgcgaggcccttggcgaccgcgactgccagcgcatccatagacagacttatacccagcaggattatttccactatactcattaactgcctccaactacgttcacaaaatggccacaaaatatcaacatgacagatacttgatttctgtggcattccacagagttatccactttatccacaatctgaatgtgaacagaacaaaaatttttttgttgatataatctcgtctgaatagttatccacaatcattttccactgtcagaaaaagtattaaaaaaataagactcctgcacaaagcctgtaaaatcaacacttacagcctttatgcacgagtctcattctttaatatctgccaggtaaaacaccacttatcaacacaagctgtggataaactgtgctattccgagattgttgacagatcacattcaggtgcggatgcgaattactccctcacacatttttttcacttttcgaatgtagtataaaaactttttcactccatgtcaatatctgcatatgtactttgcacggtgcaagctatataaattctctgaagttgcagccttatctctaccaacagtcaccgtcaatgtaaggtcttttaagatttgtttttctatgatataataatcgaatgtttgcagaactttttatgataattaatggatatttatgtgcatcaacactaaattaatctctttttttatttttattagtcttaatttggaggtattatgactttatatgatgagcttgttgcccgcggccttatagcgcaggtgactgatgaaccacagataaaagatcttataaataacggtaaagccactttttatataggtttcgatccgaccgcagattcacttcacgtaggccatttcatggctatgattcttatgaagagacttcagcagggcggaaacaagcctatcgcactgatgggcggtggcacagccatgatcggtgatccgtcaggccgtaccgatatgagaaaaatgatgacggtcgagaccatcgaccacaacgtcgagtgctttaagaagcagatgagccgcttcatcgaattcggcgagggaaaggccagaattgtaaacaacgctgactggctcaggaacctgaatttcctcgactttatgcgtgatatcggatcatacttctcagttaatgatatgctgcgcgccagagcctatgtaaacagaatggagagaggcctttcatttcttgaattctcatacatgctgatgcagagctacgatttccttcgtctgtacgaggattacggctgcaacatggagttcggaggcgacgatcagtggtcaaacatgcttggtggcactgagcttatcagaaagaagctcggcaaagacgcttacgctatgacgattgccctcctgttaaagcacgacggaactaagatgggaaagactgccggtggtgctgtctggcttgatccggataagacaagtccatacgatttttaccagtactggagaaatgtcgatgaccaggatgtctgcggtttccttagaaaaatgactttccttcctctcgagcagatcgacgagatggacaagtggcagggcgagcagctcaacgaggcaaaaaagattttggctcacgagcttacttccatggttcacggcgaggacgaggccaggaaggctgaatcagctgcaatctctgtatttacaacaggttcctctgagaatatgcctgaggcagaaatcactgacgccgatttccgtgacggaagcatcgatatagtcggcgttcttgtcgctgcaaagcttgccggctccagaaacgaggcccgcagggcagtagagcagggcggtgtaactgtaaacggtgacaaaataaccgatatccacactacctacagcagcgatgatttttcaaaggattttgtactccgcaagggaaagaagaagttctgcaaggttgttcttgataaataattatgacttctgacgaatattttgatgctgtaaaagctctattaaagcaatacgatgtgaaacgtgcagtcctcttcggctccagagccaaggggactgcaacgccacacagcgattttgatatcgctgtcagtggagtagaggacatcgacggattaagagatgccatttatgacatcccttctcttttttctacagacattgtggacctagacaggccactcagccaaaacctcagggaggatatcgagcagtatggcatacagatttgaaaaacgtttcaacagttttaaaaaatccttagaatctctgaaaaccgctcgtgaccgcgactggacagatgattttgtactaagcggtactggcgcgaaattctgtatcacctttgaactcgcatggaaaaccatcaaggatgtactgattgagtactatgggattgatgatttcgttaccggctcaccaaaggataccttgagacgcgctttcaaaactgatcttatagatgatgacagttggcttaagatggcaactcttcgaaatgaaatcgcacacgactatgacctggaccttgtcgaagaatctatgcaagcgattacaggtgaatacgtttcattctttgaaaagcttgttgaaaaaataaacgccatctgtgagaaataatcttaaatcagatttacgttgaatgcttttcatttatgaaaaataaccactataatcgaaaggattttcatgcctgagatttctattataactcctgtctacaatgcaggcccatatcttaaaaatactataacctctgtgttctcacagaggttttcttcttatgagtggctgatctgtgacgatggctcgactgacgattccgctgagattctttcagcagccgcagtctcaaatccgaatatccatgtattcacacaggaaaatcacggtgtctcagccgcgagaaacacctgccttcgccacataaacggcagatacctgatgtatctcgacgcagatgataccttagaaaccgactgcttatccaaactccatgaaaaaatgtccgtttcccgtgctgatctgtgtatctatggatggaacatccttcaaggtgaaaagcttttttcatatgtgttcgaggataaagaactcaatgcatcgcccgaggagcgatacgagatgattcttaaggatccgtatctctgcggcgggggctatccgtggaacaaaatctggcgtgttgactcattaggaaaaatcccgttttttgacgaaaatctccatcactatgaggacaagctctggacattacagtgccttgatctgttggcttctccgacagtcacatatctaaccgagcctctctatgactattatctgcgttatgaatccttgtcacaccctatgaccggttcccaatatttcaaacacgcagagtacaccctatattcgcatgaggcacttctctcatacataaaaaaagctcatccccaggcattaaaaacctgtgttgagcttgttcagaacgaacttactgaaatcaaagacatgctgggacagtagggacggttctttttgtcccaaaatctgaaaattctgattttaagttcaaatatcccagttcttttacatcagtacaagtagtatccccatgctgataccttctgtaatcaatggcaccatcgccataaaaaatgccagccattcttccattctatagtagattatatacataatcatactgattatgaaagccgttatgagaataccgatcataacccagaatctcttatctgagagcataccggcactattcaatttgtttataacacataattcaagcaccatccagccagtgatcagcaggagttcagtggttaccggccttttcagccagactgaagtaatcaggatcaatccgatgtaagtaataatcccaaaaaccaaaatccaaatgccgtgtaatttttcctgatgcaacgccttaagcgacggatcatttataccgataatcgagagcacgattcccgccagaccacacaacgcagttattccgagcagaattccgcgaaatgaaccaacacggttaacttcctgccccggctggtaggaaatgctccaccagataagataaaatgcgcagcaaatgaccagtgaaagctggcctgaaaagattttactgctcatctgaaagacgcttaaccatcgcttcaattccatccacagaatcgaagttttccttcgtcatctcctcaggtccgatggtgatatcgaactcgtcttcaagttcaccaaccagattaataattccaaaagaatccagaatgtggtcgccgatcagactcttttcattggcaaagtctacactgtcatcataatcatttaaaatttcaagtattttctctttcatttcttcgtcctttccagatccgggccctattgccggaatttttcttttctattctaagattaaaatcagtttcatacaagcccgaacgtaatttttattttcgtactgtatttaacatgaatgtttcctgcatttcacgtgcgagcctcagaccttcttttctgctgtaaagggctacagctggaagctcatgacttaaaaagagctgcattccctcatataatgaatatgcgccagcgcgcttgaatacaattgtatcgcctgtattaagtttctggctttttaagtctgcaaccataatatcgtttgccgtgcaaagggatccgcagatggtatagtggaactctccctcggaatcaatggaataaatatttccatccctgataagttcaagatatggtgtgtacatacctcttagctgaccgtcgtaatttatctggtgaataccaccgtcggcaatcgcataagtcctgccgcgatttgtcttgatgtcacgaatcgtcgtcagataatatccgcagtcgaatgccagggctctgcccatttcaattgaaatttccccggaatagcgcatgttttcgagaagagaggagaagtctctcaaatattcctctgacgttgcatcttccttctgatcaataaaatatggaacaccaaatccgcttccatactccagatgggaaactttctggcctgttttttcttccaggtcagagataaaatcatccagctttttaatttccctttcgtggattcgaagcttgtgcttctgggtcccggagaaatagtgaattccatagaatctcaaatgaccatacgcattaatgttatttagtgcatcaataatcacctcttcatccattccgaattgattcccggaagtcagacgaagatagacattcaggcagatatcgtattttctggcagtcctttccaattcttccaactgcgatatagattctgccgtatagatggctttttctctgcaatggtcaacgatttcttcaacgtcttcttccttcttcaaaacacctgaaataagcaatttctccgctggaataccaagtgcctttgtgataaggaattccccaaatgagcagacctcgattctatcggtaaattccagactcgcctcgatcagaaaaggattcgccttcatgcaatagttgatattgactttctctggaaatatttctttaaaaaatgccacgcgccttaataacgcatccgaatcaaagacatagcacgggctcttataccgacaaaaagcttctgttaaaaaattaccgctcattccgtcacctcaatttgctgtgtttatttttcctcgattacctcttcaagacttgatagtgcctttcgatcaatctttccatttttattcaagacaaattccctgatatggaaaaatttgtttggaaccatatagagtggcaggttttctttttccttacggtgtaaggtctttttatcgattttgcctttgtagtaaagataaattctatttttctttgaatcaaaggcgcagacacttctctcgactccttcgacggaatctgtgtttctctcgatttcttcaagctcaatgcggtgtcccatatgcttaatctgaaaatcctttctgccggcaaagtacatctccccgtcatcgccgtaaagagccagatctccggtcttatacattctttttttgtccggaccaaactcgacgaaatgtttcttagtctcctccgggttattgtaatagcccactgccagagattcgcccatgacacagatctcacccggacagcctttttcatggataacattcccttctggatccagaagaaacacctttctcccgggaaacgccttcccaagaggcagcttctccttgtccgagaagcggcgtgtaatctcataatatgtgcaattgcaggttatctcagaaggaccgtaaagatttacatatctcgcatctcttacattatccatccagatattcagctgctttaccggcatgacttcacctgaaaacatcacccgtctaagctcatttggaacccgataggaaaagcagttgagaccggaaataatgcaaagcgctgaaacagcccatgtcaggcttgtgacatgattgtcacagagatagtccataagcgtcttaggtgtagaaaaatattctcttggaatcagaagcagagcagcgccagtctgaaatgctgtgaaaatatctttgattgagacgtcaaaatcgaatggtgcctgtgatgcgatcacatcatctgacttaaaatcaaatatttttacaaaatgtcctataaagtcgatcacagatccatgatttacctgtatgcacttaggacttcccgtggatcccgaagtaaagattccgtacagagggctctccctgtcaagctttgaacggatttctgtcaatgcctcttcatcggccatctgagctgaatcttctttgctgtcagagaccataagatccaggtcatacttcacgcctttaaaaccagcatcatccagcttttcctgatatttggattcgcagatcaagatttcaggtcgtaaaatgtcgagaatcttttcaattcttcctgccggctgttcaggattgattacaacataaaatccgcccgcataaataattccggtgatcacagccaggagatcagaactcttatccgcaagtatggcagctggaaatccaaccttaccattagtggcagaggcaatccgccttccggcttttttagatttttcgatcagttctccccaggtatatgtcttctctggatctttcacagcaatcttatccttatagatagtcgctgtctcttcgagaaaatccagtactgttttgctgtttgccatcttttctctctttttcactaaaaaatactacgtttgagctaatctttttcaggttcttcttgacctacttgaatgcttaatattcgcgatcaatggaaatttgtttacaagatactcacccaaaaaacgcgtggcttttctggcgccatagacgttcaaatggtcaccctggtctctggtatcagatttccaatccatcttcatatccctgtcatataagttcatgtcgatgtatgggattttttcacgctttgccaattttgtcaaattcttatgttttctatagtcgtagtttttcggtgaaggagcagagtacattatgaatctggcaccttttgactcggaaagagccttcatttttcttaaatactcaacattcagctggccgattttcttatttttatagggaatatcatcctttcccatataatttccgcctaaatagggctttaccctcttgtcaattgtaaagcctctgtagacctgtttatgcttttgaataaaaggcgatttccaggaactgtgatatttgagcagtggaaaaatatcataaagtgtatcggtgatgacagcacttgcgctcttaggatccggctgcttcctataaaggctgttcgtctcatagagaaccactactggtctttgtcttttcagactgttttcaaggatctcataagactggcttacggtcgctgctgcctgtccagcgtcatatgcccggattccatacttattttttaaaaacctcgtatcaattgaagtgtagctttcactgtctccaataacgagaagatcaatggaattatccggttctgagagaaccttaggaatagttccatttctccaattcgaaagttcgagatctgtcatcagcttcggcgtcataattcttccaggaatatagaacagcagaaatagtatcagtagaaatactgctgcctgtttaattttattttttgaattatccatattcacacccgtttaaaatccggcatagatcagatctgccggtgtatatccgactccataggcaccaaagatcactatggaaaatatcaccaaatagtagagtccccatcgtttgactcttgaaagctcatgtattctgtttaaatacattggatccttttctaatttataatccacgatgaaaacaattatactaccagcaatagcgactataacgtctcctatgtccaatcccagaacttttgtattaagagtataatttatgctgtttccagggaaaataaagagtgatgccatcatgtggagaaactgtccaaaggtattcgccctgaaaagcatctctccaaaaatgatgatgatccaggttctcaccattcttatgattcccaggggcttaccatcctccgacaggtgaagtcccctgtgtattctctcacctgcaggttttagtaccacctcaagcagaagtataatgaaataataaattccgtaaataatatatggccattttggcccgtgccagagaccatttaaaatccagaccggaagcagtgcaattgctgatgtcacaacatttgtcaaatattttccacagtgttttctcccgaatcgtccccattttttcatgagtcctgatgtagatactggatagaaaatatagttcttaaaccatgttcccagggtaatatgccatctcctccagaattcggccgcgctcttcgcaaaaaacggctgtctgaaattctccgggagtgtgatgccaaatatcttcgccgatcctatgacaatatctatcgttccggcaaactccatataaagctgaactgtagtgacaaccgctgtcaaaagtatcatcacaccgtctaattgcagattcggtgcatagaggcggttcacaactacattaagtctgtcggagatgatcatccgcttgaagagtcctattacaattcggatggagccatcagatattgtatccaatgtgatcggatttccttcgaatagtgaatctttgacatctccccatctggctatcggtccctccatcagcgtcgggaagaacatcagaaacagcagtactttcagaggatttttctccgctttctcccttttccaatagatatccagaagatagcttatcgcctgcaaagtatagaatgagattccaattggaactacgaggcttttcagcctttgtgaaataatcagcgaattcgtcccaacagctttcataatctctgtcactatgaaattcgtatatttaagtcctataagaatcgcaagcagggaaatcaccggaataagcatcgctgccttagcccgcttttttaccttctttttttcatcgcccttcaaacctttttcctgtgagacgattttatcaataaatattccgcccagccaggcgattcccccggccagtaacgtccaactgataaataccctgctaaacgaatatgcgaagatcaggcttcccaaaagcaatgtcacatatctgtatctcttcggtgtaatcgaatacacgactgccaccagaatcaaaaatataaagtatacatttgtattgtaggccattctctatttccttatttctcaattcaacatcatagttctacggcttccccacatcattcaaaatttattaacccataacaatttattatataaaatttttcaagaatttgcagtattttttttcagacattttctttgttataaataaaaatgagccactgactctacatcaggcaaaataacatttaaaaaaatattgatattttactaaaagatagaatcgatggctcacatcagaaaatatctgttatttattttttttgatatacagccgctgtgggaacttctttttcacaaaatagttcatcaaaagcgccataactattccgatcatcgttccgaccattacatctgttgggaaatgaacgaacaggtacagtctcgaaagtgcgatcagtgacgcaaggacaattgcagctgttccccattttttgttgtagcagaatatgctcacggccactgaaaatcctgcagctgagtgtccggaagggaaggagtagtcctttggaatctttactatcatctttactgtcggatcaatccatatcggcctgctgcgccgtaccgtattttttaggatcagcaccagaatcgcttccgcagccagcgcgagcatacatgtcagaccgactctcttatctttcacaaatatgattatcgcaatcgtaagcaagatccagaagattccgccactgcctaacatcgtgataaatttttcgatcgggtccagcacagggtggtgcaggctctgaaaccaatagagtatattaaattcccattgcatagcatttacctcacataagattatagtattctactatgacaatgggaatttttcaagaaaaacttaacattgatcttactttatatttacaataaaaaatctttaaagaatttacgctgaatgcactgcatctgccatttctttgacaaattctctgaccttcggtacgcagtcattgccatactttgtgatgattttaatgatagcggatccaacgatagctccgtccgacttctttgccatgtcggcagcggtctgtgggtttgaaattccgaatccgacggcacatgggatgtcttttgcttcctttacgagttttaccatcgctccaatatccgtcgtaatctttgatcgggtaccagtcactccaagagaagatacacagtagacaaagccatctgcgtcttttgcgatcgtacgtattctgtcatgagaggtcggtgcgataagggaaatcaggtcgatcccgtattttctcgtataagtagagaattcctctttttcctcgaatggaacatctggaaggataagtccctgcattccgatttccttagaaatttttacaaatttttctgtgccgtagtggaagaccacattggcatacgtcataaaaaccatcggaatgtcgcagttctttcggattctttttaccatctcaaaaatcttatcggttgtgacgccgccttcgagtgcctttgtgtttgcttcctgaattaccgggccttcagccgttgggtctgaaaatggaattcccagctcgataaggtccgcgcctgcatccgccattgcgtataccagctgctctgttatgtctagtgaaggatagccacttgtgataaaaggtatgaaggcctttccatttttatttttaaatgcgtctgttacacctgccatataatgcctcctgcctcaatcgtataacttctcgccacggtatctggcgattgctgccacatctttgtcgccacgacctgacagtgttacgactatgatcttgtctttactcatcttcggtgcgatcttcattgcgtatgccactgcgtgtgcgctctctattgccgggataactccttctaccttagacagatactcaaaggcatcgactgcttcgtcatcggttatcgcaacataatcggctcttcctatatcgtgaagatatgcgtgttccggaccgatgcccggatagtcaagtcccgcggaaatcgagtaaaccggtgcaatctggccatatttatcctggcagaagtacgacttcattccatgaaaaattccgagagaccctgtatttatagtggccgcagtcttttcagtatcaatcccccggcctgctgcctcacatccgataagcttgacatttttatcatctataaaatgataaaatgacccgatagcattcgatcctcctccgacgcacgctattacagcatctggaagcctgccttctttttccattatctgctgttttatttcccgggatattactgcctgaaaatcccttactatagttggaaacgggtgaggtcccatacagcttccgataacatagtgtgtatcggaaattctgttagtccattctctcattgcttcagacaccgcatccttcaaggttcctgtgccactctcaacctgatggacctttgctccgagaagcttcatacgataaacattcagcgcctgtcgttccgtatcaacctttcccataaaaatttcgcactcgagcccaagataagcggcaactgttgcagtcgcgacaccgtgctgtccagcgcctgtctctgctatgacacgagtctttcccattttttttgcaagaaggcactggcccagggcattattaatcttgtgcgcgcccgtgtggttcagatcctcacgcttcaggtagatctttgcaccaccgagatcttcagtcatatttttcgcataatatagaagagaagggcggtttgcataatcgttgtacaggtctgtaagctccctgttgaattcaggatcatctttgtagtgcctgtacgcctcgtcaagttctataacagcattcatcagcgtctccggtatatactgtccgccgtgaattccgaatcttccttttgacatatgttattcctttccatcttgaaaatttcttgtgatttctattacctgcctgatctttttttcatccttaaagccatttgtctcgactccacttgaaatatcaactgcccaggggtggacagactcaagtgcatcgtctaaattttcgaccgaaaggcctccagccaagaaccagggcttatcaggcttttttttgataagtgaccagtcgaatgtctttccaccgcctttcccctgatcgagaagaagataatcggcaggagagcagcaggctttttcaatgtcagcttccgatcttatctcaaaggctttgatgacagtctttctggtctctgtctgtacctgtctgatgtaatcgttcgattcacttccgtggagctgtgctatatcgattgtcccatcttttaaaagcgaaatgacattttctattggttgatttacaaatactccaacttttttgatatcagaagacacctttgcgctgagatttttagcctcttctcttgtgacactacggtggctttttggaaaatctattataaatcctgcaaaatccggtttgtatcggtttacaatatctatatctttatcccgcttcagtccacatatttttatatgtgtcatcttaattcgcctttcatttcttcaagcttctttttcttatcagctgcgcgcatcagtgtctctccaataagtaccgcgtctgccccgatctttgcgacatttgctacatcaacagccgtcttcattccgctctcagagacaaagactgtttcaggtgggaccatatctacaagcctttttgtattctcgaggtctacagtaaagtccttcagatttcgattgtttacaccgataatttttgccccacattctatagcagtacggatttcttcctcattatgagcttcaacaagcgcatccattccaagttcctcggctctggctttaaaacgctttatttcatcttcagtcaggattgcacagataagcaaaactgctgatgctccaagaactctggcctgatccaccatatactcatctacagtaaaatcttttctaagaactgggatatttaccttttccgttatttcctttaggtattggtccattcctaaaaaccagtaaggttctgtaagacacgaaatcgcatcagcgccggctgcttcataatctctcgcgatctgaagatatgggaattcaggagctataagacctttagatggggaagcctttttgacttcacagataaaagatatccctggcttattaagagccttaaaaaatgatggacctttcttttttcttgcttccatatcggcagctttatgcattttttcaggagaaatctgtttcttctgctcatttatacgttcccttgttttctgagctatctcatccagaatattcattggcttcacctggttgattcttcaataaactgctgtaatttttctgcagcttttccgctatcgattatctgctcagcaatctttactccctccttcatgtccttcgcttttcctgcgatgtaaatcgcagctccggcattcaggcatacaacctggcgtttcggtcctctgtcttttccagaaagaatatctcttgttatctgtgcattgtcctgaggagttccacctaacaactcactcttggcacaggtcttataaccgaaatcttctggttttattatatattttccttttttatctccatttatctcacagacagctgtaggagaactcattgaaatctcatctaagctgtctagtccgtaaacaaccattccacgcttaactcccaggttatggagaactgttgcaagagtctcaacctgtgactcttcgtaaactcccattacctgataagctgctccagcaggtgatgtcagaggccctaagatattaaatatcgtcctgattccgagttcttttctgacaggtcccacaaatctcattgctgagtggtacctctgtgcaaataagaaacagatatttatcttttttaagatttccaggtttctggcagggtctatatcaatttttactcccagggcttcaagacagtcggcagcgccggattttgatgaggctgctctgttaccatgcttcgcgacaggaattccgtctgccgcaattataagagaagcagtagtagaaatattaaacgaattcgagccatcaccaccggttcctacaatttcaagtacatccatatcgtttaacagttttgtcccagcagctctcattccctcggccgatgctgtaatttcatctattgtctcgcccttcatcgacattgctgtcagatatgctgcctcctgaacctggcttgcgttgccactcattatttcatccattacctggcgtgcctcatcgtaggtaagatcctgtttctttacaactttctttatagcttctgcaatcatcttttttcctccaattttctttatttaaatttttacatcctgaaaaaattttccattatctgttttccaacttccgtcattaccgattctggatgaaattgaactccaaacaccgggtatttttcatgctcaactgccattatttcttcccgttcatcgtctgaaacagctgtgatccgaaggcacgttggaagtgcagctttgtcagcttccagtgagtgataccttgcggcactgaatttttcaggcagaccttcaagaattttactttttccgattctctttattggttttttcctgccatgcatcagctcagctgcgtaagtgatttttccaccaaatgcctgaactattgcctgatgtccgaggcagacacccattatcgggatttttccggcaaacttttttatcagatctatgcagattcctgcattttccggtcttccaggacctggtgataaaattatctggtcagggtttaatccttcaacatcttccacggtcatctgatcatttctaatgacctttatatcaggattcaccgaaccagccagatggtacaggttgtaagtgaaactgtcataattgtcgactaaaagtaccatcaaatgcctccttctgcctgtttcaatgcgaggactaccgcctttgccttgttctggcactcctgaaactccttttcaggcaccgaatcagctacgattccagcacctgaacggatagtaatctgattgtttttctttttcttgtaagcaagccttattgcaatgcagacatccaggtttccgctgaaatctatgtatccgattgctccaccatatattccacgctgattgtgctctagttcttcgattatctgacaggctctgaatttcggggctccggagagagtccccgctggaaggatagcatcgattgcatctattgcgtccttgtcatccctgatctcgccttctacagttgagccgatgtgcataacctgcgaatatttcagaacatccagatagttcgtaactttaacggaaccaatcttactgacttttccgacgtcgtttctgccgagatcaaccagcatattgtgctctgaaagctccttttcatcggatagcagatcattaataagcttatcgtcctcctcatcatttctccctctcggccttgtccccgccagaggaaaacttgaaatttttccctctctcagtcttgcgagcgtctcaggcgatgcgccagtcatctcaatatcatcacttgaaaaataaaacatgtatggactcggatttgtcgtcctaagaactctgtatgtatcaaacaagtctccatctgctttcgccatcagtggatctgaaagcactacctgaaaaatatctccctcatgaatatagtgccttgctttttcgaccatctgggaatattcttcttttgaaaacatcggccggatctcgctctcaaatttaagtggtttgaaatcataactttcttcacccaacagctgttcttttatctcatcaatttttttctcagctctttggtacgagttttccgggtcagctgcatttacaccgcttatcaggtatatcttctgtttataatgatcaaatgctattatctcgttaaatagcatcagatccatatctttgaagtcaccatcgtcagaaagtattaactttggctctgcatatctgatataatcatatgaaaaatatccaactaagcctcctgtaaatgatggaagttctttaagtgtcgcgctattatactcctttaaaatttttcttagttcttctccaggatgcttaacttccatttcaactgtttcagtcataccatcatcatggattgttttttctctcagatggcctctctgacaggttatttccatcgtaggcctgtatcccagaaatgagtagcgtccccaggttttatcctggcttgcgctttcaagcagatatacgtgattactagcagctctcagctttttcatcgctacgatcggggtaagtgtatcggcataaagctcttcatacaccggaaccctcttgaaaccactgtccattgcgatttccttgactctttccaaatctggtttcactgtttctcctttcttttgaacttcgccttattccaaacaaaaaagcccgttcctgaagacacataaaaatgtcttcaggaacgggcttagaataatctacatcccgcggtgccatcctgattcacggactgaaccgtacacttagcgaagtaccatcatacctccggcaactaacgtatgcccgacgtcgcagaataataaggagtaacccttttcactgcgccctcagcggtccatttatgaaatctgcgtgcgatccattctcatcatccaggactctctgtacgtgctcgataacctttatctccgcttcaacggtttatcttcttaaattgtctatactatacactttgattttctaaaatgcaagaacttttttaaattttctttgttattttttatttctaaactttaaattattactatttaatgattatttaactgtttatactaaaaattatttttttatttcaaagcccattcctatgatgacaaatctgcgcctttttgctaaaatatagtaaattatttagtaaaggagtaattcgattggataataacagcgaatggcagacacctccacctgttcagaggcagccagtatttattaacggatctttagaccgttctatcttaaaaggtgaatctaaagcttttttcaggcaaaattacggcactattcttgctgcatcaattcttccagcgctgatatcgacgggaatcgatgtcatcccatttattggacctgttatttcatggtttttatcaccgattctctttgtcggcggatactatgttattttaggtgtcatcagaaatcacagggtctcggttggaaatatgttcgacattttcgacaactttggaaatgtatttggagcttcatttacgaccagtcttcttcttttcctttggagcgttccattaagtgttgccgcaggtgcgattttggctgtagcaggattggattttagattcactaagattccgagaattaatatccctataccaacaggagtaggactgctgtttttactcgtggttacttttatctgctgtattcctgccatatacaaagttttttgctgggctatggttccctatattctggctgacaatcccagaatgacaggtactcaggccagaagactttctaccgatatgatgcagggacacaagtgggaatattttgtattatccctgtcatttctcggttggttcattctctcaatcattacgatcggactcttcgctctgttctatgtgaatccatggtactcgaccgctttatgcgattactatgataaccttcggatgctttacgcagcaatgcatcagcagcagaatgaaaatttctaataaaaaaaatccagactcatttgagtctggattttttaatagaggcgccactcggatttgaaccggggatagaggtgttgcagacctttgccttaccacttggctatggcgccatataacggagaaggagggatttgaaccctcgcgccggtttcccgacctatacccttagcaggggcacctcttcggcctcttgagtacttctccaaaaagcatttaaaaaaaatgccctataccaagtcacgtctacaagtctccgctctcaacgtgcttttctattttactaaattttttctactttgtcaatatgtttttatttttttctgtactctgcctgtgctgtagcatagagattatttccatggtcatctgctacaacgattaccgggaaatcttctacagtattttatcgttttcaatataggctcccgcggagccggaaatctacaaacacgattctcgcgtttcaatacagactcttttttcgcccaaaaacttacacgccaggtttatcgttttcaatataggtcccgcggagcctgaaatctaaagcacgattctcgcgtttcaatacagcctcttttttcgcccaaaacttacactccaggattatcgttttcaatatagaattacgcggagccggaaaactaaaagctcgattctcgcgtttcaatacagccttcttttcgcccaataacttacacgccaggtttatcgttctcaatatagacttacgcggagccggaaaacaaaagctcgattctcgcgtttcaatacagctctttttttcgcccaaaaacttacacgccaggttatcgttctcaatatagacttacgcggagccggaaaactaaaagctcgattctcgcgtttcaatacagcctcttttttcgcccaaaaacttacacgccaggtttatcgttctcaatatagacttacgcggagccggaaaatacatgacttgtagaaaatcgatgagtaatggtctcattttgaaactcaaaaatacaggctttaagtttttcgactattttgcaaatatattgaaaatgccgaaaagcactttaagtttttgactgcattccctgtcaatattgaaaatccggaaaggcattgtataaatttcgcctcgccaggctctttattgaaaaccatccgaactacggagccggaaatctgcaagtattgtataaacttcgccccgccaggctctctattgaaaaccatccgaaccgcggagccggatgtctgcaggtgatcaggtgtgctgtcaagggtggcgtccggtactcaaaagtaaaatatctgcagttttcaaggtccaatgtgggccatttttttcggcccaggtttttcatagcttatttgacactaccatttagattatatcagtaatttgcgcgcttgcaagccactttgtgggacagtagggacggttctttctgtcccattttttatattttctgaaaatataccaggtagatgtgtccccactgtcccattttctgataatgggacagaaagaaccgtcccttgtgtcccagtcagcggtcttctgccgggacgtcttttctgagtactccgagcatgaatgcggtcacgagggatccgatcagccatgcgaggaggaagagcggccatctgcctattgttgcgattacgaagacgccgccgtgaggtgccatcagtgtgcatccgaataacgctgagaggaggcctgctactgctgagccaacaaatgttgacgggattacgtgaatcgggtcagatgctgcgaacgggattgcggcctctgtgatgaagcttgcgcccatgactagatctgaaacaaagccttccttctcggtcttgttgaattttttagggaagagctttgtggcgatggcgatgccgactggcgggcacattccaccgatcatgactgctgccattgctatgtagcaaatctgtacttctggatcagaaatttgtgatccctgatgaataagctgatctgcggtagcaagcattccagtgccgaccagatatgctgccttgttcagcgggccgcccatatctacagccatcatcgctgcaagtacgaggcctaaaagccatacaagtccggactttccaagtgctgtaagtccaactgaaagagcgttattgataagtccgatgatcgggttgaagacgaagcacatgatcaccatgacaaggaacatgccgactaccgggtaaataagcatcggtctgataccctgtaccgacttcggaagattttcagtcgatctctcgagccagagaataatgtaacctgcaaggaagccgaccgcaataccaccgaggaaacccgaaacagtattaccactctgctggaacgcgaacttgtcgataaagttctggaaaccgccgaggttctttggccaaatctttgcaaaattttcggcgaccgcatttccattcgatgcgagaagtccgccgaggaagccgactgcaagtcccggtttatcagctatcgagtaagcgataaatccggcaaggactggaaccatcatgcccattgcaagtccgccgacatatttgaaaagtgctgaaagcggtaccatcgaaccgaagttgctgccgcctgtcgtgccgaatcctaagatcgtgtcgataaggaacgcgatggctgtaaggattccgccaccaataacgaacggaagcattgccgaaacgccggccatcaggctggtgtagatcttgtggcctacgctctctttttcgccctcatcctgggatgaagtattagcgcctgctgccgagtgaaaaacaggtgcgtctccctttactgccttctgtaaaagctcctcaggtctggaaaagccatctgaaactctggtctggatgagcggctttccatcgaatctgtctacaggaaccttcgcatcagctgcgacaacgattccctttgcattctttatctcttcagctgtaaggacgttcttcgctccgccagagcctctggtctcaacttttaccttgattccaagcttgtcgccggcttcctccagggcttgtgctgccatatatgtatgcgcgacaccgttcgggcagctcgtaactgcgaggacttcatagccggtctctgtctttgcggcctctgccttcttcttctcctcttccaatttgccactctctgctttgtcgatgatcgagaggaattcttccttcgactgcgctttttcaagtgaatcgacaaaaccctcgcccatcagcatctctgaaagtctcgcaagaacctcgaggtgaacgttgtcctctgtgttcggcgctgcaataagaaaaatcaggtgcaccggctgtccgtcgattgaatcgaactcaacgccgtccggaagtaccatggctgcaagccccgctttctcgactacgtcagatttgcagtgcggaatggcgattccgtcgccaattcctgtggtcgattcctcttctctggcgaatacacccttctcatacgcgtcgcggtctttgatgttcccctgttttaccatcaggtctaccatctgctttaatacatcagatttgcctgtggcttttcctttcagctcgatactgtcagctgaaagcagatctcttattttcataagattcctccttttccgatctgttccaataatgctttcacctcgtcctttgtagcgaggtaatctgaaaatgccgacgcacttccagtgcataaccccatgtaaaatgccttctcataatctccacttcctatatatccattcaggaatccggctaccatcgagtctccggccccgactgaattcttaagtctgcccttcggtggcttcgatgaaataacgtcgccgtctgccgataccagcagcgcgccctcgcccgccatcgaaacgagcacgttctcggcgcccatctcctgcattttcttagcgtaaggtacgacctcatccactgtatttatctcgaccccgaatatctcaccaagctcgtaattattcggcttcacgaggaacgggtgatacggcagcacatcctttaacaggtctctcgtcgcatcgacaatgatgtgaactcctctgccttccagatatttcataatatctctgtacatcgtctccggcataactgtcgggatgcttcctgcgagcaccagatagtcgtcttttttaagttcatcgaacttctggtaaagcgcttcgatattcttcttcgatatagccggccccattccattgatcccggtctcttcgtctttgtcatcccgaatttttacattgattcgggaaatgccctcttctacctcaatgaaatccgtgtcgattcccttctcgctcatcagtcccctgatggccttccctgtaaatccagccataaatccgaccgctgtggaatctgttccgagattcttaaggaccatcgaaacgtttaagcccttgccgcccggaagcagcagctctttcgatgtcctgttcacaagtcccagcttgaaatcgtccacactgataatatagtcaagtgatggattgaacgtgactgtcattatcatcttggttcgtacctcctttattgttattttttataaaaattatcttagttatgctaattccttgatatttttaaagcctttgaatccacgcttcgtcagcttatctgtaatgatcgttgctctctcaaaatcgccaaacccgatcgccgaaactgtgccgaacttcgtgtcatccgccagcacatatctgtctttacatgataaaaatgcctggcgcttcaccatcgcttcctttagctccggcgtcgtgaagccttcttttctggtgattccgttcgccccgaaaaatcccttcgtgaagttatatttattcagggaatccagcgcctcctcgccgacaatagcttccgtgatccgcttgaactcgccgccaaggatatacactttaaatccctcagacgccagcaccatcgcgtgattcaccgcattcgtaacaaatgtcgcatcatgctctgtaatatacgaaagcatctgctcggtcgtcgtcccggcatcaatatatacaaaatcgccgggctttattagtgacgccgcatagcttccgatcgtcgccttctccttctgcttctggcctttcctcttcgaaatctcctcatccttcgacgtcagactgccggtcttcgaaatagctcctcctctgaccctcgtaatccgtccttcgctgtccagctcatccaaatcccgcctgacagtggattcgctggcgccgaggagcttcatgagttccgcaactgtgacagaccccttcgaatccaccgcagaaatgatcttcgcaaacctttcctctgtcagcatctttccctccaattccattcatttcccttcataacagttcaaatattaccaccatattccgtacttttcaatcatttccggtcagaaatacttcacaaaattcccctcccaaatttgtgcaacctgcacaacctgggacagtagggacggttctttttgtcccattttttgaattttctgataattgtgttttttagaccgaagcagcgccgcggatggccggggctcgctccgtaggatttttctgttcgcgtgcgctcgtctatgtgccgccctctgaccaatgtatggtcttataatggttatgattttggcgggtggtcacccgggcggcaacatcgcgcacactcacaacgaaaaatcctaaggtcgcgaacctgaccatctgcgacgctgcttctggggttgaagtcatttgtatctgcaatagattatttttcaggaagtgcaatgggacaaagaatctccgcatgggagggatatggggtaagcacactgaaagtgaactggcgtggacaaaagtttacttccggctccgcggaagagtggtggtttcaatataggcttacatgtagttgaaaatcatcaaatgtgcctgcctgctgcacagtatggaagaactaatttcaatattggaatttgcggagctggaaatatacaagcttcgttctcgcagtttcagtatggatatacatgagaccaaaaatctaaaaggcaaaaaagtcagtctcgatatagattcacgaagcgttgaaaatcttaaacgctcgaatgtacgctctcaatatagcctgtcgcggagctggaaatcttaaatgccttgtagaatattcagaagcaatggacatatataaaaagcttgaaatgtactgtttaagattttcgagcattatcccacacatcttgagaatgcttgaaaactctttaagaatttgactttctcccagatctatcttgagactggaagaaatccgttgtataaatttcgccccggaatgggctatactgaaaacgtggccaaccagatatccaggcagaaaaaggcagcactactgatatgggcacactttaatcaaaaagcagcgccgcagatacgggcgcactttaaccaaaaagcagcaccgcagatagagtcgggctcgcgaccttaggatttttcatagagcgcgcacgcgaacagaaaaatcctaaggagctagaccgaccatccgcggcgctgcttcggactataaatacataatgtgtcagaaaattcaaaaaatgggacagaaagaaccgtccccagtgtcccacaaaaagtgggacagaaagaaccgtccctagtgtaccacctggacgaagtgcatgacgaggcgctcgaacttgtctttgacggcgtcggcggtggccttgacttcttcgtggtttagtggctggtcgaggatgcctgctgccatgttggtgatgcaggagacgccggcgacgcggagtcccatgtggttggccgcgattgcctcgactactgtgctcatgccggcagcatctgcgccgagggtgcggagcatcttaatctcagtcggagtctcgtagcttggtccggtgagctggatatagacgcccttttggagggtgattccggtggcggcggccgagtcctcaagctggctgataagagccttgtcataaactgaggacatgtccggaaaacgaacgccgagttcgtccggattttggcctataagcggattctgaacaaaaacagagatgtgatctcttatgatcatcaaatcgcccggcttgaaatcagtattgataccgcctgcagcatttgtaagcaggatgatctttgcgccgagaaggcccatgatgcggacaggcattacgacctcggacattttgtagccctcgtaaaagtgcactcttccgctcatgcatacgactttgcgtccggaaagatttccgaagataaattttccatcgtgaccggaaactgtcgataccgggaagccctcgatatctttgtatgaaatctcgcagaccttgtcgatcttttcggagaggcctcccaggccgcttccgagtgtgatgccgatctccggcacgaaatcagttacttttctaatgcttttaagcgctttttgaagctgctcgtaaatctctgacataaaaacctccctttaaaaatcaatccgaaatgaaccgattcagatattctctcatttttctgtattgctgtttgtttattttaaaaacgctgcggttgtgatcaaaaaaaccttcctcgtcaagctgctggaccacacggtttacagtgcggacagaaagtcccgaaaaatcagcgatctgctgccttgtaaacgtcagcctgcagttccccttctggtctgcgcggtcctcgtactcgagcgcaaggagcatcagaagcgaatccttgccgggcaggaacctgaaaaccctgtcgcgcctggcctctctcaggagatactcgcaggtatccttcgtcagaagtttcagggcgtgcgagtccttgtccatccacctctcgtaggccgaacgctccatcttgaaaaaaatgcagtccgtttcagtctgaagagttgccgcgtataggtcgtaaccaagcaggctctccatcgttccaaaagattcgaacgccgaataagtcgtgaatttgtaatttgtcccgagcaccctgtgctcaatggccgacacttctccttttatcaggaaatatacgcggctcgcagggtcattttccctgacaaaatgcgtgccgctcggtatctccctgatctccatctcctgaaaaattccaagaggggcattcttgaagagctcctttagaacatcctggactgactccggcaattgctccgaataatctaaaattgaattaactgctgcatgttcgatcataaaaatgcttcaagttcttttaatatatcatttttcgttgcttcatctgcaaatgaggcgttaaccgcatttttttcaagtgagacgagctcagcgtcagtcaggttggcaacgcccttcgcactctcgagctcatccgtaagcgtcgtatttgaaactgtcctgttgtccgtatttatcgtggccatgattccggcatcgataaattcgcggagcgggtagatcccggtcactgccttcgtttgaaaattgctggtcgggcacatttcaattgggatgcccttctctacaaactcattttcgagctctcttatgccctgcatcctgactccgtggccaatacgcttcgctccaaatgacaaagccgctctgatgcttgattctccgtcagcctcacctgcgtgaataatgtacggcacatttctggtgcgggcagccttgaaaagctccttgaatccactcgtcgggtagactgcctcagcgcctgcgaggtccatgcagcagaccccctttccaaggtatttttctacgagtgaaagagtcccgagatttttttcaaggtcaaagtgcctcatggcgcagaggatgatgttgccctttacgccatattttaaagtaccggcgcgaaggccttcgatcgacgccgcgaccgcatcgtcgggagtcattgcatttcccgcttccgcaaggcagaacgggtcaaaacgtatctccatgtagcggacattttctgcatctgcctgtgcgaggacatccattacaccgtctcttacagcatcaggcgtagagagcgccttgatctcggcgtcaaatttttccaggtattcgttcaggctcgcgcactctatggaaactgagagatctttgaaatccaggcttcgcccgaggtgactgctgataaattccggcgaaagtgatccgtcgagatgacagtgcagttcaactttcggcagcgcttttatctgttctctgtccattaattacgctcctataatttttaaagtagccgaagttccaagtcttgtagctccagcctttaccatagattcggcctcttcggctgagtggattccgccgctggccttaacaccgagcctgtcgccaactgtctttttcatgatggcaacatcctctgccttggcaccgcctgttgaaaatccggtcgaagtctttacaaaatcagcaccaccattttcagagagctcacaggccttaaccttctcatcgtctgtcaaaagacaacactcgataatgacctttaagatcttgcccgcgcaggcatcgcgaacagccttgatgtcatcaagaacaacgtcgtattttttatcctttaaagcagcgacattaataaccatgtcgatctcgtcggcgccatcttctacagctgtctttgcctcgaaggccttagacttcgtgctcatctgtccgagagggaagccaacgacagtagtcgtgtggatgcctgttcccttcagggcatcagcgacatattttgtatagtaagagttgcagcagacagacatgaaatcatatttcttagcctcagcgatgatctgatccatctgagcctgagtggcatctgcttttaaaagtgtatggtcaaataacttgtgatctaacataataatctccttttatataatttattgttctcaaaatcagagttcgcggcgccggaaatctaaaagctcgattctcgcgtttcaatacagcctctttgattgctcaaaaacttacacgccaggcaaagaaagaagtattgctcatggacattatacgttatttacttcaaatcattcaagaccttaattatcaaaagcgttgcttttaactttcatctgcagatatattcctccaaacagtgggccatgacactcacggtctccaaagtaccagaaatttaaaactgataagcttcctgagatattccaatcatccacaaggactggaaacatcttcgtcgtgaaaccagcgcagccacaacggccgtgagctgaaccgatcaggcataaaggcaagtgcgacatcccagctgatacacgctgtccgtgctgtggagctcctgctgaatacctctatcgcaacacggttccaaaggccatatctgtgcaaagtctgtggaacgacgtttgcctctgataagcgttttcacaaaaactatcagtacaagtgccccattctgtggccgtgctcttgtccctgttaaaaccagaaaggtctttaccgtctggaagtgcgttaacccgaaattttcgttttatctcaatcggctgaaaaagatcaaaccagatgaagaggacgaaaagtacgagtataaactccactatctttacagggaattcactgtcgatttattcaagatgaaactggacaatgattccaacaggatttgcacgttccgtttcaaaaagtacgacgcaaacatcatgggacgtgtgctcacacttcacgtaaaccttcagctgtcactgcgtaaaacctcacaggctctgcaggatctgtatggatttcgtgtctctctcagcaggtagcgaactattgcaagcttgctgccatgtgcgtaagaccattcgttgaccattacgatacaagccaggtaaaacctggactgccgacgaaacatacatcaaagtcgaggtgttaaaacattcgtctggttcatcatggatgctgtcagtcgatcgattatcggctatcgggcttcgtctaatcgaagcgtcggtccctgtgtccttgccatgcgtatggcattcaaccacataaaaacatcatccccaaaggattccgtttcattgctgatgggtacagtgcctacccgcttgcagctcaacatttctcgagcatttcggtaacaagatgaaattcaaaatcacccaggtcttagggtacaacgatgatccgtaacgccaaagttccgtccatacaagcagctgattgaacgtctgaacaggacctacaaggcctcatatcgacataccaatggctttgacaacctggaaggtgccaactacgatttatcattgtgggtggcctactataactttctacgtcctcacaaacacgcgaacttcaagtcacttaaccaggttccgcagattgaaaaagcagaaccatgccaggtaaatggcaggtaatgatgtacctagggcaacagcaaatctcagatgcagtctcaaacagaggcttaagactgtctgtcagagattcaaccggaggcgttttgataaacagccacaccgaaggtgcatgcccttgatggcacaccgagccgcgctacaatgggatgactttcgacgggagaagactgtctgttcatgagttctcaccgtcggcggcatcgcctcagcgcgccggtagtttatgtgatgtgtagatttcccgctccgcatacggctatattgaaaccgcgggaaccgcgcttgtagatttctcgctccgcggatgcctatattgaaatgcatcgccaacgcggagccggtagtttatgtgatgtgtagatttcctgctccgcatatgcccatattgaaaaacatctgccacgcggagccggtagtttatgtgatgtgtagatttcctgctccgcgtgcctctatatcgaaaaaatccccgctttcccgcgcaggcgcgggaaagcgggggctttactgtattttttagttgaatccgatgaagcgctgggcgatgtggtagaagaagacgcccatcttcttgccgaagttgcctctgatgcgcattgcgccgccgaggacgccgtagcggatgtggcggtaggtgcggatgtcgtgttttttgatgtagtcccagaggtcctcgaccttcttgtagttcttcgggtccttcgaaaggtagccgattgaggttgaaattaccgttacggactcgaggtacgagaggagatagcggcggaggtgcggctcgcggactttccaagggtcgacggcgtcgatcatcatgtaattgacgcggagctgctggtcgatgcggcggatcatggtctgctcagcgaccgactgtccctcacggccgatgtagtagcggtagaactcgacgttcatgtagtagatcgtctttacatggacgagcgggatgtatacatacagattgtcaacataaaaagtgtgcttcggaagcttgagtccgcagtcgcggagaagctgtgtgcggtagattaccgagtgcatcaggatcgagaagcccttgatattgcgcttcattccgtcccagccaatgatcttgtcctctggaaaaagtggcgagaggagcatcctgcgctcgtggcctgtggacaatttttcgtagacaaagtttgagaggtgcatgtcgacagggtggcgcatttttgcaaactcacggagcttcgtgaggatcttcatgtaggcctcgcggtcgacccagtcgtcagagtcgacaactttaaaatagactcctgtcgcattctcgatgccggcgttaactgcggcgccgtggccgccattttcctggtggatggcacgaactatgttcggataagttttctcgtattcgtctgcgatctcggcggtcttgtctgtcgagccgtcgtcgacgataagtatctcaacttcgtctccacccggaagcagcgagtcaatacattttctcatgtatgcgcttgaattatagcacggtacacaaaaactcaatattttcatttgttctctttcctttcgctttacagcatatttcttttatgaagaacaataagcgtgacgatactcgccacgaacgttattgcgcagagtatccaaaaacctaacggcgtgtgcgaaaacggcatccagcgggcgtcaacattcatgccccagaggccgccgatgatcgttggcacggagagcacgatcgtgactgctgcgagatatttcatcgcgatatttaagcggttgttgatcacggtgctcatcaggtcgcgggttccatttattatatcacggtaaatcgatgtcatctcgatggcctgctttgtctcgactatgacgtcctcgaggagctcttcgtcctcgtcgtactgcttgatccgcgagtaacgggtcagcctgtcgatcacgaggttgttcgcacgaagcgaagtcgcgaaatatacgaggttgctctcgagctcgtgcagatcgataaggtccgcatcttctaagttgccggatattttttcttcgatttcggtgcgctggcggtcgatagtgcggagcagtgactgatagaccatgctcgtgttgtagaggatctgatatgtgaaacgcatctgtttttttgtagaaaattctttgatgcggtggtcaataaatgagcgcagcaccgacgtctcttcgccgcacaccgtgatcactacgtcatcccttagcaatatgcccagcgggattgtcgtgtaggtgtgtctgtcatttctttcctcagccgtcggtatgtccacaagtatcaatgtgtaatcatcttctacgctgattcgcgagctctcctcttcatcgagcgcggcacgcacgtcaactatgtccattccaaattccccggcgacctcttcgcactcgtccgtcgtcggcgccgtcagctttatccagcagcccggctggaacgaatccatctcgtgaactaccgcgtcatctgtcctgtatatatccagcatggtgacaaatcctccatctcatgttaccaaatatctcttccgctcgataatgaatatcagattccatgggatttgccaccttcctttctcaacctattatactaatttctttgaaaaattcctgttaaatttatttagaagcaatctgcctcaaaatcttaatgaagcgttttttatcgaagatcaccgggaccgggtagatcgggtttacctctctataggcccaggtggctattttcgggaaatcactctctgaaatatcaaggtgcttcgggattcccatgtcctcgttcatatcctcgaccgctttgataaaacctgccgcgcgctcctgcctcgtgccatctttttcaatatcgcttaccgaggcgagcttcgcaagctccggcactactgccgcgccgtattcgcggaggacatatggcatcacgaccgcatttataaggccgtgctgcatgtggagcattctgcttatcgcatgcgcaagcgcgtgaatatttccatagccgctgacgttcagcgccgttcccgccgtataagatgctataagcatctcctctctcgcctgcaaatcctcgccatctgcgtaggctttcggaagcgattccattatcgcttcgaccgcgtcttcgcaatcctccgccgtatcgctcagatggtatggcgtgttaagatacgcttccacggcgtgtgtaagcgcatccattcccgtgtaagcggtttcatcctgcggaaggcttataagaagtgacggatccaataccgccacatccggcatcaggtgcggatctattatcgaaaatttctggccggtctcattgtcaataagcgctgcattcgccgtcgtctcggagcctgtcccagccgtcgtcggcaccgctataaaaaatggcgtgtcgtggcgcacatgcatcagcccgcgcatcttctgaagcttctttcccggtcttgctatacatgcggccgccgcctttgcggcgtctatcgcgctgcctccgccgatcgctataaatgaatcgcagtcatttttttcatagaatgctgctatctcctcggcctgcgagaccgtcggctccttccggacccaatggtagacgacatatccggtctcccggtcatttataaatgattcaaaaaatgtggtcttcgacacgttcggcccggtcactacaagcggcctctctgcctcgtgcctgtccagcagatccggaatcgaaaagagcgaatcaacgccctcgatcttctcggcgagctcagaattcctgtgtcttatcttccttccagtaactttctgatataatctggtgatacattctaacggaacgtccataaaaacctttctttacataaaaagccaactgtatcattttatcacagctgtcaaaaattgcaaatgggtcagtagggacggttggagcggttgttatgctgtcgcgagtccgtaggacgaagcgagagcattataaaccgcccatgcgatagccgtccgcgattgacgagtccgaaggacgaagtcagagcggaaacggcgaaccgctctttttgtcccattatctgatatttctgggacagtagggacggttctttttgtcccgtttttagattattcagacaattatgccttttttagcccgaagcagcatcgcagatggtcggtcctcgctccgtaggattttcctgttcgcgtgtgcgcgcctaattgcggccttctggccaatgtatggttttaatacgtttaaggcttaagcgggtggccacccaggccgcagctagcgcacacgctcacaacgaaaaatcctaaggtcgcgagcccgttccattctgcggcgctgcttctggggtgaagtcatttgtatctgcaatggattatttttcaggaagtccaatgggacaaagaagctccgcatgggagggaaatggggtaagcacactgaaaaatgtttacttccggctctgcggaagagtggtgatttcaatataggcttacatatagttgaaaataatcaaatttgcctgcccgctgctcagtatataagtactgatttcaatatcgacatccgcggagctggaaatatacaagctccattctcgcagtttcagtatggatatacatgagactaaaaatcttaaagactaaaaagtcattctcgatatagattcacgaagcgttgaaaatcttaaacgctcgaatgtacgctctcaatatagcctgtcgcggagctggaaatcttaaatgcattgtagaattttcagaagcaatgactgtatataaaaacttgaaatgtactctttaagatttttgaacattatcacacgcatcttgagaatgcttgaaagctctttaagaatttaacttcctccccgatctatcttgagactggaagaaagccgttatataaatttcgccccgaaagggtctatactgaaaaagtgaccaaccagatttccgtgcaaaaaaagcagcactgcggatatgggcgcccatcaatcaagaagcagctccgctgatacgcgcgctttctaaccaaaaagcagctctgctgatacgcgcgccttttaatcaagaagcagcgccgcagatagagacggtctcgcgaccttaggattttttgtcgtgagtgtgcgcgatgttgccgcccgggtgaccacctgccaaaatcataaccattataagaccatacattggtcagagggcggcacatagacgagcgcacacgaacagaaaaatcctacggagcgagaccgtccatctgtggcgctgcttcgaacttaaatgttgtgatttgtctgaatattcaaaaagtgggacaaaaagaaccgtccctactgacccactactgtcccactgagaggtcggtgtttcggatggcgtcgcggactgccagtactcgcgatggggagactgagagctcgtcgactcccattcgaaggaaggtctcggtcagagatgtgtctgcgccaagctcgccgcagatgccgacccaggcaccgcccttgtggccatttttgatagtgtactcgatctcgcggagaactgccggatggtgcgaatctgcgaaatcttcgagttttgcgttctgtctgtcgcaggcgagagtgtactgcgtcaggtcgttcgttccgattgagaagaaatcgacttctttggcgagttcctcggacatccagacggctgccggagtctctaccatgatgccgagctcacagtctttgtatggaagtttttcttcgtcgagttcagctttgacttcttttatgatctccttgattttgcggacttcgtcaacggaaatgatcatcgggaacatgatcgaaatatttccatagaagcttgctctgtaaagcgcgcgaagctgagtcttgaaaatctccgggcgcttcaggcagattcggatcgcgcggaagcccatcgcagggttgtcctcgtggtcgaggtggaagtaatcgacctgcttgtcggcaccgatgtccagggtacggataatgacttttttgccggccatattttcagcgacggtcttatacgctctgaactggtcctcctcagacggatagtcgtcgcagccgaggtacaaaaattcgctcctgaaaaggccgattccgccggcgtcgttcgtcaggacatctgcaatatccttgactgagccgatatttgcgtagacatttatctcatggccgtcctttgtaatatttggcttgcccttgagttcctgtaaaaggcgtcgtttttcatcttcttcggcctttttttccttatatgaagtgagaacgtcctcatccggatcaatgataaatttgccctcgtagccgtctacgatcccgagcctgccctcgagtccctcctcgttgaagtcaactccgatgagcgccggaatgttcatcgtccttgcgaggatcgcggtatgcgaattggtcgagccgccctttgtaacaaatgagaggacgagcgacttgtcgagctgtacagtttcagacggtgcgaggtcgtctgctacaagtatcgacggctccgttgcggtgaaaccgcctgctccggcgccgtttaaaatgccaacgactctgtttgaaatatccttgacatcggcagccctgccgcgcatatactcgtcgtccatatttgcaaacatctcggaaaaattgtccccggtcgttgcaactgcaaactctgcattgacaccctgagtgcggataatattttcaactgattcctgataatcgaggtcgtcgagcatcatctgatgcacttcaaaaacagcagcattggcctcgccgacttccttcagagccttgtcgtgcagctcgccgagctgcttttttgcctcgtcagatgctgcgtgatatctcttgatctcggcctcagcgtcgtcgatcttctcacgttttacaactgattcttttttatggtaaatggaaatctttccaatggcgattccgctgaataccggctttccactgtattctttctgcactttgtacctcctgtcacaaaaaccgggcgatgcataaacacccgcccggctcttttcagatcaaagattctctttgaggaatttctcgagggcttctgcagcctcgtcctctttttctccgtcacaggtaactgtgatctccatgccctgcttgattccaaggctcataacgcccagaattctcttggcatctgcttctctgccatcctttgaaatagtgaccttgcatgggaagcctgctgcagcctttacaaaaaggcctgccggtcttgcgtgaattccctgtggatctgtaatagtgtacttaaactccttcataatgtgacctcctttatttagatggtagtgtcatgcatatagcatgaataacaatgtataaaccttgatttcaagggattttgcacaaaaaagagcaacaccccctgtttttgtgtataatgtcaagtggccaaaccaaacattctcacggtctccagctggcaacaaatattttccgtcaaagctccaccccgcgcaccaggcgacgtcggcttcaccaaaacggttttcacataaacccacaataaaccaatcttatataattagcatatataataagcatacaatattctactaaaaaagaattattaaatcaaggcttttttgctatacaggctatttctgagcaattatttctttataaagaaatgcatgttcgacgcagagccgcgttttctcaatatggccacgtgaaatagctgtttgtatcaaataatttttagtgtttttaacatacgccaaagttgactagatttgtgacaaataatgtttttctagtttcactataagtacaaatcaatctggtttgttccaagggtgtgtcgcaattcttccggatattgggctctggtgataaactaatattttaataattcccgagcatttctggcatttgttacattttaagtcatgcaggagctataatgataaactagcgtttttataacatcccagcatttccggacttgttacattttaagccattcaggagctatagtgataattcccggcattttttaacgcaaaaagcccccggctgcctgaacagctggggaccctctcaattttttagaaatcggtgaagtgcttgtctgtctttccgtcgatctttaagaatgcgcccatgccttccttcttgtcgtgggtatcatttacaacgccgaaaaggttggcttcgagctctacgccattcttgatgtccatgtcgtagccgttgttgattgctgccttggcaatcgaaactgcgtatgagccgtttgcttcaatcgtctctgccatcttcttgcaggtcggcatcagctcttccttaggtactacatggttaacaaggccaatcctgtatgcctcgtctgccttgatattctgggctgtgaagatcagctctttcgctctgcccatgcctacgagtcttgcaagtctctgtgtaccgccaaatcccgggatgatgccgaggccacactccggctgtccgaaaatagcgttctctgatgcgattctaatgtcgcatgccatcgaaatctcgcagccgccgccaagtgcgaagccgtttactgcggcgatggttacctgacgcatattcatcagcttgaaaaatggttctgcggccttcatgccaaattttctggctgaaggtgcatcaaatccatacatctctttaatatctgcgcctgctacgaatgatctgaacgggtcgtctccgccgagcttcttattgtagcaaggtccgcctgtgatgatcaggactttcgtgttgtcatctgcctcgatctcggtgagtgcttcattcagctcatcaactgtctctgagttcagtgcgttgagtgcctttggtctgcaaatcgaaagaacagccgtcgcaccatcgtgctcgattttaagattcttgtagtctgccataatttccctccatttatatctactataaactatatactttctaaataatagaagaaccgccggggtttgtcaagggagagcggaattcacgtgcgggtatacaattctggcgggcttacagctctcgtttcaagctatagccttaccagaaataatttctacaattacatcgagcttgcagcttcgcattattgctcgctttcaagatagggccgaatagggttgaatttattcaatttcttttaatttgcggatccgcgcttcggcgtgtttctagattgagctttaatgactgaaaattatgcaatgacacttagcttgcagctccgcattattgcttactttcaatataaagccttaccaaatcaattttatacaatggccctcctccggttctcaagatagagcagggaggaaattaaattcttaaagagcgttcaggcattttcaagatgtgtgggataatgctcaaaaatcttaaagagcacatctggggctttcagcatgcgcccagagctcttggattttctacaaggcttttaagatttcatgctccgcagatgcctatattaacaacgcgcatttgggcgtttatgatttctgatgtgttctgaatctatattgagactcgcttttttccctttaagatttccagctcagtgtgcggctatattaaaaccgcgagaactacgcttgtagatttcttgctccgcataaacccatattgaaatcaagcccggcataccgcgtggctcgcaatcgcatttgtagatttcctgctccgcgtgcagcccatattgaaaagcatctgccacgcggagccggaagtctatatgatgtgtagatttcttgctccgcggaaccccatattgaattcaaacccggcataccgcatggctcgctatcgcatttatagatttccagctccgcgtgcagccttcagaccggcctaattataaattttcgaaacaatttataaacaaaatcaatttcacatgaattttccattaacaattattaaatcgtatccatttttattgaccgaagactgacaagatgatatttttttatcaaggccacaaaagaaaaggggaaagcttatgtttaattgtttagaacgccggatcaaatttctcgagaaagagattcccatacttgaagccagaataaaggcggcgccgtctgggaagctacgtatttacacgcacgataattattccaggtggatggttctgctggctgacgggaagagtcagtatattaagaaatctgagaaggagcttgtgtgcaagctctggcacaagcagcttgattccgacagtctcgatttgtacaagagagagcttgcgattttgaagcgtgacagtgcggcgattgagaagctgtatgccagccgccaaaagcggataaaccgacacaccaattccacgctgccccaggacaaggctgtgtttttgccagacgagaactggcatgatattccttatcacaagaacccatacaagcaggaaaatctgacgaatattggccccggcggagagaaaatgcgctccaaatctgaagtgatgattgctatggcgcttgctcagcataatattgaataccgctacgaatgcgaatatccccttggttgccgaagcgtttatccagattttatgatcaaacggccggcagacggtgaaatcattctttgggagcactttggaatgtgggacaatgaggaatatcttaaaggtgctgtcgataagatcaatgattacattgcaaatggacttatcccgtatgagaattttatttacagcctggagacagagagccatcctacagactatagtttgataaatgacatgatagagacttatattctttaaaaaacatcatagctcccagagccgcgtctaaagacgcggctctgttttttgcaataaaaagatttgcggcaggtttcaacatagggccttatttgtgctttctgttcgcttgcggctccacagaggcccgggtttcaagatagggcctttgcgagggaattttatacaatgaccttcttccagttttcaatatagcgcagagaggaagtcaaattcttaaatagccttcagtcgttttcaagatacgcgctataattctcaaaaaacttaaagggcacatttccgtctttcaatatagcgccaaggattctggattttctacagtgcttttaagatttctcgctccgcgaacgcctatattgaaagtacaaattggagcatttaagatttttgatacactttgaatctatattgaaactctcttgttagtatttaagatttccagctccgcatacagctatattgaagctgcgggaaccacgcttgtagatttctcgctccgcgaacgcctatattgaagaacatctgccacgcggaggtatctcctccactgcatcagcacttccagaggatatcgctcgggttgagcaccacttcttccttcagatttactttatcagtctgcattatttctatcctttatttctggttattctactctccccgttaagtttttgtgatttttctgcttagatgctgtgtgctttattttatcttactcggcgcctttgctgcgcttttgtcgctttattcggcgctaattctggcttttttcgttattactcagcccccttgctgtcgcaaccgcttttatcgtcgcaaagaggatcttgaaatcgtatccaagactccagttgttgatgtactcgaggtcaagccttatgacttctcgaaatccgtgatatcacttctgcccgacacctgccagaggcctgtaatccccgggcgtatcgccatcctggctctgtggtgcctcgtaattgtcccactcatccactgtaggcgggcgggttcccacaaggctcatctcacctttcagcacattaaaaaactgcggaaattcgtctatacttttcttcctgataaaccagccatagccgtggcgcgtgccgtccggcccggatcctatgattcgcggatctgcttccattttgaacataagtccctgcatcttattctgatccatcactccgccttgcgcctttcggcgtcctgatacatgctgcggaacttgtagagcttgaatatacggccattttttccgtttcgcttctgtccgaagaatatcggacccgggtcatttttcaagatgcctggtatagctacgaatacagtaagtattcccgttatcgcaagtcctatgagagctcctataatatcgaaaagaccttcgatagtagcctgccgaacccgtgatcttcaggctctcgtcaggactgtcctgccatcagattctctacaactctttcgctgtgctcctggatatatatctcacgatgtgtcgtgattcccatgatctacatgaggtgatcagctcattcactcttcgtcgtatttttctctgcccttgcggttcgtctcgctggccgggtctacctgtctcggcgtcgcaaaaaatatctcatctacccagttcttcgtcagatacgggatgatgtcatctccctgcgcaagcaccggtacttccatcgtgccgtcttcgtctgtgatcttctcccctgccttaacgccgggtcactccgatgattcccgacacccagacatccgatcgcatcgaacttcaggtctgaaagcacctctttgcatccgcacgggtcgtgtaaaccaccatcctgcgcctgtggtacttctttttcttcagggccaccctgatgatcgtcttatagataatcctgtatacatcaggcatattattgaaaatattacaaaatatcccagaagcagtctcggcagagcctgtgagaaatgaactatatacaggataacgaggagttcaagtgtcacgacaacatcatcttgatgactgcccaaagctctttaaaaagcctcttctcaggacattattcaggttttcgaacatcacatccgcaattatcgatgcgaacccgagcgccactgcgacatctctgtagaaattcgcgatctgcgtcgtcttgttcttcacataaatgcaatatatgcggatcaaatatcccccgaaccgtataccagaaatccatatggtgcctgagcgtgaacgccagcagaatgccacctctatggctatcatatccaaaatatgaagtccagatgcttgatccaccttttatacttttcttatacataacaattcttttctttcgggcgaagggatttggtatcgggtggttgttattgcgctgaggtttttgttgcggcggtgtgcttttgttggtgctcttgttgttgcggtgcacttttgttattgcgcaaccgctttactactccgattccacttgttgctgcgcaaccggtttgctgtgtcgatgtcgcttgttgtgcgcaaccgctttactctttacggaccacctcaagaccgacggtcactggcgtttttccccaaggaagtctaccgcgagcatcgcagtcctgcggtgtcttttttatcgagatgatcgaaccctcgcgtcccttcaacgggccttccgtaacgatcgcttgtctcccgtcatgtatcctttcgattcgcggatcacatgctctctgtccgacaactccgtcacaatctgctcgtcgtgcttcgacagcggtattatatactcttcgtcgcggatcagattcacatatttaaaatcgtcttcccgagcgaccctttcagcctctcgacagcccgtgctgtcccctgtcctcaaaatacataccccggaaacatcgggatcatcacgtccgtccattcccgtgtatcttcttgcttcgggcagtcaacggcacgaaggcttcctctcctccgacccacatgcttcgctatatcgtcccgcacccggcgggtgtatgtgctctctgtatggagacaatacattttgcagtcattaatttgtgtggtagtggttttatgcttggttgtgcagcacggccagaaggccgtgctccgccatccggcgaccgttcggcgcgaaaaactgcagatatttgcagatcgagagctcgttttttttgagttcgtctgtcttgatgttgtcccgctcttctacaagggcgatcagaaacatcaggaaaaaattaaggactatcgtcgatattcctattgatttctgcagatatatctccagactgtccagcttgtagtagttttggaattttttaaagcttatcaggggtagtacttttaaagttatctgtactatggtgtttttcagtataaagaaaaacaggttgatccccagcagcacgctcgcttttatccggatcctgtatagcaggactatgataagaagcggaagcatcgagacgtggaacaggctgcttactgcgataaatattatcgctcttatattgcgccctttgctcagatttatcagtccgatgagggcgatcgccgacgccagggactggcggatattgttcagcgatatcaggtatgtatatgagatatatagcagcaggatgcttaactgaatattgtcggatgctttatagatgctgtaatagacgaaatatacaaacaggaatgatgtaacgacgaatacccactgcgcatcgtttgtgaaaaatccgaccaggcggttaagccatacatagcctgtttcggcggacgtctcctcgcctctctgaatcatgtagaaccacgggagatagttgtgcagataatctgtcccgactccgtatctcagtgctgagaccagcgccggcatcagtcccgacagtatcatcaggtacgtggcgttccgccggtttttatctatcagtacgattccattcttagtcctggtgtcgctctgtgatatccgtttgttccatgtcactcccagacttattagtatcgataccgtgcagcttatgatatagatcatctgattacctaaaaactcttgtcgtacttctcgccgaagaacttcgccttaaggaatgccggaaccttgaccagcatattttcctcgacgtcgaacgggagctccatcgtctctctcttgaagatgcggctggtacccagcatatattcgagccagacattgaagaggatctcgcccatcctgcctacatacctcttctcgaaggatgtatagttcgcggcttcgactctgtggtagacctcgaaaagtatgtcgaagagccagttgcagtactcgtcgagcagatctcttcgcattatcgacatattgaacatatagccccagcggtgctttagggctctgtcgaaaaagcggatgtactctggatatttctccgcgagtacttccttcgtgatctcgaggtgcatatggtagtgcgtatggtcgtagtgcgatccaagtgtctcgatcacataccatctcttcttcggtgtaaataccttgatccggttcaggtacggcttgatctgtctgtattcgagtgtcctgccgtccatcgcaaagtggcgcctgtagtgcacgagtccgatataatcggcatcgagattcttccaggcccagtacagacctgtaagctcgcagaaatacgggttgtatttggagatattgtctccctcgtcgtcccgctggtatccttctatcgtcttcttgcctgctgctccgacatgcaccggcaggtacatcctgtctttcggcatggcatacggcttgtgcgccgctactattatctttatatctgaacccgaagcgggaatatcactttgattcatttgtgatctgtctttccttaccatctacgatcccgtcccagtcttctcacttcaggcttttctaatcagtccacatacagataccccattaccggtatcttgtactctgatgtcatcctgaaaaattctccgagctccgagtacttcgtctcgccctgtgttaccgcaagtactatagttcccatggaacttactgcgtctgcatctgtaagaagctgctttacactgtactgcttctgtgatgcctttatagctgaattcttcagtccgtttacgactgcttccgaaaatgctttgtttataggtgtgagtgtatcgagggacagtatcgtaacattatccggcagcttctcttcgtttcttaaaatcgagaacgctgatccgattccttctgacgcaaactctgacatctcgtccttatcgagatacctgctgtagtgcgacttgaatacccctctgctccagacaaacctttcgaatcctgtcttcgcatagttgtgatactctccatattttctaaggccggtgatcttcgcgatgtcatctccgccattcacacggcgcttatgcgctgtcaatatgatatatgcgactgcatagagcagtacaaataccagaaatcccacggcgaatgctttcttcgaaatggatggcttcgccggcgctgccttcggcttcgacgtgctcttctcttcgataccaagctccgcccttatattcgtaagctccgcattgtaaaacttcttctgtttatctgaaaatgacttcgtggctttcctggcatcatccaggctggatgtgatctcttttctgagcttgtcctgcttactacccaggctcgaatccgatgtaatcttcacatagctttcgagaaggttcagcttgtgcttcgccactgtcctgttcaggtcacctgagatcgctttcatctcattcttgacagtctctatcaccctgtctgtgtccgaccctttcggcagtatgactgatactgtgatgaccggattcacttccgacgatatcgctgtaccgactgtattcgccgatcctgtgtaatcgactttcaccagctctctcataaccatcgaaaggtctttcgaatcgaccttctggttcatgtcctgcgccagttccttcaagacgctctcatcacacatcttccctgaaaatgctctgcagagtgtctctgcttccttcggttcatttccgttgagatagtattcgactgtggctgtcttcttataatacgggtcgatcttcataagaagcgatgtgtcaagatacttctgatctgcgaggatctttcgctggtcgaagaccgcctttctggcattgaccagactcttgcccttcagcttattctgaagcttcgctatctcctctgctgtatagctggtcttcacctcttccttcgtcgaataattctggagcgccttcttataattcgatacactcttcatataggaaaggcccgacaccagaatggctccgagaagtgcaaataccactcatccaggctggatgtgatctcttttctgagcttgtcctccttactacccaggctcaatccgatgtaatcttcacatagctttcgagaaggttcactgtggcttcccactgtcctgttcagtcacctgagatcgctttcatctcattcttgacagtctctatcaccctgtctgtgtccgaccctttcggcagtatgactgatactgtgatgaccggattcacttccgacgatatcgctgtaccgactgtattcgccgatcctgtgtaatcgactttcaccagctctctcataaccatcgaaaggtctttcgaatcgaccttctggttcatgtcctgcgccagttccttcaagacgctctcatcacacatcttccctgaaaatgcctgcagagtgtctctgcttccttcggttcatttccgttgagatagtattcgacgtgggctgtcttcttataatacggtcgatcttcataagaacgatgtgtcaagatatttctgatctgcgagatctttcgctggtcgaagaccgcctttctggcattgaccagactcttgcccttccagcttattctgaagcttcgctatctcctctgctgtatagctggtcttcacctcttccttcgtcgaataattctggagcgccttcttataattcgatacactcttcatataggaaaggcccgacaccagaatggctccgagaagtgcaaataccagtatcatcctccactgcatcagcagcttccagaggatatcgctcgggttgagcaccacttcttccttcagatttactttatcagtctgcattatttctatcctttatttctggttattctactctccccttgtaaagtttttgtgatttttctgcttagatgctgtgtgctttattttatcttactcggcgcctttgctgcgctttttgtcgctttattcggcgctaattctgtgcttttttcgttattactcagcccccttgctgtgcgcaaccgcttttatcgtcgcaaagaggatcttgaaatcgtatccaagactccagttgttgatgtactcgaggtcaagccttatgacttcctcgaaatccgtgatatcacttctgcccgacacctgccagaggcctgtaatccccgggcgtatcgccatcctggctctgtggtgcgcctcgtaattgtcccactcatccactgtaggcgggcgggttcccacaaggctcatctcacctttcagcacattaaaaaactgcggaaattcgtctatacttgtcttcctgataaaccagccatagccgtggcgcgtgccgtccggcccggatcctatgattcgcggatctgcgtccattttgaacataagtccctgcatcttattctgatccatcagctccgccttgcgcctttcggcgtcctgatacatgctgcggaacttgtagagcttgaatatacggccattttttccgattcgcttctgtccgaagaatatcggacccgggtcatttttcaagatgcctggtatagctacgaatacagtaagtattcccgttatcgcaagtcctatgagagctcctataatatcgaaaagacgcttcagatagtagcctgccgaacccgtgatcttcaggctctcggtcaggactgtcctgcccatcagattctctacaatctgctttccgctgtgctcctggatatatatctcacgatgtgtcgtgattcccatgatctgacatgaggtgatcagctcattcacatcttcgtcgtatttttctctgcccttgcggttcgtctcgctggccgggtctacctgtctcggcgtcgcaaaaaatatctcatctacccagttcttcgtcagatacgggatgatgtcatctccctgcgcaagcaccggtacttccatcgtgccgtcttcgtctgtgatcttctcccctgccttaagcgccgggtcatctccgatgattcccgacacccagacatccgagatcgcatcgaacttcaggtctgaaagcacctgctttgcatccgcacgggtcgtgtaaaccaccatcctgcgcctgtggtactttcttttcttcagggccaccctgatgatcgtcttatagataatcctgtatacatacaggcatattattgaaaatattacaaaatatcccagaagcagtctcggcagagcctgtgagaaatgaactatatacaggataacgaggagttcaagtgtcacgacaatcatcatcttgatgactgcccaaagctcttttaaaaagcctcttctcaggacattattcaggttttcgaacatcacatccgcaattatcgatgcgaacccgagcgccactgcgacatctctgtagaaattcgcgatctgcgtcgtcttgttcttcacatagaatgcaatgatatgcggatcaaatatcccccgaaccgtataccagaaatccatatggtgcctgagcgtgaacgccagcaggaatgccacctctatggctatcatatccaaaataatgaagtccagatgcttgatccagccttttatacttttcttatacataacaattcttttctttcgggcggaagggatttggtatcggagtggtttgttattgcgctgaggtttttgttgctgcggtgtgcttttgttggtgctcttgttgttgcggtgcacttttgttattgcgcaaccgctttactactccgattccacttgttgctgcgcaaccggtttgctgtgtcgatgtcgcttgttgctgcgcaaccgctttactctttacggaccacctcaagaccgacggtcacatggcgtttttccccaaggaagtctaccgcgagcatcgcagtcctgcggtgtctgtttatcgagatgatcgaaccctcgcgtcccttcaacgggccttccgtaacgatcagcttgtctcccgtcatgtatcctttcgattcgcggatcacatgctctctgtccgacaactccgtcacaatctgctcgtcgtgcttcgacagcggtattatatactcttcgtcgcggatcagattcacatatttaaaaatcgtcttcccgagcgaccctttcagcctctcgaacagccctgtgctgtcccctgtcctcaaaaatacataccccggaaacatcgggatcatcacgtccgtccattccccgtgtatcttcttgcttcgggcagtcaacggcacgaaggcttcctctcctccgaccagcacatgcttcgctatatcgtcccgcacccggcgggtgtatgtgctctctgtatggagacaatacatttttgcagtcattaatttgtgtggtagtggttttatgcttggttgtgcagcacgggccagaaggccgtgctccgccatccggcgaccgttccggtctccagctggcaacaaatattttccgtcaaagctccaccccgcgcaccaggcgacgtcggcttcaccaaaacggttttcacataaacccacaataaaccaatcttatataattagcatatataataagcatacaatattctactaaaaaagaattattaaatcaaggcttttttgctatacaggctatttctgagcaattatttctttataaagaaatgcatgttcgacgcagagccgcgttttctcaatatggccacgtgaaatagctttttgtatcaaataattttagtgtttttaacatacgccaaagttgactagtttttgtgacaaataatgtttttctagtttcactataagtacaaatcaatctggtttgttccaagggtgtgtcgcaattcttccggatattgggctctggtgataaactatattttaataattcccgagctttctggcatttgttacattttaagtcatgcaggagctatatgataactagcgttttttatacatcccagcatttccggacttgttacattttaagccattcaggagctatagtgataattcccggcattttttaacgcaaaaagcccccggctgcctgaacagctggggaccctctcaattttttagaaatcggtgaagtgcttgtctgtctttccgtcgatcttaagaatgcgcccatgccttccttcttgtcgtgggtatcatttacaacgccgaaaaggttggcttcgagctctacccattcttgatgtccatgtcgtagccgttgttgattgctgccttggcaatcgaaactgcgtatgaccgtttgcttcaatcgtctctgccatcttcttgcaggtcggcatcagctcttccttaggtactacatggttaacaaggccaatcctgtatgcctcgtctgccttgatattctgggctgtgaagatcgctctttcgctctgcccatgcctacgagtcttgcaagtctctgtgtaccgccaatcccgggatgatgccgaggccacactccggctgtccgaaaatagcgttctctgatgcgattctaatgtcgcatgccatcgaaatctcgcagccgccgccaagtgcgaagccgtttactgcggcgatggttacctgacgcatattcatcagcttgaaaaatggttctgcggccttcatgccaaattttctggctgaaggtgcatcaaatccatacatctctttatatctgcgcctgcacgaatgatctgaacgggtcgtctccgcgggttgcgcgtgccagtagccataatgcggagctgcaagctaagtgtcattgcatttttcgtcatttgctcatctagaaacccgcgcgcgatccgcaaattaagaaattgataaattcaaccctatcggcccatcttgaaagcgagcaataatgcgaagcgcaagctcgatgtaattgtagaattatttctggtaaggctatagcttgaaacgagagctgtaagcccgccagaattgtatacccgcacgtgaattccgctctcccttgacaaaccccggcggttcttctattatttagaaagtatatagtttatagtagatataaatggagggaaattatggcagactacaagaatcttaaaatcgagcacgatggtgcgacggctgttctttcgatttgcagaccaaaggcactcaacgcactgaaactcagagacagttgatgagctgaatgaagcactcaccgagatcgagagagagcaacacgaaagtcctgatcacacaggcggaccttgctacaataaaagaagatcg

SEQ ID NO: 8 - DNA, 57093 bp, Unknown
  Metagenome-assembled genome
ctcagattatgagatgtaaaaataagctgcccttttcctttctctgaaataattcgtaaaagttcaccagaagatactcaaagataccactcaattcatcgatggcaaccgtaatagaggaatcattataaacaactatcaaaagctgtaatacagagataatttttttgatgccatccgattcatacttcaaagcgattgttctattgtttctagtggacatcaattgaatcctatgtccctttttgccattttctgatacaatcgatccaagattcttcacctgaacttcatcctggaacaatttgagtcagtaacacatccagattgcttattactccatcaattacattaaatgactggtcatcaatttctgtaggctcgttaagttgcaacataattttccaacatcactttttttgccatgatgaacttaaatgaaactggaagtgcattaagagtaataagacctaatttgaagtatccattacaaagagctcgtatggccatagtaaatcattcgctccaggatattcttcaaaaaaactaacttcttatcatctcttctggccttctcagctgttctcaaatcattaagaagcgctcgtggagaaatgaatgactgtgagtttgttgctgcaagcactttcgccactgccagattctgtttatctggcgtcgctgccaaaaaagaactgtacttgctggcaggagcaaatacatctgagcttctggtatcaagagagtattttacgtataggcttcggtttccattataaaaagctcagtacttcatcaaaaatccgaacctttttcttttcctcgtttgtcgtctgtatacaatattttgagtgttttcatcctgaaatgatttcattgagaactcataccagacgtcaatttccgaagtgtccggataactgatcgaaattgtatcagaattcgcgcataatcagcacaatgttaatatagttcacaaatcttctggtactctttgaccacacattaaatactttaaaagctgaatggcataataagtgctgttttaccagaaccgttctgaccatataaccaagaacacttgccttgtaatttttacttttattttctaaattcagtgttcctttttttacattcttgaagttctgaagttcaatatcaattatccctacagagccttcatcgccataatcctccgactattttccttatacaatgttcaatttaaaatcatttctttgccgcacaatccatataataaatttgtttttgtttttgtcaattatatattgtatatttggaattttttgtttcatttttgctgctcgtattataattatcaaaattaagccgcatctcaacaaaaggatcaggacggtgtatcacgtttacggcgttattgctggtcttgaatacgtatgcaaggtctggaggttcccctgattcacatatcaattgttgattttatcgccagcatttttcagctcatccagatatcggttcagggcatcctgccatgtcggaagcggagtaaagccgttccttacgagcttactctgtcaagtctggagttgaacgggcgttcgccttcgaaagaccgtactcttcagtagtcacaggtacaactttagtcgaatatccccctgcctatagatctcacaggtaaagtcataccaggaaatatagccgccttcatttgtagcgtggtaatatccgtacttatcagacatgatcatatccactagaagccgcgcgaggtcgtacgtataagtcggagttccgatctgatcgtctacgacacggaccgtgtcgtgggtctttccgacattaagcatctgtcttgataaagttcttgccattcaggccgaacacccaggcaatccgtaatgaatatttggaaagtgtgtttgcgacagccagctcaccttcaactttgtctggccatagacgttcagtggctggtaatccctgcagtcgggatcccacggagtcgtcccctgcccattaaaaacataatcagtggaaagatagagcatcttcgcgtcaatcttcttcgccgcattcgcgatgttctgatgtccgcccagcattgacagcgcgtaccttcgccaccttgtcatcatcctcagccatatccacagcagtccatgcagcacaatggaggaccgcatcaggatgaatctcctcaatggccttctcaaccgccgcaccgtcagtaatatcgagcgacacatacggcatagtcacaactgccgattcatcctttatcccagcatagcgggagcgatatcgctcccgacaccttctatccctctcttcgcgagttcattcatgcaatcgtgaccaagctggccagcaacgcctgtaacaaaaactttcattgggtctccttagttttattcgtaaaaatatagaaaatttttcatcacaatataatacattaaatccaaaataaattctactacctgttacctaaaacacaacatatgtgccaggcaccaatgtggtacacttagcgtcaactaactaattgcatgtctccaggatttttgaatagcatttttataatgtttgaatatctgccacgttttgaaggtgattttttggcatgcttaataagctgtcaatagttatggcgcttgaactatttgaaagcttttattattgcgtcgcggaacttttataaagctcgttttcgttttagaagtgctcccgctcgcgggcactgatttcttttttcgagattcctccttcctggctgtatctgggagtgataacacatgcgccttcaaatatgtcatccaacaacgagagctcacatgcttttgcaataaatcgggctatgaaccacttcatccggcctaatacatatgcccttttggcctgatagcgatatctgtttccttcttttctctgggaatcgatcttatcgtcagcagcgctttttaccatggcagacaggtttgagagcagcaaattgatataaaattcctgctcgattgaagtgcttgttgcacctgagaattcctcaagcaggcctgatgcttcaattcgccgtattttgactctatcggccagcgcataaaatacagttctttgaagtcatcagctgtcagatcctcattaaagatagtttgtagccaggtactctgtaacaccgccgtcaagcgggatcttgatgacacgaatgtcaatgtcttctgtacccttcttcttgtttccaggcaaggtgaggatacagtcgccggtgcactgcttcgcaatcttaaaactgtctctgatgcgcatcacgcagagataacctctgtctgagaaatatctgaacatggcatcagagaaatagccacggtcaaatatgaccacggaatctttgaatagatcaagcttttcgagctcttcacagtgctttaaagcagcgtcacgttcagagcccagatagcgtttgattatgccatgacgacgacatcattgcaactctatatggttgagcagagagcagagtccattttcgattggggttgttatgcgaaaacatctctccatagttttcgaagtttgactttgaatttggcagtgtgatgcgcgatccatcgactgcaaagatgtgatagagatcatgccatttttttcgctttttaatggagctgtagtaggtgtctacgggagcatcaaacagttccttgaaaagagatggtagaatgccctgcctggctttggaaacggcctgttttgtgactttcgggaattcgagctgtggcagatcaagcgggatgtttgccaggtttatgctcataggctgctttgaagtatagagcagatagacaatgatatgagtcattgtgaggagtcctttccgaataaccgttttttcagacgatgggattccagaaaatcttctgaacggatcaattcggaaatttttgtgcaggatcttcctgcagatggatagtgaattcataagtacctccaattgataaagaattgtcccgtccctgtgacgaacatttgcctttaatcaattggccgctttcactacctcaagatttttcagtagtgaaagcggccgcacatttggagctttatgtcaagtgttttttgttaatttgcagaaatctgcgcatgaaaaaaagccaggaaagcccaatttacgggctttctggcttaggttgaccacgttggtgccaggcactgttaccatgcgtcgggaaaaaggtcaataggttccatgccgttttaataattgttaataatgtttattttttgtttgaataaaacatcgaacacggctgcgcaaattattaaaaataatttaactaaatggcaacaaatccatagaatacaatgatttgacagaaaaagtaatcgatttgatttagtttatcaattgtttatttttagatttttttttgatactgcttactgtaggtctttaataacttttactgccaccccctggatttcacaatgcgaaacgataatatcatccaaactgtcattttccggttgaaggcgaatccgctgcttttcaggctccggataatatcgtttcattgtcgcctcttcttctatcagcgcaactacgatttgacctggctcgtgcgtatcctgcttccggatcaacacgagatcaccagtgtttataccggctctccatggattctccatcggctcgtagcagataaaatggtccttcaccaaaagtgaaacaggaagagacacatatccctcgatattctcctcggcatacttcggtacaccgcatgccacatgtccgagcagaggcacctgcatagtatgagtattgaaggctagctgcttctttgttcgatagcacctgtgtcccttatagtcgatcatgccatgctcgcgcatgtactgaagatatctgccgactgtcgcataagggatatttgttcctttgcaatacactcctgtcgtaggtgacacaccgtaactactccagtagtactctataaaattttctaatcgggaaaaactcttctttcttgtgttgcatgttaccgtctctttcactatgagatatttatctcacttacagataaaattataacccgcacagagccgggttgtcaatagaaatgtgaatatttgttcgtgaatatattaagttaaaatcattttaagaatggccgagttttaattcgagctactacacaacaacaatgataaatatacctgtagtcataatgtgtgggtctcgaattaaaaactcgggcccattctaaaatgattttaacttaatagattccgaacaatatcacatttctattgacaacccggctctactgcatgggttctaattttattctgtaagtgagatcaatatctcatagtgaagagacgtaacaatgcaacaccaagaaagaagacgtatttttccccgattaaaaatttttatagatgtactactggagtagttacggtgttgtcacctacgacagagtttattgcaaaaggaacaaaatccccttatgcgacagtccgcagatatcttcaggtactatgcgcgacatggcatgatcgacatataagggacacaggtgctatcgaacaaagaagcagcgtagccttcatactcatactatgcacggccattctcgacatgtggcatcggtgtagtctcgaagtatgcgagagaatcatcgaggtatatgtgtctcacttcctgtgtttccactttttggtgaagcgaccattttatctgccgagagccgagggagaatccatgagaagatgccggtataaacaaactgtgatcctcgtgtgtgatccaggaagcagaataccgccagagccaggctcaaaatcgtaggttgcgctgtatagaagaagatgcgcacaatgaacgataattaatcgcggagccttgaaaagcagcgggattcgcccttcaaccgaaaatgaagtttgggattgatttatcgtctcgcattgtgaatccagggggtggcagtaaaaagttataaagacctaccaggtaaacagtattcaaaaataaaaatctaaaaagaaacaatggataaactaaatgcaaatcgattctcttttgctgtacaaatcattggatgtctatgctttggttgccatttagttaaattagtttttaataatttgcgcagccgtgtttcgatttttattcaaacaaaaataaacattacttaacaattattaaaacgcatggaccttattgaccttttttcccgacgcaatggttaacattggcctgcaccaacgtgtgccaacctaaccagtaaagcccgtaaatgcgctttcctggcttttttttcatgcgcaatttcgtgcaaattaatcacaaaaaacacttgacatacagctccaaatgggcggccgctttcactactaaaacatctgagtagtgaaagcggccaattgagtaaaaggcaatgttccgtcatcaggacggacaattctttacaatggaggtccttattagatcactatcacatctgcagaagagtcctgcaaaaaattccgaattgtccgtcaagaagatttttctggaatcccatcggtctgaaacaacaggtttaattcggaaaggaccgccttcacaatgactcatatcagtgtctactgcctatacttcaaagcagtcctatggcataaacctgcaaacatatcccgcttgttcctgccaacatgctcgaattcccgacagtcacaaaacagccgtttcccaagccagggcagggcattctacgctctcttcaaggaactgtttgtatgtctccggaacctactacagctccattaaacaagcgaaaaatggcatgatctcgtatccgacgactcttttgcagtcgatgatcgcgcatcacaactgccaattcaaagtcaaaccttcaaaactatggagagattgtttttcgcataacaccccaatcgaaattggaactcttctcttctgctcaaccatagtatgatggctatgcaatgatgtcgtgctgttcatggcataataaacgctatctggggcctctgaacgtaccgtgctttaacactgtgaagaaagctcgaaagcttgatctattcaaggattccgtgtgtcattttgacacgggctaggttgtcaccttctgatgccatttcagatatttctctacagacggttattctctgcggatggcgcatcagagacagctttaagattgcgatagctgcaccggcggactgtatcctcacctgcctggaacaatgagggagaagaaagggaggagggggaaaaagaaaaagaaataaaagaaaataacagatccagaggggaaagaaagctaagaagcaaaaaagagcggacacaaaagcagaagaaaaaaacgaaatacaaccagataagagaaggtagaagcgaagggcaaaaaaaatgaaaaaagagaataaggatatacgaaaagagagcaaggcattaaaaacaaagagagaagggagaggtgggggggaagaagagtaaccgagaaggaacacagcagaagagaaaaaagcggtgaaaccgcgagctggggatagtacgaaaggagaaagcgaagagaaaaaaggagatacaagaagagataggaagagggggggaagagcgaaaaaagaggagacgaaacaggaagggaacgacgaagaaggaaagaaaatcaagaggcaaaagccaaaggaaaaggaggagaaggcagcagagagaccgaagcgagagactaaagggaggaacaatcggggcgaccggacaagggaaaacacgaagaggaaacacgagaagaaaagagaaaaggatcagtgaacgaaagcaagggcaagcaaagcaagaggagcgagaaggaagtaaacaagaaagaaaaaggggggaaaggaggggggtaaggagagacggggggcacgaaaagaacaaagaacggaaagaacaaccaagaagaaaaaggaaaaaaagaagcaagacaagcgtgaaagcaaaaggagggcgacaaaaacgacaagaagaaaaccggaaaaaaaggaaatgcagtcaagcaaaaagaaaaataaagaaaaaggggaagcaaatgagaagcaaaagaagaatacaagaagacggggggacggaagagacgaaacaagaaaaaacagaggaaagagagaaaatgaaacgaaaataaaaacagggcaaagagaaaggaaacagagacaacgaaaaagccagaaaaagcagggagcaggagagaagcaaaaagaggacgtagggaaagacaggaaaggggaaaagcgtagagaaagaggaaagcccaccaagaaatgaagccaaaaacgcaagaaagacgaaagcaacgacagaaaaaaagaacgcaaaaacgaacggaggaaggaagggaaggaagaaaaatggaaacaggtagaagaacaaagagaaaagcgaaatgcaaaaaaaagaaagaaacaaaagacgaaaaaggggggagaggaagaagaagagggaataacaaggatcagcaatagaagaaaaaacaaagaaggaaggaagaagaagggtacaggacaaggacattgacatcgtgtcatacaagatccgcccgcttgacggcgtggtacatacctggctacaactatctttaatgaggatctgacagcttgactgtcaaagaacggttttttgcgcgtggccgatagagcaaatacggcgaattgaagcatcagtcctgcttgaggaattcctcaggtggcacaagcacttcaatcgagcaggaatttatatcaatctgctgctctcaaacctgtctgccatggtaaaaatgcctgctggacgataagatcgattcccagagaaaagacgggaaacagatatcgctatcaggccaacaggcatatgtattagggcggatgaagtggttcatagcccgatttattgcaaaagcattgagctctcgttgttggatgacatatttgaaggcgcatgtgttcaatcactcggcagatacagccagaaggaggaatcctcgaaaaaagaatcagatgcccgcaagcgggagcacttctataaccgaaacgaagctttataaaagttccgcgacgcaataataaaagctttcaaaagttcaagctgccataactattgacagcttattaagcatgccataaaaaatcaccttcaaacgggcatatattcaaacattaaaataaaaatgcctagtcaatcctgagacatgcaattaagtagttgacgctaattgtcccacattggtgcctggcacatatgttgtgttttaggtaacaggtagtagaatttattttggatttaatgtattatattgtgatgaaaaaattttctatatttttacgaataaaaactaaggagacccaatgaaagtttttgttacaggcgttgctggccagcttggtcacgatgtcatgaatgaactcgcgaagagagggatagaaggtgtcgggagcgatatcgctcccgcttatgctgggataaaggatgaatcggcagttgtgactatgccgtatgtgtcgctcgatattactgacggtgcggcggttgagaaggccattgaggagattcatcctgatgcggtcatccattgtgctgcatggactgctgtggatatggctgaggatgatgacaaggtggcgaaggtacgcgctgtcaatgctggcgggactcagaacatcgcgaatgcggcgaagaagattgacgcgaagatgctctatctttccactgattatgtttttaatgggcaggggacgactccgtgggatcccgactgcagggattaccagccactgaacgtctatggccagacaaagcttgaaggtgagctggctgtcgcaaacacactttccaaatatttcattgtacggattgcctgggtgttcggcctgaatggcaagaactttatcaagacgatgcttaatgtcggaaagacccacgacacggtccgtgtcgtagacgatcagatcggaactccgacttatacgtacgacctcgcgcggcttctagtggatatgatcatgtctgataagtacggatattaccacgctacaaatgaaggcggctatatttcctggtatgactttacctgtgagatctataggcaggcgggatattcgactaaagttgtacctgtgactactgaagagtacggtctttcgaaggcgaagcgcccgttcaactccagacttgacaagagtaagctcgtaaggaacggctttactccgcttccgacatggcaggatgccctgaaccgatatctggatgagctgaaaaatgctggcgataaaatcaacaattgatatgtgaatcaggggaacctccagaccttgcatacgtattcaagaccagcaataacgccgtaaaacgtgatacaccgtcctgatccttttgttgagatgcggcttaattttgataattataatacgagcagcaaaaatgaaacaaaaaattccaaatatacaatatataattgacaaaaacaaaaacaaatattattatatggattgtgcggcaaagaaatgattttaaattgaacattgtataagggaaaatagtcggaggattatggcgatgaaaggctctgtagggataattgatattgaacttcagaacttcaagaatgtaaaaaaaggaacactgaatttagaaaataaaagtaaaaattacaaggcaagtgttcttggattatatggtcagaacggttctggtaaaacagcacttattaatgccattcagcttttaaagtatttaatgtgtggtcaaagagtaccagaagattttgtgaactatattaacattgatgctgattatgcgcgaattctgatacaatttcgcatcagttatccggacacttcggaaattgacgtctggtatgagttctcaatgaaatcatttcaggatgaaaacactcaaaatattgatatacagacgacaaacgaggaaaagaaaaaggttcggatttttgatgaagtactgagcttttcttataatggaaaaccgaagcctatacgtaaaaatactctctttgataccagaagctcagatgtatttgctcctgccagcaagtacaagttcttttttggcagcgacgccaagattaaacagaatctggcagtggcgaaagtgcttgcagcaacaaactcacagtcattcattttctccagagcgcttcttaatgatttgagaacagctgagaaggccagaagagatgataagaagttagtttttttgaagaatatcctggagcgaatgatttactatggccattacgagctctttgtaatggatacttcaaattcaggtcttattactcttaatgcacttccagtttcatttaagtatcatcatggcaaaaaaagtgatgttggaaaaattatgttgcaacttaacgagcctacagaaattgatgaccagtcatttaatgtaattgatggagtaataagcaatctggatgttgtactgactcaaattgttccaggattgaagattcaggtgaagaatcttggatcgattgtatcagaaaatggcaaaaagggacataggattcaattgatgtccactagaaacaatagaacaatcgctttgaagtatgaatcggatggcatcaaaaaaattatctctgtattacagcttttgatagttgtttataatgattcctctattacggttgccatcgatgaatttgacagtggtatctttgagtatcttcttggtgaacttttacgaattatttcagagaaaggaaaagggcagcttatttttacatctcataatctgagaccccttgagacattaaataatggatttgtagctttcacaacaacaaatcctgataacagatatgtccgccttacaggagtcaaagcaaataataacttgcgtgatctttatttccgaaatattgtgcttggaggacaggatgaaagactgtatgacactacagataattcagagattgcgctagccttccgggaggcaggtgagatccttgcgtcataagaagattgtatcggattttgagagggcttgtcatccgaaaaaaaattaagaataatgatttatcgtagtagaatttccggcggatttaatgtattatattgtgatgaaaaagttgacacatttttataattgaaggatgactattcgtccgaagggataggaaagatatgaataattttgaaaattcgaataagagaaaggcttcagggcatcgtagaaaagctgtgcgcatcgtgatcatatgccttatcgtgcttatctgcctggttggcatttgcggtgtcatggctttacagtcggcgaaaaagatgaagccgcgcgtcagaaatatcagtactgagatgaaagcggcagtttctgatctgaaacagggcaaggctgacgatgctgtatctaagctaacgaatgcctcacaggaaagcaaagagataagtacggaaatgcagggaccggtctggaaagtgatggaactggttcctggtattggaaagcagattaagtccgcccggactgcgattggccttgtaggtgagacagacaataaggtccttcttccatttgcgaagcttgcgaagaagtatccgatgacagcgctgaagactgagaatggctttaatgcgaaacttctggtcgcctatatgaatttcgcggagcaggtacggcctgaggttgacaagatctcagagaaaatggatactgtcgatgtctcgatgctcggaattggagacaaagtagcttcctacaaaaagaagatatcaaaactcaataataatttagatacctatctgcctttgtttaagaccattgttggtaatggctctgaccgcaggtatctgctgatagctcagaacctggccgagggaagaagcatcggaggcttcatggggtccgctgcagaagttaatgttaaaaacggagaactgatcatcggtgattttcataatgcatctgaaacgctgccaagtggcaggataccggaaaatgtggcggagacgaaagaggaagtcgtactttttgacggagaaatgcgaaacagctgggatgcgaattacagtccggactatgaaagagcggcacagatctgggctgcatgttatgaaactcagcacaataccagtctgaatggcgtgctctctctaaataccaatatcatcccaaatcttctgaagacggcggataaagagctggtcctctcggatggaacaaaggtcaacagcagcaatgccctgcaggtgctctcgcatgacctttattataagtacttcaatgtcgcaaacgcttcatccagatcgaatgtaaaagcggatgctttatttgccgaaactgctaccaaggcgcaggctgcatttctggacggcttttctattgacaagacaggtcagtacaaagcatttctcgatgatgcgatcaaagagggaacgctcctgggctggatgaaggacaagaaggaagagaaggtgatgatctcttccggagtatccggaaagcttaaagatactccggagtcaaaatggacgacaggtttctactggaacttcgatcctgcgaataagatgggctggttcatgaatttaaagacttccattggtcagaaaaagaagaacagtgatggaagtgttacttatgaagtgaagggcagcatcgagaatatctttgacacatctaaagatatgacggatgcaagcagctatatacttggcggctatcatggaaatctccaggggcagcttcatctgatcgctccggagggcgcttctataggaaatgtcaaaaccaataatggccttacgcttacaaaggcttcctatatgggacttgaagactactacggaatccgtgttaaagtcgcgccggggaagacactcgagatcagctatacggttacactacctgccggtgtaaaccataagcttcgcgtcagggaaaccccatctgttacttcctacaggtcggagtaaggacctgactgaaattttttaaaaaatatataagatataagtctggtatgtataagcctcccggtcacgatgaccgggaggcttttttattgcaaacgggttgcactaatgctataatttttgtaaattttgaaagcatttgaggaattttgatgaatagtgatacagcggcgatcgttgttacgtataatagaaaagagctgcttgctgagtgcattgagcatttgcagaagcagacttataaagcggatattatcgtgatcgataatatgagcactgatggaacaccggagatgctgaagccgctggtggatgaggataagatcatctatcattccaccggggcgaatctcggcggtgccggaggctttttcgaggggataaagctcgcctacaagctcgggtacgagtatttctggctgatggacgatgacagcatgccgacgccggatgcgctggaacagcttaaagaagcgggcgataagcttcagggaaatttcgggtttctctcgagcagggtcgtctggaccgatggcagcatctgccttatgaatgtgccgaaggaatccctctataaaaaagtggacaattttgatgacccggtcgtaaagataaagatgggcacttttgtgtcattttttacgaagagggaagtagtagaggaggtcggacttccgataaaggagttttttatctggggagacgatgtcgaatacagccagaggatctcacggagttatccgtgctaccttataaacacgagcagggtcgttcacaagacgaagaacaactatggctcaaatatcgcgaccgatgatttcagcaggataaagcgctacgagctggcgtatcggaacgaggtttttctctaccgcgaagcgggggcgaagggttttttctaccagactgccagattgtgcctgcatgtatttcgtgtgatcgcgaaagctaaggaccacaagagtgagaggctgcacacgatctccgcggggacgaaagccggtttcaaatttcatccggagataaagagggtacagaatgaaatgtaatgcctttagatccagaaggtttggaatgagtcacggagcctggaaggtacgaagatgagttacagggttttggaagtaaatgttgacgatataggcttcagcggggtctactcgctggtcgcaagcgtcattgcaaataaaccggctgatattcagatagatatagctgcttttgagcattttgaaaacgaagagaatattgagaaattagcgtcatacgggactaaggtcatctatgtcggatacgaggggagcaagattattaagcagcatatgatctataggcatctgcttgcatatcttcgcgaaaatcactacgactgtgtccatgtccattccgacgtcgcgagcaaactctatatcgctggcagagccgcaaaggaagctggcgttccgaagataatatttcactcgcacgccactgaagtagatgggaattacaagagcatcaagagattcatgcataaggtcacgaggcctaagctcataaaattcggcactgattttgtcgcatgctctgatctcgctgcccggtggatgtatcccgggattcctgagaaggatataaagatcataaataacggcatagacctcgggaagtttaagtacaaccctttagtccgcgccagagtgcgggagaaattgcactttggcgatgagcttgtagtcggtcacgtcgggagattctcctatcagaagaaccacgagtatattatcaggatttttaagaacctgctggagaaggtcccggatgcgaagcttttactgatcggtgaaggcgttgataaagagcgtatcgaaaagctggtaaaagaggagaagctcgaaaagaacgttattttttacggtcttagcaaccatgtcgaagagctgcttcaggcgatggatgtctttatcctgccgtcgcatttcgaggggctgccgatcgtcggagttgaggcgcaggcagcgggcctgccggctgttttttcagacaagataacccgggaggcgaagctccttccgaccgcggcttttctgcctatagatgattcaagcatcggcgactgggtcgatacgataataagtgattcgaaggtcgagagaaaagatacctcggatattttaaaagaggagaagttcgatatttcggatacgatgaaggcgtttttgagcctgtacagatgaataattaatggataataaaatacattctgtcaagtataacttcataatgaactttatactgacagcctcgaatttcatctttccgctgatcacgttcccgtatgtctcgagaatcctgcatgcggccgggaatgggaaggtgaactttgcggcttcgcttgtcaattactttgtgatgcttgcttcgctcggtattccgacctatggtgtcagggcctgcgccaaagtaagagatgacaggcagctgctgtcgaagactgcccaggagattctgataatcaatgcggtatccactgcgcttgtcacggtctcgtacctgatctgcctctttactgttccgaaactcgcttcggacaaggaacttttcctgatagagggcgccaacatcattttaaatatggtcggggcgaactggctgtaccaggcactcgagcagtacgactacatcacgcgccgctcgattatcttcaagctgatatctgttgtcctgatgtttgctctcgttcatcagcagtcggactacagaatctacgcggctacgactgtgctggcttcggtcggctcgaatgtgacgaattttatcaggcttagaaaatacatctcattcagaaagaccggcagatacgatttcaaacagcatctcgggccgatcttcatcctctttgcgcagagcgcaacgataagcatctacacgaatctcgacactgtaatgctcggtgcgatgaagagcaatactgatgtcggactttataccgcggctgtaaagatcaagacgatcctggtgtctgtcgtttcatcacttggcaatgtccttctgccgcggatgtcgaactacgccaacaaacacaatgaggacgaattctatcgcctgcttggactggctatgaatgcggagcttttcatgagttttccgctgatgctcttctttatcatagaggcgaaggactgcatgatgtttatcgcgggccctgagtacgtggctgcgaccgcgaccatgcaggtcataaatctctctgtgatcccgatcggtctgaccgggatcatcggggttcagacgcttactgcactcgaccgcgagaagcaggtgctctacagtgttatagtcggtgccgtgacggacttcgtactgaatctgatcatgataccgggattttcacatttcggcgcagcgtttgctacgatggtggccgagtatctcgtgttcgtcgcccagctgatactgggacgcgatgtggtaggacatactttcaggcacctttcatttcttaaatatgggctgaccgcagcacttgcttcggtatgcgcactgcttgccatgcattttttaaactggaacgcgctcttaaggcttgtgatctcagcggccattttcttcggagtatatggaatcgtgctgatcctcttaaaggatgaactgatgaagagggctatgagtgtaagggttcatagaaaaaactgatcgtaattataaaaaatgaataaagatactgataaaaaaggcaaattttcaataatagttcctgcccacagtgaaaatgagatcctgacgcactgccttgaaagcctgacagatcaggactacgacgatatcgaggtgctggttatcctgaatgcggcgacggagcagaccagagctgccgcgcgtaaatcagctgaggaacatccggaaatcaagatattcgataccgatgtggcgggagtttccaacgcgagaaatattggcctcgaaaatgcgaccggtgattttatcgggttctgtgatgctgatgactggtacaatcagggtgttatcagaaaagccgctgaggtctttcacagtgggcacagtgatatcgtgatgtttgggatgagctgtgtctggccagacggtaagacagtggatgttctgaaaggcaggaatctgaagctttctgatgaggatttcgtcattacaatacttaccgataaaaaaatatacgggtatttgtggaataaatttttcgacaggaaattaataaaaaatatcctctttaatgataaaatgacgcttatggaggatgctgagttctgccttaaagcagcgaaaaataacggccacctgaaagccgattacatcaatcagattggatatttttattttcagaatccaaacagggcagtagacaatgtgataaggaattcaaagcacggcaggagcggatttatcgaatctttagatgtcatcgcagaggaattctcgttttctaaggacgaagaacttgctcttagtgtggccagaacgaggtttgcttttggccctctggtgatgtatatgcaaaataaaattgagcataaacctgaattcaggagtatgatacaaaacgcccggcatgaatttttaaaaaactgccattcgatttataaatttaaagagtgcactaccagcgaaaaactaaaaacattcgctttggaattgctgatgcgcatcaggaaaatggagtagaatatgaatccagaagtttctataattgtgcctgtttacaatgtggagaattatctcgaaaaatgtgtcaacagtctgctcagccagacttacagggatattgatatttttttaatagatgatggttctacggacaactctgtaaaactatgcgacgaactgcagaaaagagatgatcggatccgcgttattcataaggaaaatggcggctacggtagtggcctcgaaattgctgtaaatagtatttcaagtgaatattttctgatctgtgatcctgatgactggctggaaccggaagcggttgagacactccttgctgcgatggataagtacaatacggactttgtagtaggcaggagaaaactggtttttgctgatggcacggtaaagagtgacagagattttttttcacatcttaacagtgataaactatacaccgatctgtctgatttcgttacgattccgcagagtcctcactcaaaattatacaaaactgatctatgccgcggcatcagtttcccaaagaaagtaagctacaccgattatttactgtatcaggtttatctgaccagaatcaagtcggctgtctaccttgataaggagctttcaaattatttcttcgacagacctggcaacactatgaatgacgatgctgctttaagtgagaaggctgtaggatttcattcgattgtctctcttgccactttcaggcagctgaataagcagtcgcctctttacaaatattctgtggtgaattcatttgtcaatgcctgcaagtggatggctctgatcaaaaaaaatcatattgataatgacgaatactacaatatgaatcttgaaattgtaaaagatgctgaattttcaaaagatgatctggaccgcttccttaaggacaataccagcagcaaaataaaatatttcacaaagaggatgatttattccggcatgctggatgaaaagaagcgcaatcattctcttgatttacttacgaaatttatctgaaaatcagatacaaagcgcgaaggcgctgctatgaggcttttgagaagaatgcctcgcctgactctttcactgtatcggccggcggcatcagaagcttgactattttattaatataagataagctatttttcgtaattatgaaaaaaagcagattttcgtaaaggagcagatggaatatgtcaaatgttgcattgatcattgccgggggttccggacaccgcatggggcaggacatcccgaagcagtttattaatgtctatgacaaaccggttattatttatacgcttgagagttttcagaatcatcctctgatcgacgcgatcgaggttgtctgcctcgacggctgggacaatgtcctctgggcttatgcgaagcagttcaatatcagtaaactcaagtgggtcgttccgggtggaaattccggccaggagagcatccgaaacggcgtctatggtctcgaagggaaatgccagaaaggcgatatcgtaattattcacgacggcgttcgccctctgatcaacgacatgatccttaccgatgttgtccgcaccgctgagaaatatggcaatggcgttacttcccgccctgtaaatgagcaggtcttctgcgtcggagaagacgacagcacgacgactacctcttacattccgcgtgagaagctccgcatcgtcgccactccgcaggcttacgaattcgagaatctcgacaggcgctaccacgaggctttcgagaagaatatcggtatcgatggctcgaactacacgaacacgatgatggtccagctcggcgagaccctgcattttgccactggctctgatcggaatatcaaacttactacgaaggaaaatcttgagactttcaaggctgtcttgaagtctgacaagagtgactggttgaaataatatgatgacatcattagaacttgaagacgttaaaactatcgctgagctcccttacgactgggacaagctcaatggcaagactctgctgatctccggtggtaccggttttgtcggcacttttatctcggacgtgatccgctacagaaacaagcacttcggcagcaacacgaagatcgtctctctttcccgtcacggcggcgaatcagacgacactgtgacgaagcttgccgctgacatcacgaatccgatcctttacgacggcaaggtcgattttatcctgcacctcgcctcgaacacgcatcctgcgcagtatgcgaaggacccggtcggcacgatcacgacaaatatcattggctgcgacaatctccttaagctcgctgtcgagaagaagatcgagcgcttccttctcgcctcctcggtcgagatctacggccagggcaccgaagctcctatggatgagaaatactgcggatacatcgactgcaacaacgcccgcgccggctataacgaagccaagcgcacctgcgaagctctctgccgctcatacgaatcccagtacggcgtaaacgtcgttatcgcccgtctcgcccgtactgtcggcgccgaccacaagaaggacaccaaggccatggctcagttcatggacaaagctgtcgccggcgaagacattattttaaagagcaaaggcaaccagcggttctcctattcctacatcgccgacaccgccagcggcgtcttaaaggtcctgctcgacggcgcctctggcgaagcctacaacgtttctgacgaagacgagggcatgactctcggcgactacgctggctttatggcgagactcgccggcaaaaaagtcgtctttgacatcgaagagaacgcaagcgtctcgaaagcaagctacgcgctgctttccatagacaagatcaaaaagctcggctggaagccgatgtactctgtaagcgacggccttaagagaacgtatcagatctacaaggaacgctgatttatttatttggtgttacaacgaaatgaagaaaaaaattctgactgttttgatagttctgactctcgccttcatctggggccattccatggtgcctaaaacgtactctgcagaggagagcggccgcttcttgaaattactcaagccgttcctttctctttttctggatccgaaagtggtcactgaccatctgatcagaaagatggctcatttcaccgagtacatggctctcggaatggaaatccgtgggctgatcgggattaagtctaaggaaggtttgaatgtgcctgtggggatatttcacacctctctgattcaggcgacgaagtacgtattttttgctgcgtttctcgatgaaacgatccagattttcagccacagaggctcgatgataagcgatgtctggctcgacacctgcggcggtttctgcggggcactgattattacattgattattatctttatagaaaagaaaaagcggcgccggtcctgatggacctgtgccgcttgcttcagctttcgggtttatttcagcatgtcgaggatctgcgccttcgtgtgcacaccgaccgcctgttgaacaacctcgccattctttataacaagtaatgtagggatgctcatgacattgtacttctgggcgatctccgggttctcgtcgacatcgagctttccaaccttcacatcttcgagctcatcggccagctgctccacgatcggtccctgcatacggcacggagcgcaccatgtagcccacatatcaacaagtaccggcttgtccgactttaatacttcatcttcaaaattatcagtagtaaacttcaatgtagccatttccaatctcctttcggttgtcttatcgacagctttgttttaacactagagacactataccacggaattaaattgtgcgcaatacatttttgcaaatttctggaattttttgggacagaagggacggttctttttgtcccacttttgggattgggacaccggggacggttctttctgtcccacttttaggatggtgggacagaaagaactgtcccttctgacccgtcgaaagaaccgtccccctgatccgtaaagtgggacaaaaagaaccgtccccgctgtcccattagacgcgggccagagaggcgattcgcgagaggatgttgtccgggatgaggccgctcagtatataatcgaggaatgagacgattgacggagtagatactataccgcggcgtttgatcgtgcgcaggctgcgtctgatgacggtttctgttcttactgagaggaacggtgacgacttgtggcctgaggctgtctcgatgaaacgagtgtcgcggacccagtatgggcagacggctgtgacggtgatttttttcgggagaagctcctggcgcagcgcgcggctgtaatttaatacaaatgccttggtggcggcgtaggtattgaagccggccatcgactggaaacctgcgaccgacgaaatatttacaatgcgcgagcctgccgtcatatacggcaggcaggcatggatcatggcgactgtagcggattcattcaatgtgatcatgcgctgctcgccgtcatttccggcctcttcgcttgtcctggaaaggcccattcccgcggaatttatcagcagcgaaacttcgcaacaggcctccttcagggctcctgtgaccttttcaaatgattcctttgctgtcaaatttgccggcaggatgtggcatggcactttggcctcgtctgcgagcgccttcagcctgtcctcatttcttgcaatcagccagaattcgtcgatatcaaattctgccatctgctttgcgagcgctaaaacatatccgcggcctagtccactggatgcgccggtgataaccgcgatgcgctttttattggtctcatgctttttgtaatggcggaggcgtgcgttttcaatcagtgcgatgatgatgcccgcgacgccgagccagaagaacatgttgccgaagatggagacgagtcttcctgttatggatgttataatgtgcatatgaattctacattgtcaagcacttttggcctgaaaaaataaggttttcattgttcctcaaaataaagaatgatcaaatatgttgagcatttctgtgtatctggtacgaaaatagcctatcagggtacactttttaaaacgtcttcatatctcgttttaaaaggccttaggtatacccctgtcagctatggcagcgtactcccatgtctaccgggatctttgtcccaactccttcgttccgccgcccacaaccaggtgtcagcttagctccttttcagggtcgtcctatggaaaaattcctgccgactactggctcattctttgtaaataacttactgaccatgtatcttccacaacagcaccttgcggtggacgtttacctgctgtttccaatggcatagtctttgcctgtgtgctacattcttttacatcgcagctgcctcaacgactcttgctcggctcaggacagctgcgatggcttggtatgctacctatttctgctgccactatctctgtgtccatatctttccttcgtatgttctaagctcttggtgccatcataatctacgccttttgccaggattacataaaagattctgatcagcttgcaggcaaccgcgattatagcctgcatcttctttaacgggttgtcctttcttgtccggtagtaattatacaattccttgaactctgcattcttgcctaccacagatactgctgcttcatacagcacatatctcagcctttttcgtcctcgatagcttatgtgactttctcctttgtgctttccggaactggtctccacattgcgtatcctgcaagtttctgaagctgtcttggatcctcaaaacgtcttatgtctcctacttcagcaacaaacccatacgccgttttttcgcctatccccggttctcaaggagtttgttaacataaggtatatcactggtcttctcattcagcttttctaacagttctgcaaccctatgactgtatttgtcatagtcttccagtagctccgctatctcaatcttgcggctcatgggcggtctgcttccctatgctgttcagcgcagcttcgtaagctcaacagccctcttgtgtccggcgccgcggatttttgctttcctccagatcttctctatgccgtcagctcccagtttcacaatgtcttccgggagaggcgcctcatgaagaatcattatccctgttatcggatcgggctgtgtataaacgcttgaattcagggaaatatatgctgaaccatctcgcaagccttttcgttacgcgtgtcagttcttcctgtgcctggtatctcagatgaaagcaccctcacctctgcatatacaccttccggtatgtagggtatctgtaccttccatctttcaccagccctgctatcacctttggatccttgcggtcagtctcagtggattactgtctccgctctttcgcctgttttacatgatatggattcacgaacggtcctcattccatgagattggagaaatgcgcccaagttgaaccagtaatggccggttggctccattcctggtattacggcatcgagtccattctttgatttgagatcctccatccacgccagaaacatatagtaaccctcttcactatttctaaactcgaagggttccgcagagatctctatccctcttgtagtaacgctctggcgtcatgcttctcacggccatatcgatccccacgatcattgtcgtctctgtgatagccctgatcctggcattctgtgatctgtcgatttgtggcattacttctggtcttgtgttactattcatttgtgatacctctctgttctatatgttttaccaactatgctgagtcagtaacttattttacattgaggtattacttttatcaaccttccttccggaattccttatatatgtattatacagaagctcctttttctgtcattataatgtatttgaggggaggtttcaaaaaaatgtgagcaccttttggcgaagattttcaatagtggttgcggggagagtggtttgctccaaatgcgaattgatgatacgtattattaaaatactgttttatcactattgatacttatttagtccgtttgcaacacacccttgagcaaattgtggtgatttcaacgtatagttaaaataaaaatcaggattggagcgaactaaacaggaaatcgcgcatggtgaaaatgagaaaatgtctttggtacatttgatatctgggtagacctatattgaaagtggtgtggagtagatcgtctgaaaaatcggctatgttgagaaacagccggattgcagagcaggaagattttgaggtttgtagcgttacggtatcagaaagcggtatggtgaaaatttccggctccgcggagcgagaccgcccatctgcgacgctgcttcggctaaaaagggcatattgtgtctgaataatctaaaaatgggacaaagagcggttcgccgtttccgctctgacttcgtcctatggactcgtcagtcgcggacggctatcgctgggcggtttataatgctctcgcttcgtcctacggcctcgcgacagcataacaaccgctccaaccgtccccactgacccacttgacaaataccacgggggtatattatagtgggcagagtgatacccatcttgggtatttttttgagagaaagaagggcaatgcatggagaagtttaatgtgaccggcatgagctgcgcttcgtgccaggcgcacgttgagaaggcggtcagcaaggtgccgggcgtcaagtctgtgaatgtttcgctgctgacgaattcgatggctgtcgacggcactgcgagcgcggcagatattatcaaggctgttgaagatgcaggatatggagcttcgaagcaggattttgagaagcagcagggcggagtgagtgcgagccagaagctggcagctgaggaggaatctttaaaggatacgacgactccgaagcttttgaagaggttgatatggtcggtcatcgtgctgcttgtgctgatgtatatcacgatgggccacaatatgtggggatggccggtgccggcatttttgaaccacaaccatattggacttgcgatcacgcagatgcttctggcgctggttgtcatgatgataaaccgggcatttttcataagtggattcaagtcgctggctcacggcgcgccgaatatggatgctctggtggcgctcggctcgagcgtgtcgttcggctggtcgctttatattttgtacaggatgacatatctgctgaccacaggcatttcaaatatggatctgatgccgctttaccacaacaacttgtattttgagtcggctgcgatgatcccggcgctgatcacgatcggaaagacgctcgagtcgtattcgaagggccgcacgacagatgcactgaaaaatctgatgaaaatggccccaaagaccgctgttatcgagcgcgacgggcagcaggtcgaggttgggattgatgaagtgaagtctggggacatttttgttgtaaagccgggcgagtcgatccctgtcgatggcgtgatagttgagggttcgacggcagtcgatgagagtgcgctgaccggtgagtcgatccctgtcgataaaaatgtggacgatacggtttccgctgccacgataaaccagtccggttttataagggcgcgcgctacgagagtcggcgaggacaccactttttcgcagattattcagatggtaagcgacgcagccgcgacgaaagcgccgatcgcccgcattgcggaccgcgtttcgggagttttcgttccgacagttatgggcattgcgctctttgttttcattgtctggctgatacttggcggcggcgcgatgacttcactcgagcatgcgatcacggttcttgtaatttcctgcccgtgtgctcttggtcttgcaacacctgtcgctataatggtcggcaacggcatgggcgccaagaacggcgtgcttttcaagacatctgaagcccttgaaaatgccgggaaagttcagatcatcgcgctcgacaagaccggaacgatcaccgagggcaggccgcaggttactgatatcatccctgcggaaggtgtaagtgcgcaggaacttttggcgaaggctttttcccttgaaaaaatgtccgagcatcctcttgcgaaggctgttgtcgacaaggctgaggccgacggaatcgaggccgcttgtgcttctgatttcgaggcacttgcaggtcacggactaaagggtataatagaagaaaagacagtttacggcgggtcttctgcatttatttcttcgcttgtaaatgtgccgaaagatattcaggaaaagtcagatgagcttgctgagcagggcaaaacgccgctgtttttcgaagaagacggcaagctggctggaattattgctgtggctgatgtcatcaagtccgactcgcgccaggctgtaaaggaactgcagcacatgggcatcgaagtcgtgatgctgacgggcgacaacgagcgcaccgcgaaggccattggcgggcaggccggcgtggatcgtgtaattgcgggcgttttgccggatggcaaggaaaaggtcatccgcggccttcagaagcgcggcagagttgcgatggtcggcgacggtatcaacgatgcgccggctctgacgcgcgccgacaccggtattgctatcggcgccggaaccgatgttgctattgattctgccgatattgtcctgatgaattcaaagctgacagatgtttctgcagcaataaggctgtcgcgtgcgacccttagaaatatttacgagaacctgttctgggcgttcgcttacaacgcgcttctgatcccgatggctgccggcctctatccaggcatccacctgaacccgatgtggggcgctgctgcgatgagcctttcaagctttactgtctgcatgaatgcgctgcgcctgaaccttttcaaagttcacagtgctaaacacgataaaccgctgaggcatccggcactcccggacaccgcggcttcaaaagtaattgtggcagaaaatgccgtgaatgggaatccggctgcctgccctgttgaaaatatttctggtgagagctcatcagaagcaaatgtatcaggaggtaacactatgaaggaaactatcgaagttaagggcatgatgtgcaacatgtgcgagaagcacgtaagcaacggcctcaagggcatcgacggcgtcacaaatgccgccgccgatcacgagaaaggcgaggctgtgatcgagtccacaaagccgatcgcagaggcagacatcaagaaggccatcgaagacgcaggctacgagttcgtgtcagtcaaggcctgagtcagagaactcttttgatttattgtgggacacggggatgactcctgtgttccactttttttatcattgaatgatgcggagctgaaaattttcactatagcttctacgttggagaaattgctacaaatcataaagatttgtaacaaatcaaaattttttcttttcactatacgtcgaaatcgacctcgtttgctccaacgatgagagcccgttgactcttaaaagaattgtgcaaagagcccgtcgactcttaaaaaaattgtacaatgagcccttcacaactgatttaaaaaattgaagtatcgttttttgctgcgagtctggcgagatcgtcgaactcgcttttttctttatgcacgccgtagccctcggaaatttttttacggattccgttcttgtctgttactactgtgcgctttaatatatagcgattgcagagcgtctccctgattccgatcgtcgtcgtgtgtttgaagatcagcgggactatttttccggtgtcgtcggggcggcagagtacggtaagcagaatgcccggacggttctttttcatgccgatcgcggttgtgaaaacatcgagcgcgccggctttaaaaagcatctgcgtcgcaaagccgatctgttcgcccgtcatgtcgtcgagattgcattttagctcgacgacatgatcggtatatttaccatcgattggagcggtactgtttgaattgatgctctcgtctgtctcaccgagaaacgcgcggacgcagtttgctgccgcaaagtccttgtgtccaatcccataacctgttttttcaatggtcataagagggcgctcttcgtatttctggacgtggcttctaagcagcgcggcgccggtcggggtgcacatttcgccctcgattccgcctgcgtaggtcggtacgccatgcagcaggcaggccgtggccggcgccggaacaggcaggatcccatgcgcgcacatgacctcgccaaatcccgtgcggacaggcgatgcgaagatctggtccggcattattttatgtaaaatataacaaaaattcacgacatccattatcgcgtcgagcatgccgacctcgtgaaaatggatctcggaaaccggcttgttgtgggcgcgggactccgcctcggcgagctgcttgtagacgcaggccgcgtcgtatttgacttcgacggggatatccatgccgttgatgatttcctcaacctgagccattgaagtgtgatgatggtggcttttgtcatcgtggtggtcttgagaagactcttcctgcccgtttatctcaacgtgcatctgcgtcccagtgatcccgcactttgtgacgggttctgaccagacggagacgccttccggggcaatttcgtttaatttttcaatgatggagcgctgctcatcatcgtcaaaaaggtccagcagagaggcggagagcatgtctccggcggctcccatattgcattctaaataaagtgttttcatgcgttcattgtaccatttttcaattgttatggatagatagaaaaacttgacacataccccaatggggtatattatatttttcaggaggtaatatcatggcgcagacagctgcattagataaagaagagaagatgtgtccgcactgcggtcagatgaatacagagggcacggtgggtggctgtgcaggctgctccggcaagacgaaggagagaagctccaaggagaagaaggaccttgtgaacaggctctcgaggatcgagggtcagatcaggggcatcaagcgtatggtcgaggacgacacgtactgcatcgatgtactgaggcagagcgccgctgcgactgcggctctgaacagtttcaataaggtcgtgctcggaaaccacatccgcacctgcgttaaggaaaatatccagaacggcaatgacgaggtgatcgacgagcttgtcgagacgatacagaaactgatgaaatgatgtggatttttgcacattaaatgtcagaattttctggaaatgggacaaaaagaaccgtcccttctgtcccattagagggtgaagcggcggatctcgcagtttcggggtttgggattccacatcagttcgtttttcttgtggccgaggattccgcagaggacacgcatgatcccgccgtggcaggagatcaggacgttttcatagtgctttgatgagagctcatccaggaaggaatgggctctttttttcatgtgggcgatcgattcgacggtcgcaggctccgggaaaatcgtcgggaggagccagaatgaccacatgcgggcgccgaggcgggtgtattttttcttttcgtagcggccaaagtcgacttcgatgatgcgctcgtcctttatgatgtcgtctggtgaaaatccggtcatgattacggcagtgtcgatggcgcgctgcagcgggctcgagtagacggcgtcaaagtggatgcctttaagctgggcggcggctgcggctgcctgttcgcggccgtgggcgtttagcggggcatcggtgcggccctgcatcaggtgggctttattcaggtctgtctgaccatgtcttgtcacataaatattcatatggatattttaacataatttacacaaatttcctattgacatatgataaatagggtggtattatttgcgtacaatctaattagcactcgaacgaaatgactgctaacagcaattttggacgaaggagggaacaagatatgacagttttgcctttatataacgtgatgcttatccctgagacgaacctgtatctccagacgcaggcgtttacgcagatgactggcaaggagcctgagaaccaggagaggctcatcattgcagctctaaagtctgcgaagaagagggaagagatcacagaagacgatatctatccgatcggcgtctcgggtattgttaccgagatcaattctgagcagggctacattgtgatcagaacgaagaagagagccgatattaccgatattactatttttgcagatcacacgataaatgtcaccgctacgcgccgtgaggacactccgggcgaggatgtaaatcctgatgatgagagagccagacttgacaaggtcaagcaggcgatgatcggctatttttcaaattcgcagtacggcaatctgagcaggggctatatcgcacagttcaactcgatgtcggagatcgctgcggccatgagcccgtggctttttaattctgcggaggacaggtacaggatcctcgaagaggattcgaaggccaagcgtctcgatatgatggagaagatgatctatgagaacatcgagatgacgaatattggcaatgaggctgcgaacgcccaggaagctgattaccagaaaatttaccgtgagtcagctctgaagaagcagatcgattatctgcagaaagagctcgatgacatgcaccctgagaacgtttcggatatcagaaagttcgagatcgctcttaaggacaacggcatgaacgaggatgccaagaaggaagccgagaaggttcttggcaggctgaaacaggagggcaagaattctcctgaatatggcatgctctatgattaccttgatttcgtgacgactctttcctggaaaaaggaagagccaaaacatattgatctgaaagaggccagagctgttcttgacgaggatcattacggtctgaaaaaagtcaaagacaggatcatacagcagattgccgtgatgaacctgaagaatcagcaggccggttctattcttcttttcgtaggtgcccctggtactggtaaaacttctatcggaaagagcatcgcgcgtgcgctcggcaggaaatatgtaagagttgcccttggcggtgtccgcgacgaagctgagatcagaggtcacagacgtacatatgtgggagctatgccgggccgtatcatggatgcgatccacaagtcaggcgtttcgaatcctgtaatggtcttagatgagatcgacaagctctctgaatcttacaacggcgatcctgcttcggctctcctcgaggtcttagaccctgagcagaacaacagcttcaccgatcactatatgaatgttccgtacgacctgtcggatgttcttttcatctgcacagcaaatacgctcgatactattccggctcctcttcttaaccgtatggaggtcatccagttccaaggttatactcctattgaaaaggagcatattgccagggatcacctgattccaaaggcttttgagaaggctggaattcctaaggacaagctctctattgatgatgacgccattgagacgatcatctcggattatactatggaaggcggcgtcagaggcttgaagaagcgcatcgacacgctctgccgtattgccgctgtaaagatcgaatctggggaatcaagcgtcactgtccacaaggacgagcttcgtgattatcttgatatgcatccgcttcatcaggataaagtcaaggaagagggcaggcctggtattattaccggtctcgcatggactcaggtcggaggcacgatcctctacattgagtctcttatgactaaaggcaccggaaagctcacgatcactggccagctcggcgacgtgatgaaggaatcggctacgatcgccctttccctcgtcaaagctatgtacccttcgaagatcaagctcctcgaaaagagtgatatccatattcatgtacctgacggctcgacgcctaaggatggaccttctgcaggaattactcttacaacggcgcttgcatctctcgtcacaggcacagctgttacccctcaggtagcaatgaccggtgaagtttcgctgaacggttcagtcaacccgattggcggtcttcctgagaagctgatggctgcccagagatcaggagtcaagcacgtcttcattccagaggaaaacatggaggatctccgcgacgtggcgcaggaagtcaaagacaacctcgagatcaccccagtaaaacaggtgacggatgttctcaacgcactgaatataccagtcgagaatccatcgcttcagaacaacaaataatgggtcaccggggacggttctttttgtcccaaaatcagaattgtcagattttgggacaaaaagaaccgtcccttctgtcccattttttgtgcattattgctacttgactggtataccggtatgccatataatgagcttgttaatgaaagatagagatttccatatttattctcggaaggagcatttaaatgagagtaggttttattggacttggaattatgggtcgcccgatgacgaagaatcttctgaaggccggtgttgaggtttacgccactgatctgaatgcggaggctgtaaaggatgttgttgaggccggtgcgaaggaggccgattatgcgacgatcggcgccgagtgcccgattgtcattacgatggttccgaatggccagatcgttcagtcgattcttttcggcgagaatggcgttgcaggcacattgaagaaggggtcgattgtatgcgatatgagctcagttcttccgacagagtcgcaggtctgctataagaagctgaaagagcagggcgttgcctttgttgatgcccctgtttcaggcggcgagactggtgccattgccgggacgctcgcgatcatggcaggtggcgacgaagaggacttcaaccgcatgaagccggttttcgatatcttaggatcttcagcaattctgatcggacccagcggcagcggttctaccacaaagctctgcaaccagatgatcgtaaacaacacgatcgccgttgtttcagaggcttatgtttttgcaacaaaggccggcgccgatcctgcgaaggtttatcaggcgattaaaggcggccttgcaggcagcgccgttatggaccagaagattccgaagatactggcccgcgatttcaaaccgggcggcccgatccgcataaaccacaaggatataaaaaactgcgtcaatgcagctcacgctctggacgttcccattccctacaccgctcagctctatgagatcctccagacgcttaaggtccatggacatatgaacgacgaccacggcggcatcgtgcagtattttgaaaaattagctgactgcgaagtaaaaagtccagagaaatgaggcctaccatgcatttgacgacagatgtttttaaaaaatataaaaaaatcgacgaagagaagatcgacgctcttttaaataaggagatcgctgcgaacaacaagaagatcgtagtcttagacgacgacccgaccggcgtccagacagttcacgacatttcagtttacacaaactgggatcacgacagcgtaaaggcaggtttcgaggagaaaaacaacctcttctatattctgacaaattcccgcggctttacggcggagcagacgacaaaggctcataaggaaattgccgccgttgtcgatcaggttgccaaagagaccggacgagagtacatttttatcagcagaagcgacagtacgctccgcggacactacccgcttgagacggtgcttttaaaagaggcatatgaaaaaaataccggcaggaccatcgacggagagatcctgtgcccgttttttaaagagggcgggcgtttcacgattgacaatgttcactatgtaaaatatggcgatgagctgatccctgcaaatgagaccgagtttgcgaaggacaggactttcggctacaaggctgccacgatgcctgagtatgtcgaggagaagaccggtggtgagtacaaggccgctgacgtcacctgcatttcacttgaagatattcacaacatggatattgacaagatcgagtcgcagctgatggcagtcagggattttaacaagatcatcgtaaacgccatcggctacgcggacgtcaaggtattctgcgtggcactttaccgtgcgatggcaaagggaaagcttttcatgttccgcacagccgcagcaatcgtcaaggttatgggcggtgtcacagaccagccgcttcttacgaggaagcagatggttgtcaatgagacgacaaatggcggcgtgatagttgtcggctctcacaccgaaaagactactaaacaggtcgaggagcttaaaaaaatcaaagatatcgagttcatcgaactcaatgcgactcttgtaaaagatgaagctgcatttgcagaagaagtggaccgctgcattgctctcgaggagaaaaatatccgcgcaggaaagacagtctgctgctacacgacaagaactcttatcactgcagacacaggcgacaaggaagatgaactgaggctttcggttcgcatttcagacgctgttcagtcgctggtaggaagactctctgtcacacctgcattcgttatcgcaaagggtggaatcacatcgagtgacgtcggcacaaaggctctcaaggttaagcgtgcaaatgtcctcggtcagatcgagccgggcattccggtatggcagaccggcgcggagagcaggttcccgatgacgccatatgtcatattcccgggaaatgtcggagatgcagatacacttcgtcaggcaactgaagttttgatggggaaataatcaggtaataagactactctcattataaaaagccaggtgcagtccggaaattcggactgtgcctggctcttttatctggatattcatgcgaacgccttattgatctggaacgcattattgaagtgatctctttcagcattgtagagtgctgtgagatcattttcttttatcgcatcgagaaccgccctgtgctcttttaatgcaattggcattcgtccactggttttgagggagcgcgcggaaagatttaaaatccagaacgtgtagcgcttgaaaatatcagtgaaatcccgctggtcgatatagcggatcggacaggcatgaaattcataatcaaaattattaaaatccgggatatttcctgaagtgcggtaaatctcctcctggctgtcgagatttttttccatggcttttatcatgtcgactgcactggaggctttcgcatggtagtcctgcatcagaatgctgcagcagaaaaattctatggcgcagcgcatgtcatagatgccccgcatttctttttcagtgatgtgatgaagctggaaaccgcggctcggaaggatgtccacatagccttcccgctcaagacggacaagagcagtgtgaaaaggcgtccgggagacgccgatccgggcgctgatctgtctctcagaatagatggtatccggctggaaatggccatttatcagcatttcaagcattttttgataagcaacatcattaaggttacctttttccacggttatcagctcctttgcagattgaaaattacgatataattgtaaatgattatcgatcttcaaacaaggaaaaagagcaaaaaatcaagggcgggaccaattataaagtggttgagtaaattataaaattattctataatatataggcctattgaattttttacaggaggaaatacagatggcacagaacccggttgttactataactatggaggatggaagcgtgatgaaggcggagctttatcccgagatcgcgccgaatacagtgaataatttcataagccttataaagaagggcttttacgatggacttggttttcacagagtcataaatggatttatgctgcagggcggagatcctgcgggcaacggaaccggcggcccgggatattctatcaggggcgagttcaattcaaacggattcaggaacgacctgaagcacacggcaggcgtgctttcgatggcgcggacgatgatgccggattcggccggaagccagttcttcattatgcacaaggatgcgccgcatctcgacggtgagtacgctgcttttggcaggatcatcgagggaatggacgttgtaaataaaattgccgaggtggagactgactggtctgaccgcccggtagagccgcaggtcatgaagacagtcactgttgagacttttggcgaggattacccggagccggagaaggcctgaatattagattatagaaagattgatgtctttgcgagatttttccagagacgaagaaaaggtttagatttatggatattaatgcactgatcgcagacgaacttaaggttaagaagtcacaagtcgatgcggccgtggaacttttagatgaggggaatactatcccgttcatcgccagatacagaaaggaagttacaggaggtcttgacgacgacgcactccgtgtgctcggcgaacgtcttgagtacctgcgcggactcgaggacagaaaacagaccgtactctctactattgaagaggccggaaagctgacggatgatctcagaagaaaaatagatgttgcccagacactcgcggaggtcgaggatatttacaggccttataagccgaagaggagaacccgtgcgactatcgcgaaagagcgcggactcgagccgctggctgagatcattaagacgcaggaacttaaaacgtctttaaatgatgaggcggaaaaatacgtcgatccggaaaatgatgttcacgttccggaggatgctgtccagggcgcctgcgatattatcgcagaggagatctctgataacgccgatttcagaagctttatccgtgagaagacaaagaacgagggcctgatggtctcagcccagaagaaggagaatgctccttcagtctatgagatgtactatgactattccgagaaggtttcgactatccctggacaccgcgttcttgcgatgaaccgcggcgagaaggaggatttcctcacggtaaagatcaccgctccggtcgatgacatcaagaagtatctggagaagcagatcatcacaaatgacaatccgaacaccgctcctgcacttaaaaacgcggtttcagacgcctacgacaggcttattgccccgtctatcgagcgtgagatcagaagtgatctgaccgagatggctgaggatggcgctatcaaggtattttcagctaatctgcgccagctgcttctcgctccgcctattgcgggaaagaccgttttgggatgggacccgggatttaatcacggctgcaagctcgctgtctgcgacccgaccggaaagatcctgaccactgatatggtatttccgtttaagccgaaaaatgacaccgcagggactgtaaagaaggtcctttcgcttatagatagatattccgtagatcttatagccctcggaaacggcacagcgtctcgtgaatccgaggcacttgtcgcagagatcataaaatccgcgtcacgcccggttcagtatgttatagtaaatgaggcgggtgcatctgtttactcggcaagtgaacttgctgcgaaggaacttccggaccttgatgtcgagggacgtggcgccgcttcgatggcccgccgtcttatcgatccgctctccgagcttgtaaaaattgacccgaaggccattggcgtcggccagtatcagcacgatatgaaccagaagaaactctcggaggctctctctggagttgttgaggcggttgtcaattcggtcggagtcgatgtgaatacagcctcggctccgcttctttcctatgttgctgggatctcgaagaccgtttcgaataatatcctgacatacagggaagagaacggaagcttcggcgacagacaggagcttcttaaggtaaagggactcggacctaaggcgttcgagcagtgcgccggattcctgaggatccgcgatggaaaagagccgctcgacaacaccggagtccatcctgagtcctacgacaagacgaagcagctcctcggaattctcggatttacagaggatgacttaaagaacggcaatctctccgatattgacaagaagacaggtccggtagatgaactggccgagaagcttgacatcggagttcctacacttacagatatcatcaaagagcttaaaaagcctggccgtgatccgcgtgaggagatgccgaaaccgattttacgcagcgacgttctctcgatggacgatctgaagcccggcatgaagctcaaaggcaccgtcagaaatattgtagatttcggagcatttgtagacatcggagtccatgaggacgggctcgttcatatttcgcagatatcgaaccgccatatcaaacatccgcttgacgttttgagtataggcgatatagtagatgtaacggtactcgatgtcgacaaggagaagggcagaatctctcttacgatgaaaaacgatgccgaaaagtctgataacggcaaagctgaaaagcagaacggccgtcgtgaaaacgaccgccgcgattcggggaagcggaatgctgcccgcaaatctgataaaaataacagacaccgtgattctgataagaagaataaccgcggtggaaaaaataatacaaacagacctgacaggcagcgcggtaacagccgcgatgtcgggacgaatctcggcagcctgctctcgggcctgaaactggactgaggttttaaaatgaagttcgaaagccacagcagggaagagacattaaaactggcggctgatatggccgcaaaggcaaagccgggagacgtattcacgctgaccggggacctgggagtcgggaagactgtttttgcgaagggcttcgcaaagggactcggagtcactgaaccggtcacaagccctacatttacgatcgttcaggagtacaagagcggacgcctgccgtttttccatctcgatgtctacaggatctccgatccggacgagatggaggaagtcggttttgatgactacctcgagaggggcggagtcgtgctgatcgagtgggcagagcttatcgaagatattctgccgctcccgcgcacccgcgtaaagatcgagaaggactcagacggcgccgacgattacaggcttattacaatagaagatgtggagcaataatgaggatacttggaattgactcctcggggctcgtcgcctcggctgcagtagtcgacgacgatacgctcctcggagaatttactaccgattacaaaaagacacattcgactactcttatgccgatgttagatcagctgataaaaatgctcgggatcgacatcaggacgatagatgcagtagctactgccgcagggccgggaagttttacgggactccgtatcggagctgcaacggtaaagggcctggcatacgctttgggaatcccggttatcgctgttccgacagtagatgcgatagcctacaacctctacggctcgaagaggcttatctgtccgcttatggacgccaggagaaaacaggcatattctggactctacaaattcaacgagacgaatgagttcattgtgaaaaaagagcaggagcccgaggccatcgaggacatagtaaagcgcatcaatctaagcgacgagccggtcacttttctgggcgacggagtgccggtgtttgcggattacataaagcagaatgtgactgtagactacgactttgcgccggcgttctgcaacaggcagagggcttcgacagtcgcatgtcttggcaggaaatatttcgacagagagttctacacctcggcagaggagttcaggccgatatacctgagacagtcacaggccgagcgggagagggaagagaagcttaagaaagcaggtaacaatgcttgatatctgtcttttaggatgtgggggtatgatgccgcttccgaaaaggcatctgacttcgctcgctgtcaggttcaacggccatacgacgcttgtcgactgcggcgaggggactcaggtcgcgatgagaaaggcgggactttccccggcgccgatcgatactatctgcgttacacactaccacgcagaccacatcagtgggcttccgggactgctattagacattggaaatgcgggcaggacgaagccagtggccatgatcgggccgaagggcttgaagagagtcgtaagttcgctctgcgttatcgcaccgcagctgccttttgagataacttttcacgagctgaaagaaaacgaggagacatttgacctcgaggggctgaggcttaaggcatttcatgtaaaccacaatgtgacctgctacggctacactttcgagctcgacagagccgggcgttttgacgctgcagcggcaaaggcacttggaatcccggtaaactactggagcgtgcttcagcacggggacgaggttgacatccctgagggacattttttaccggaacaggtcatgggaccggccagaaaaggactcaaggtgacctataccacggacacaaggcctaccaggtcgatcgtcgagaatgccagcggcagtgacctttttatttgtgaaggaatgtacggagacacagagaagcaggaaagtgcgaaggagaaaaagcacatgatgatgcaggaggccgcgagtcttggaaaagaggccggcgtcaaaaaaatgtggctcacgcacttttcgccttcggtgatcaatccgaaaatatatatagaagacattaaaaaaatattcccggaactttcgatgggaaaggatgggaagaagacagaacttgactttgcagatgagtaggaggcgatcctatgggtatgaaacggggaatcagaacagcttcggtattgactctggttgcggtgatcatcattgctttttacatgtacctgaccaggatggcggggcagagagaagagaggaaggagactcaggctgttactgagacggagaagcttcttaaccttgacttcaagaaaaattacccgcctacgccgagagaggtgatcaagtactacgaccgttttgcgctggtgctcttcggggagaagaagccgtcgcagagcaatacgacaaagcttgcttcaaagctccgtgagctttttgacgatgatctcgcgaatgcaaatcccgagaaaaattacgctgcggctctctggagccaggtgcaggattttaaagagcggaaggcgaggatcgtgcaggctgatgtctgcgataccgacgatgtcgtctacaagacagtaaacggccgcgatgtcgcctatgtccaggtgacctatctcgtgaaggaagccgactcgtattcgtcgacttaccagaaattcgtgctgcgcaaagacaaggatgacaactggaagatactgggttacacgcgtactgacaaggacggaaacccggtatcagaatctaataagaagactacaaaatgagtgatataaaaatacttggaattgaaagctcctgcgacgagacggcggctgccgttgtagtaaatggcagggaagtcctctcaaacgagatttcgacgcagatcccgattcacactctctatggcggagtagtgcctgagatcgcttcgagaaaacatgtcgagaggataacgcaggtagttgatctcgcgttaaaacaggccggaacgactgcagatgaattagacgcagtcgctgtgacatacggaccgggactggttggcccgcttctcgtgggagtctcgtttgcgaaggcttttgcctatgcgaacgatctgccgtttatcggtatcaaccacatttccggacatataagtgcaaactatatagaggataaggacttgaagccaccgttcctctgcctcgttgtatcgggcggacacacacatcttgtaagagtcattgactatggcagatatgaggtgctcgggcgcacggtcgatgatgcggctggagaggcgtttgacaaagtcgcgagagcgataggacttggatatccgggcgggccgaagatagagaaggcggcaaaggacggagatccggactcgattgaatttccacgggctaaagtcgcagaccacccttacgatttttcattctctggacttaagagcgcagtgctcaactacctgaaccaccagagaatggccggagtcacggtaaataccaataacgtcgcagcttcttttcagaaggctgtcgtcggtgcgcttacagaccacgctgagatggccattgaccagtttggcatggataaatttgcgatagccggaggtgtcgcttcaaacggagctctccgcgcttcgatcgaagctctctgccagaggaagggcgtaaagttctaccgtccggcaccgatactctgcacagacaacggtgcgatgattgcggcagcaggctattttgaatttgagaatggagtacgctcgggcctgaatctgaacgccgagccgagtctcgctctctgataaataatgaaattaaagacaaagttcatactcaatattttactaattgtgctgcttccgatagtgctgatcttcatattcgcttcattcgccacccgaaccaaggccaggagcagcgggtcccatccgggaaatctgtatttttcaaacagtgtggatgatctggcagcttacaccgacagcgatgtaatggagcttactgaactcgccaaaaatcatccggagaaatttctggacaaggatgccgtaaagcgggaaaacagtaagcttgcaaagaagaactcctatctggtcgttgtagcagactcaaagcttacctatgacggagcagcgaatgggatgcgcccgatctacagcgaacttccgcagtacggaagacttaaaaaaggcgatgtgcttctgataaggcttcagaaggagagaggacttttaaaagaggtcgacttcaagaccaggggccagaccggccaggtatttgtcataactccggcgggaagcatcgtcccgggaagcaggaagatcgtctgctattatctgttctggcttgtagctatcctgtttatcaccgggattgtcgcttcgatgcttctctaccgaaacatgattaaaaaagtccggcagatgcagcaggccgctgaaaacatccacgagggtgacctcgatacgaagattgaagtcaggggaaacgacgagcttactgaacttgcccagagtatggagagaatgagggtgaagcttctctcgaatgccgagcagaaggtggcggacgaggagtcaaacaggcagttcatgagcaatatttcccatgatctgaagacgccgctgacttctattatcggctattcagaggggattttagatggtattgcgaaggaccctgagaaactgaaaaaatatgtcggcacgatccacacgaaggcggtcgatatgaacgcgcttttaaatgagctctctgaatttttaaagctcgatatgcacgagataccgtaccacttcgatacgataaatgcgaacgggtattttgacgatttcgccgaggagacctgggacgaactggcagatgccggcgcagatttttcatataaaaatacactgccgacggatacggttatttttgcagaccctgcacagattaatagggtgcttcataatctggtctcgaatgcgataaaatatcgcagagaggatacgaagctttcagtggaattcagggttcacgacgccggagattttattcaggcagagctttgtgacaacggaaggggcataagcccggaggatgtgccgcatgtctttgacaggctctttcgagctgacaaggccagaaatacgggcatccgcggcaatggcatcggcctttcgatagtaaagcagatagtggaggaccacggaggccaggtttgggtcacaagccgaaaaaacgaggggagtactttctatttcatgctgaaaaagattcagcagcatagcgcagcactttgagctgcagacaggagggaaaatgagcaggattctcattgtagaagacgaagaagcaattgcggagctcgagaaggactacctcgagctgtcgggatatactgtcgagattgagaacaatggaaccaccggacttaacaggggacttaacgaggaatgggatctttttatcctggatatcatgcttccgggggcagacgggtttgagatctgcaagcagatccgcaccaggaaatcgacgccgatcatcttcgtatcggccagaaaagacgatatcgacaaggtcaagggactcggttttggagcagatgactacatcacgaagccgttttcaccgagtgagctcgtggcgagagtcaaggcacatctcgcatctttcgacagagtagtgaacgcttcagcagcttattcgaatgacgatgtcataaggatcagaggcttaaagatcgacaacacttcccacaaagtctgggtagacggcgccgagaagcagcttaccacaaaggagtatgatctcctgagattttttgcaaagcatccggggcaggtcttttcaaaggaggagctgttccagcgcatctgggatcaggattctgtcggcgacatcgccacagtaacagtccatgtcaaaaagatccgggagaagatagaacttgacaaagaccatccgcagtacatcgagaccgtatggggcgtcgggtacaggatgaagatataattattaaaggaatcacctgttatgaaaaaatttctaaaatcactctgtttcctgcttactgtctgccttctggctggagctgtcgcagctccggcttcggctgcaaagaagaaaaagaagaataaaagagcaggtataactattggcatcgatccgggacaccagcagcgcggcaattattcaaaggaaccgatagggccgggcagcagaatcagaaaagccagggtcgctggcggaacgagcggcaggtactcgggaattcctgagtacaagctgacactttctgtcgcaaagaagctacagagcgagctgaagcgccgtggttacaaggtcgttatgacaaggaccaaaaataatgtaaatatttcaaatgcccagcgcgcgaaattactgaataagaaatgcagggttgctgtaagacttcacgcggacggagctggcccgagtgcgaggggcgcctctgcgcagtgttctacgaagagaaacagatatatcggaaggctcgcctcgaagtgccagaagctctctagctgcgttctgaattcatattgtaagaagacaggcaggaagaatcgcggcatctcatacagggatgacctgacaggcacgaattattcgaagattcctgtgacgcttatcgagatgggatttatgacgaataagtccgacgattcatatatggccagctcaaagaatcagacgaagatggctaagggaatcgctgacggtattgacaggtacttcggattcaaaaaataacagattaccttgacatgtacctgtattttttctaaaattatatagtttgaaataaataaagcgaggaaatttttaatggctgataagaaactggtggaggctatcacctcccgtgatgaggattttacacagtggtacactgatgtagtaaagaaggcagagctgatggagtattcttccatcaagggctttatgatctacaagccgaacggctatgccatctgggagaacatccagaaaaaactggatgccgagttcaaaaagaccggcgttcagaacgtataccttccggtgcttatcccggagagccttcttcagaaggagaaggaccatgtagagggttttgcgcctgaggttgcctgggtcactcagggcggcggaaacgagcttcaggagagactctgcgttcgtcctacatccgagactcttttctgtgaactcttcagaaataactgtcacacctacagagatcttccgatggtctacaaccagtggtgctcagttgtcagatgggagaagacgacacgtccgttcctccgttcttcagagttcctgtggcaggagggacacacgatccacgccacagccgaggaagcagaggccagaaccatccagatgctgaatatctacgcagatttctgtgagaaggaacttgcaatccctgtcattaagggacagaagaccgagagtgagaagttcgcaggagccgaggccacatacactattgagactatgatgcatgacggaaagtcacttcagtccggtacttcacataacttcggtgacggcttcgcaaaggcctatggcgttcagtacactggaaaggacaacaagctccacccggtatatcagacttcatggggcgcttcgacaagacttatcggcgccattatcatggttcacggcgacgattcgggtcttgctcttcctccgcacatcgcaccggtacaggttatgataatccctatccagcagcagaaggaaggcgttctcgatgccgcagagaggatcaaggacgagctcgctgaagcaggtctctctgtacagcttgacgattcagacaagagaccgggatggaagttctcagaggaagagatgaggggaatccctcttcgtgtcgagatcggacctaaggatatggaaaagggccagtgtgtcctcgtccgcagagacaaccgtgagaagactgtagtctcacttgaggatgttgccgaaaaggcaaaggaagtcttagagaccgagcagcaggatatgttcgagcgcgccaaagcgttccgcgattctcatatctacgatgctcacaattacgacgaattcaaggatatcgttgccaacaagcctggcatggttcgcggcatgtggtgcggcgatcctgcctgcgaggcaaagatcaaggaagatacaacagctacgagccgctgcattccgttcgagcaggagcacatttcagatacctgcgtctgctgcggaaagccagctaagaagctcgtcatctggggaaaagcttattgatgcagttgcctgaatcagttaaaaaaattatacacacattagaacaggccggccacgaagcgtatgcagtgggcggctgtgttcgtgatacgcttcttggaaaggagccggacgactgggatatcacgacttccgcagaaccggaagaagtcaagggcctttttaacaggactatagacaccggcatcaaacacggcacggtgactgtccggctcgacgggaagagtttcgaggtcacgacttaccggattgacggcaggtacgaggatggcaggcatcccgaaaacgtcactttcacaaagagcctcgaggaggacttgaagcgccgcgattttacaattaatgcgatggcgtacaacgacagaacaggcatcgtcgaccttttcggcggagagtccgaccttgagaacaaaataatccgctgcgttggcgaccctatggagcgcttctctgaggatgccctccgaatgatgcgcgcagtcagatttgctgcgaagctcggtttttctatcgaagaatctaccagaaaatccattacaaaacttaaggacaatttaagaaaagtttcggctgagaggattcaggtcgagctgacgaagcttatcacttcggaccatcctgagcttttagagacgctctatgagacagggctcacgtcggtatttttcccggaatgggacactgccatgacctgcgaacagcactcgaggcaccactgctatacggtcggaaagcacaccatcgtcgtaatgcagcatgtaagaccgacgaaggtcatgcgtcttgctgcgatgcttcacgacatcggaaagccgcaggtgaagagggtcgacaagaaggggatagatcatttccagggacacccacagctgtctgaagtcatggctgaagatattttaaaaaggctgaagtacgacaacgacacgataagaaaagtctgccttctcgtcagataccacgacgagaggccggcgctgaatccggcctccatccggagatgtatgcgggatatggatgtcgacttcgacgaactcttcgagctgaagcgcgctgacaatgcaggcaagagcgactacaagcgtgaggaaaaggaagcggcagtcgacaaatttgaacagcttgtcgaagagaacaggactgcagggaactgcaccgacaaaaagcagctggcggtaaacggcggagatctgataagaaacggcgtggagaaggggcctgtgatggggaagatcatcgacaggctcttagatgacgttatcgaatacccgtcagaaaatacgaaagataaacttctcgagagagcaaagaaatactctgaactcgcgaaaatgggtaaattatttttaagtatctgcgtggcatttttctgtgcgggaatgtttctcactgcctgcggaagccagaagatagtttactcgcagagaaagcccggagatctgctttcggcctcatctgacgcgtcggccgacgccacaaagtcgcttgacaaggtatatatcatcgaggagaaggacaaggacgacggaaagcttaccgtgatgaatgtcgtgagcctgagggaatttcgatatccgtacaatatttccactgaatttttaaataaatacggtgataccgaatcagtcgatgattttaaacccgggatggctgtagaactcgactcctcgggaagatacggggtgcttaaaagagtccggaaatcgagccttgtctgggaatgggacaagcttaagaatttctcctttgacacttctctcaatatgatgaagctccgcggacaaaagtacaagtacagcgatgcgactcttttcatggatgggagtaatatcatagaattaaaggacctcgcacctggagtcgatgagatcagagtcatcggttacggcaaggatatttactctgtcacgaggacaaaaagccacggctatctgcatcttacggacacaggcagatttaacaacagccttatccagatcggttcatatgacgcgtcgcttgtatcaaacgacaagacatttacacttccgactggaacttacgctgtcactattgcaaacaacggctggggcggaacgaagaaggttaagatcacaaaggatgtgaccacataccttaacctggagtctatgaaaggaagcggccctaagacctgcaagctcaaatttgagatcgatgtcgacggagcgaagatctatctcgatggaaaaaaggtagagaaggagaagaaaatgaccgtgctctacggcgcacactctctttctgtaaaggctgacggctacgacgactgggacaggacactctatgtaaattcaccaagcgccacgatctcactcgatatttctgacagcaagaagagctcgtcgtcttcgtctggtacaaacagcacaactaattcaggcacttccggcacgacggattcttcgaacaagcggcacttaccaaaccagcactacaagcggcaccactggcacgacgtcaggaagcactgatacgaatggaagcacagttacgactggaaacggcagcactacgacaagcggcagcagttcgaccggcagctcttcaagtggaagctcgaactcgagtcttacacaggagcagcgggaccagatcctgtcaacacttgccaattctgctctcagttcactgggctcatctctttcaaactgagttttgaaaaaattccaacgattgccctgttttgctttaaaatagtggaaaacagcgcaattatcggatataataggttcagcttattttttagataaaggcaaattttaaaggaggaaaaatgggttacaaggagacatacgagaactggctttctgatccgtatttcgacgatgatacgaaggcagaactgagaagcatcgcaggaaatgacaaggagatcgaggatcgtttctacatggacctggagtttggaacggccggactcaggggcgttataggtgccggtacgaacagaatgaacatctacactgtccgccgtgctacccagggactcgccgattatatcatcaaggtcggcggagagaagagaggcgtagctatttcttatgactgccgccatatgtcaccggagttcgcggatgtagctgcctgctgcctcgcagcaaacggcatcaaggcctatgtttttgagtcgctgcgtccgacacctgtcctgtcatacgctgtcagatatcttcactgcatagccggaatcaacatcacggccagccacaacccggcagagtacaacggttacaaggtatattgggaggacggagcccagatcactcctcctcacgacaccggaatcatggactgcgtcaaggccacagccatcgacaaggcgaagacgatgccgaagcaggatgctgtaaaaaaaggactctatcaggttatcggcaaagatatcgacgatccttacattgcagagctcaagaagcttgtgatccatcaggacgctatcgacaaggtcggcaaggacatcacgatcgtctactcaccacttcacggcacaggcaatatccctgtaagacgtgtcttaaaggaactcggatttaagaatgttttcgtagttcctgagcaggagaagccggacggcgacttccctacagtcaagttcccgaaccctgagttcaaggaggcatttgcccttgcacttgaacttggaaagaaaaagaacgctgacctgatcctcgccacagatcctgatgccgacagactcggtgtatatgtaagggacaagcagggcgagtatcacccgctcactggcaatatgtccggatgccttatcggaaattacgtcatcggccagagaaaggccagagacggaaagcttcctgaagacggagcttttatcaagtcgatcgttaccacgaacctcgcagacgccattgccaaggactacggcattcagctgatcgaagttctgacaggattcaagtacatcggcggaaagatcttagagttcgagaagtcaggcaggggcacatacctcttcggtatggaggaaagctatggatgtcttaccggaacctacgccagagataaggatgcagtcgatgcttctatgacactttgcgaagctgcagcttactacaagactatcggctggacactctgggatgcgatggtcgatctctatgagagactcggctactacaaggatgccgtaagttccatcaccttaaagggcaaagagggcatcgagaagatcggctctatcatgacttacttaagagagaaccctatcaccgagatcggcgattacaaagtcatccgcagaagagattaccagaatgacacgatcactgatatcgctaccggcgagacgactccgactggacttccgaagtcaaacgttctctactatgagctgaacgacgacgcatggatctgtgtccgcccttcaggtacagagccgaagatcaagttctactatggaatcaagggctcaagctttgacgatgcagacaggaaggcagacaagatgtcgaaagccctcgaaaaacttgcagatgagcttacaaagtgataaaagatattgacatttcattgagaaaactgtataaattaatagatacaggaagatttttcctgtatgaaactaaaaggtcgtattgaaaatacgaggaggaaaatttaaatgaataagacagaacttgtagcagagatcgcagagaaggctgatacatctaagaaggaagcagagctcgttctcagcgcattcacagacgttgttacagagcagcttaagaagggcgagaagatccagctcgttggctttggtacattcgaagttaccgagagaagcgcccgcacaggcagaaaccctcagacaggcgaggagatgcagatcccggcttctaaggctcctaagtttaaggctggcaaggctttaaaggatgctgtaaatcagtgatttttgtgaactaaagagatataagggagcggcttttgggccgctctttttttatttccagctcggcatttttgacgattatcagaatacgcttgacgccatacagaatcatattctgataaaatgccattactttaattcaaacctcggaaaacatttgttagcaattggctcagaaaaagtctataatgaaaatcgccccgagcgcggagccggaaataatatgtaatcagcttttctggcgctttggggttttgcgagtgtgaaacactcaagatttggagggaaaatgcttaacgtagttcttcatgaacccgaaattccattcaatacgggcgcgatcgggcggacctgcgtcgctacaggttcgtcgcttcacctgatctacccgctagggtttattttaaatgataaaaatgtaaagagggccgggatggattactgggataagctcgatcttcatgagtataacgactatgaggattttttgaagcagcatccagagataacgtacaacggggagggtgacgacggcccgaaactctggttcgcaacgacaaaggccaggcagtgctattctgatgtgcgttttggcccggacgattttcttatgtttggaaaagagtcggcgggaattccggaggagatccttgtaaagcacccgaaggcctgcgtcaggattccaatgctcggggatacaagatcgctgaatctgtcaaactcggccgcaatcgtaatctacgaggcactgagacagaacgatttcatgggactgaatgaaaagggcaatctgcaccatctgtcgtgggactgatcctgcatctttaaaagatgcacctgctctgttataatatgatatacgggtcaaaaagcgtgacttaatgacccgccccacagcttcagaaaagttgaaaaaggagtttgcttaacatgataaaccagaaatacaaggacaggctttcgaataagtctgtgatcagggaactggccggctatgccagaaagcgtggcaaggatatcggctatgagaacgtttttgactattctctcggcaatccgtcggtcgacactccgaccgattacaacagtgcagtcatcgacatgtataagacgatggattcgatgtcgctgcacggctattcaccatctctcggaaatacacacgccagagaggtgatcgccgcttctcttaagaagagattcgggattgattacgagacgaagcacatcttcccgacgacaggagcagcaggcgcaattgcgcacgccgttcgcgcggttacgaagccgggggacacggtgcttggatttgcaccatttttcccggagtacaggccttatataaatgactcgggagcaaagctcgaggtcgtccctcctgatcttccggacttccagataaatttcaaagaacttgaaaaaatgatgaacgggaatgtcacggcagtccttatcaattcgccgaacaacccgtccggagccgtctattcacaggctactctcgagcgtcttgccgcatttttaaatacctgccagaagaaatatggccacgatatttttattatcagtgacgagccgtaccgcgagatagttttcgatgggaagaaatgtccgtatccttctcactattatgacaacacactatcgtgctactcattttcaaagagcctgtctctcccgggcgagcgtataggctacattgcggtgaatccgagggccacggatgcagatatcctcgtggatatttttgcacagatcagcaggggaataggccataactgcccttcatcgacagcacagctcggtgtcacagcagttatcgacgagacttcagatctgtcggtttatgagacaaatatgaacctgctctacgatgcgctgacagagatcgggttcgaagtaaaaaggccgcagggtactttttatatattcccgaaggcactcgaggacgatgcagtggctttttgcaaaaaggccttgaagtatgaccttatcatggttccggccgacagcttcggggctcccggctatgtaaggcttgcctactgcatcgatactgaaaaggtcaggcgttcaatccctgcattaaagaaattcgcacacgaggtttacggaaaatgagtcagtttggaaatcacgatgatcgcccgacgaagactgtcgagctttcaagatcagaagtcacccatgtggtgatgcagatagatataaacggccagggccgcctctttggcggaaggcttatggagtggatcgatgaagtcggcggtatgacagccatgcgccattcgacgcacgaggtcattacggcttcggtcgacaacctcacattcaaggcggaagcccgtctgaacgacatggtagtaatgatagggaaagtgactcatgtcggcaattcttcgatggaagtccgcgtcgactcctaccgtgaaaacgagatcggaatgagaactccgatcaaccgcgcatacctgacctacgtcgccgtcactccagagggcaagcccatcagggtgccgtacggcctcgaagtaaatggcccaggcgaggaagctgagtggcagggagccgagaagagacagaaactgagactcaacagaaggaaagaggcattctgaagtctcgattcaagcaggcgtgcggagatcgttattgggtaaataagccttaaatgcggcattggagaaccttcttaaagaatttttaaaaaattagcactcacctattgacagtgctaacaaatcgtgatataacataattgttccaagagagagacgaacaggaacaagctgagttagaattaataatttgatctataaaggagcttcctgtataatacatatataaggaattccggaaaggaaggttgataaaaagtaatacctcaatgtaaaataagtttactgactcagcatagttggtaaaacatatagaacagagaggttatcacaaatgaatagtaacacaagaccagaagaatgcaacaaaaatcgacagatcacagaatgccaggatcagggctatcacagagacgacaatgatcgtggggatcgatataggcagtgagaagcatgacgccagagcgtttacatacagagggatagagatctctgcggaacccttcgagttagaaatagtgaagagggttactatatgtttctggcgtggatggaggatctcaaatcaaagaatggactcgatgccgtaataccaggaatggagcaaacggccattactggttcaacttgggcgcatttctccaatctcatggaatgaggaccgttctcgtgaatccatatcatgtaaaacaggcgaaagagctggatgacagtaatccaatgaagactgaccgcaaggatccaaaggtgatagcagggtggtgaaagatggaaggtaccagataccctacataccggaaggtgtatatgcagaggtgagggtgctttcatccctgagtaccaggcacaggaagaactgacacgcgtaacgaacaggctgcgagatggttcagcatatatttccctgaattcaaagacgtttatacacagcccgatccgataacagggatatgattcttcatgaggcgcctctcccggaagacattgtgaaactgggagctgacggcatagagaagattggaggaagcaaaaatccgcggcgccggacacaagagggctgttgagctatacgagctgcgctgaacagtaggaa

SEQ ID NO: 9 - DNA, 183555 bp, Unknown
  Metagenome-assembled genome
tgtcccgccatgatagcttcctgatgatgtttgacaaatggtaagtttttgctgtgcagcactttcttcggaatttgacgctttgcttcaaccaatgccataagcactgatacgatagtatatttactttttcaagaatacggaagcagcagcttcatctaagattgttaatttgttgtactgttttaagccggtctatttgccaatgtgcgataaaggaagtaatagaagtgtaaaaaatttttgctttcctatccgacacttagggctgtgtcggataggtcaggcgttaggcttccggcaagtctactcttgcgacaaaagctgtaataaatctcaatgtccggcctggggtccgtttcgtctagctgcactcatgcacgacgatttttctcaatcatttcccgcaagagggtgggggtcaattcttcaaaagcaaggtgctttctcacgactcccatgaatgttctcggcgttgacgtgtggggcctgcgacttggaaaggtctcctgccaaagcggcagcgccggtctttcagttcccgccgctcctgctcatagtccgccgacagctccatgaaacgctacgtcgctgattttggccgcttacattgtcctctacagccgcttgataatgcggttcacttcggcatgcgtgtctgggcctgttcaagctgcttcgtggctgcggcggtctttctttgccgccgattcgttctgctggatgagcagctttacagcggctctacatgcctggcggcgtattcgtcacttgccggagattggaaagcacgcaccacgtcaaaaggtcggtgcggatttaaagtgtgccgtacagtcacgggtacagcttcttgtagcttgccgagatggtaacagtcctgcttgcggttcttgttctgataccgctgctgatacatacatggccgcagtcgggcagaacagcataccggagaacagccccacttcatcatagcggtcgggcgtttgcgctgcttgcgtaactcctgcacgcgctcccatgtttctcggtctatgataggctcatggtggttctcaaaaacagcctgcttctccacgggttctcatctgcggcagctacaagaagcgtacccgtgactgtacggcacactttatccgcaccgaccttttgacggcgggcgtgctttccaatctccggcaagtgacggaatacgccgccaggcatgagagccgctttgtaaagctgctcatccagcagaacgaaatcggcggcaagagaaagaccgccgcagccacgaagcagcttgaacaggcccagacacgcattgccgaagtgaaccgcattatcaagcggctgtatgaggacaatgtaagcggcaaaatcagcgacgagcgtttcatggagctgtcggcggactatgagcaggagcagcgggaactgaaagaccgggctgccgctttgcaggaggaactttccaagtcgcaggccgccaccgtcaacgccgagaaattcatggggattgtgagaaagcaccttgcttttgaagaattgacccccaccctcttgcgggaaatgattgagaaaatcgtcgtgcatgagtgcagctatgacgagaacggcacccgcaggcaggacattgagatttattacagctttgtcggcaagatagacttgccggaagcctaacgcctgacctatccgacacagccctaagtgtcggataggaacggcaaaattttttacacttctattacttctttatcgcacattagcaaaatagaccggcttaaaacagtacacaaattaacaatcttagatgaagctgctgctttacgtattcttgaaaaagtaaattactatcgtatcagtgcttatggcattggtttgaagaaagcgtcaaattccgaagaaagtgctgcacagcaaaaacttaccatttgtcaaacatcatcaggaagcatatggcggacattttcccatttgggcagctgttgaacttatgacatttggaaatattgcatctcttttgataaagcggatgcttcacagcaatgagcaatgggaatcttttctgaaagatatagacaaaaccataaataaatacaaagatgtaatcattctctcatttattggtttcccatcaaattggtatgatgttttatctgaaccagtgactggtatatgaatctcatgatgctgtgactcatagacacaactcagttttaatatttgcagacataagacactagtcaattggtgtcttatttttatactgaaaaataacaagtgatgaattttaacttttgacattaatgaccttacaaacaaaagtttgtgcctaattagtgcacattcgtgtgcctaatctgtccatagaaaaagtaatcattataaggtatgattttttcagaacagattacatctgttctgaaagatcggaccttgacaactgaatatacattcatcaggcacatccctgtgcgggttttgaaaggaaccagccgaagaagctatacgtgatgaagtgcagtcgtccctctgtgacttaacggagataagaaactgcgctgagcgatacctatgaagcttcaaaatgccggaccgcttccggcagtggcaattaaacgtacaggcacaatggtacttctgtccagccacagccccgtcctaagacgggatcacgcaatgggggcagctccgggagatcctcggaggagcatagattctgactcatggaagccgggagcacccggacacctgtatgaagaaagtgatcttcgatgtcttttaggacagcgacctggcaatctatgagaaactgctggggacagcaggcagggatgcaaagggatttaagaagataagataacgattaaaagatcatatgttagtaagcggctgtaattcggcaaagggatactttggccggattgcagctgctttttttgtggacaaaatttttttctatacatttgtgttatagcatagtttaattgctaatttctattttgatgcaatatgcttaaaaaattattttaccaagatatgatttatattgacaagtaacaacattgtcgttacaatacaaatgataggaggcattgtcatggagaaatcaacaacattgaatttaagagtaaatccgacattaaagcatgatgcagagtctgttttgggacgtttgggaataccaatgtctacagctatagatatgtttcttaatcaaattgtattagtaggtggaatcccctttcctgtgaagctacctaatgcaccagatagcatagatgtctcccagatgagtgaagaacagattcatgccaaactacagaaaggttatgaatcatataaagcgggaagaacacaaaacgcagctcaggcatttgaaaaatttagggagaaccatacctgatgaaggagtacatagttgatataacggatgatgctctagcggatatggatgcgctttatgaatatatagcaactgaacttcaatcgccggagaatgcaatagatcagtataaacgtattgcagatgcaattttgtcattagattcttttccagatagatttgttttgtttgaacatgaaccggagcattctttgggcattcacaagatgattgtagataactatgttgtatgttatgtgatagatcctggaattgttacggtaactgatgtgctttatggggcatcagatcttcataaaaaattgacagagcgacatggctaatgttgtgattgattaaagatgggataatcctcctgaagcatggagggctggtaaaggcaaccatgaccacagagcttcagaagagcatcactggaaaagtatacgagggcatgatcacgaaggaagatgtaaaattttagagttgcgacaaaaaacaggaatagacaggacgtggaaatgaagaaaaatatagttcttattggtatgccgggtgctgggaaaagtaccgtcggcgtagtgctggcaaaaaagctgggatatcactttttggattcagatattttgatacaggagagcgaggacaggacgcttccagagatcattgcggctgagggtacagacggattcttagatattgaggacagggtaaacagcaggattgacgtcgaaaaaagtgtgatagccacaggcggcagcgctgtctacggcaaaaatgcgatggagcatttgaaatcaatcggcaccgtggtctatctggcagtatcatacaagagccttgaaaaaagacttggcgacctgactgacaggggagtcgcattaaaagagggacagacgcttcttgatctctacaacgagcgctgtcccctctatgaaaaatatgcggatgtcacaattgatgaagagcttttcgatattccgagtacggtgaaggctattatttcacaaatatctgccaggtgaacaagatttcccggcagctctatggtagagcggatcaatctcgtcagcgattgtattaaactggtcaagtgtcttttcacactatcagctgcagcttctggtccagcagtgagaaggtcactgaatcggtcttaatggcgacctcgccatctgtgtgaagccaaagaggctgtgaggtggtgacagtcatttttttgaagttgaagtgatggacgccggactggctgtagtagctcctgctcccgcgacgcgcgccagggaaaaatctgagtatatgtgcagcagacatatcgccgatagctactatggacagcctgccgtcagttccggacgcgtccggcgcaaagcggtatccgccgccttcgtatggcagattgaaagcagctgtaaaaagtatccggtccagatgaacagttctgccgtcatcagtgactccatcgcaggcaatcctttttgaatagacggaattcagggtgcggtacgcaatagcgccgtaggaaagcatccccaggtgaagcctgttcagaaaagatttggtatttgaattcagtgcttcctcgcagacaccagcgtcaaagccaatgccggagcttatcacgaaacgcatgtcgtcaggtataatggcggcatgctgtcttgaatagatttctgtgcggtggttcagatgcacatttcctatatctaaaagcctgcatacctggctgtcggttattttttcaatgaagtgatgcagctgctcatcggtttttaaagcaggaatgccaagtccacgcgcgaaatcattcccggaaccgttcgggatgaagccgaactttatctgcgaaaaatcctttattccgtttatgacctcgtttatcgtaccgtcaccgccgcagacgatgatcgtgtcgcttgaaatcttacctgcgatttctctcgcatgaccaggccctttagtctcatagacacggtacggaatctgctttttctgaagctcttcgcagaggagttgcacagctctgccgtcgccttttcctgaatgtgatgaaggatttgttattatcgaatacatgaaaatctcttttctgttttaaagtttcactgccatatattggcttgtaattatggcatttataaaattattcagatgctcaaaagatagaatatcttttggaccaggtatcatataattgtagcagttatttaaaaaaagtgtagggaaagtgatgtaataaatatattgacaaagtattattgccgtgatattatttctatagttgaaatgatgattattacaaaaaggcaagaggtgactccgatgtattttttcaatccaaataatttgatgacaaaaggcgcgaagatgagcgatgaggaaaagcttttactttttaaagaaaagatagatagcgcggctgctgtagtgatcggctcgggttcgggactctcaacggcagcaggctacacctattcaggagagaggctgcagaagtactttggcgattttgcttttaaatacggcatccgcgacatgtactcaggcggcttttatccgtatcagacgatggaagaattctggggattctggtgccgttatatctggataaaccgctatgcgccgattccgaccgacctctatgaaaggctctttgacctcgtgaaggataaggactattttgttttgaccacaaatgtggaccactgcttccagagaagcggctttgataagcacaggcttttttatacgcagggagattacggtctttttcagagcagtgatccgcaggggaaatctctcgagaagacctatgacaactatgatcagataaaggaaatggtactgtcagagggctttgagataggcttggatggtgagcttataatccctgagggaagaaagataaagatgacgattccatcagagctcgttccgtactgcccggacgacggagagctgatgaccacaaatctccgctgcgacgacagctttgtcgaggatgatggctggcacagcgcgtcaaggcactatcataattttctcagaaatcatgaaaaaatgaacgttctctacctggagctgggtgtcgggatgaacacgcccgtgatcataaaattcccgttctggaaatataccaaagagaatccgaacgcattttacgcctgcataaataaaggtgaagcaggctgtccggatgaaatcaaagacagatcagtatgcatagacggagatatctgggaggtcttgtccgcaaaggtaaactcgtgaacagtgcgaagaggagtgctgccattttcaatctgattgccttcaaatgctagaataggttttcttcagcatctttccttataattataatggcactcagcacgaactgtattattgagatataacggtatcccatattccagccctgtccccggtcaatggcaaatcccatgatatatggtccgacagaggctccgactccccacatacagtgaagccagctcatgtgacggctggcaaaatgcagtgcgacataattattaagcgctgcatccacgcttccagctccaagtccgtacggaatcgcccagagacagagtaccgggaaactgctgcttatcgaaaagccaagcaaagccacagctgttgtcagcacagatgctgctgtaacttttcctgcgccgaattttcttgtaagcctgtcactcatcaggcttgatacgatcgtcccgaatgctatgatcattgaaataataccggcataggatatcggcaccgaaaatcccctatacatggatggccatgccgagccgagcagagaatcaggcagtccgagactgataaatgccagatagattattgctaatagaagtccaatcataaaatacctccagagtctgctttcatatcagatgactgtaaaagtggatagaaagatacatgcagaaggcatatccgtcaattgaattgctaatgtaataatatcgcaaatgccggtttctttagaattccatatcatttgtccgcttgatatatcttccgattccatcaagccccggatagattgaacgttcatcaattccaaggattgagagactttcgagtgaagattccttggtgtcggcagggattatgattttgtggaccatgatcctcggggatgcttttgcatcttcacgcagatcatcagaaggattttttgtggaaaaatatgctccatccgtttcattaagtggctcctgatcgaagccccagacaaggaaggcgcttcgctgggaagccattctctcttcgagaaagtaaggctcgacaacgaaaggcttcctgactgactcgtattttctatctccgtttaaaattccggaaacgatatccttatgctttgtcttcttgtaaacgtctttttcaaggccctgcatctgaaggtctccggagatgacatagactgcaccgtctttatccaggtcgtcctgcccgagacacgcaaaccacatggcgacgagaggattcctcgttatatcgagaagtcttgtagggacgccatggtgctgggccagaactgtccagttccagatatcgtcttcaggaatagagctgtaacgcctcgcttcacgcataaaattgtgcaggcagttgcgctcgtattttctgaactgctcaggtgaatgacacatgtcgttttgcctgtaagcagatgggataagactgtggcttttgtctgaaacacctctgaaataaggcaggccgcgctgaaggtaatcgtcctgtgataccctgtttagtccggaataaataggctcgatcttatttaaaaaatcgtgaatcgttttaaattctatcatatattcgtaagtttattgatctcgtcggtcagatatatatataaattacgctgaaaagtatcagtcatgcggctgcaggaagaacttgcctgcgattttttcagtgcggatcacgttgcagaaagctgccgggtctatctcctttacttttttgatgacacgggcctcttctgcggcgccgattactgaatagacgatctttctcttgtttttttcatgggagccgagtccgtcgactatagtgccgccgtggtcggtctcggcgtagatcatcgcgcagacagcatcagggatcttcgtgattatcaggagtgtcacctgctgatagttccggtacatgatgtgctcgacctgagtagtggcgaactggaaaatgatagagtagagcgctttgtcccagccgaagagaaggccggagactaagaggattacgacgtttattccgaggatcacattgaaggaatcacggcccgtcctctgagagataaagatcgagataaagtcggttccgccggtcgtcgtgtcattgcgcaggcagagcgagatcgcaaccccgtttatgatgccgccgaagatgcttatcagaagagtatcgtaggtgatcacatatttcggcagaaaatcggtgagtaccgatgagagggctatcacaaagagtgatgagccggtgaatttttttccaataaaacgaaaacctatgtagataggaatggcgtttatcgcaaggttgaggggagtgtatggaatcgcgacctttgcgaactttgcaaaggagcgctgtatcaggagggcgagacctgtcgctcctccgggcacaaggccacccgtagatacgaaagtattgatatttatcgccatcagaagcgaggaagctacgatgacgaagaactgttttattatagtgtttttcctgattttctccattagcttattatagctgaaatgcagatttttacaatatcttactggatgaatttacgcctgaatttgcgtaagaaaattgtcgcattggatgcgaaagtgtagtaaaattaacataatattacacttcgccggaggaaagaaaaatggacgctataatgaaatttacggattcgatggactcattcctgtacacctatgttcttgtgatcatactgatcgcggccgggatttattttacgatcgcgacaaagggagtgcaggttaggatgtttcgtgatgcgctccgcgttatcatggagaagccggcgaagaaaggctccgtatcttcttttcaggcgctgatggtctctacggcgtcccgtgtcggcactggaaatatcatcggtgtcgcctcagcgataatgctgggcggttatggtgcggtcttctggatgtgggtcatcgcatttataggtggcgccactgcatttatagagagtactctggctcaggtctacaaaaaacgcgctgtgaatggcggatgctacggcggccctgcttactatatcgaagcggcgctgcacagcagagtcctgggtgtggcatttgccatagctatgatccttacatacgcaggcggatttaatatgctctgctcctacaacctgcagtctacttttaaaagctacagcttctacaacgatacggtgactccgatcgttatcggcgccatcacagcgtttcttgtagctttttgtcttttcggcggcggaaagagaatcgtgaaggtgacttcgacactggtcccgtttatgggatgtgcctatgtccttgtcgccgtgatagttgtgatccttcgtgccccggttcttccagcggttttttcaaggattttccacgaggcattcgacttccatgcgatcttcggcggcttcgtcggttcctgcatgatgtacggaatcaagcgtggactttactctaatgaggcgggcgtaggctcagctccgaacgctgcggctgccgcagatgtctctcatcctgtaaagcagggccttgtacagatgatatcagtctttatcgacactctgatcctctgcacctgcaccgcgttcttatgtctctgctcaggcgttgacccatctggcatcacagacaatgcaacctatgtacaggaggcgcttcacgctgttctcggcggattcggcccggtattccttaccgtttcgatggttctcttcgcattcacgacgcttatcgggaacctgttctacatggacaacctcctgatctatctccataaaaaaatcccttcaggtcgttttatgcttggattccgtctggcagcagtgcttttgattttcgctggtgccagcatgaaggcatcgcttctctggaatcttgcagatatcctgatgggatttatggcgattataaatattcctgtgatcgttacccttcaccgcacggcgcttacagcgttaaaggactactgcgcacagcgcagggcgggaaagaaccctgtctttaaggctgagacagtcggcctcgagggaaaactcgatttctgggaataatgaattctaaatgacagaggtgcttttctacttaccgagcaccttagcaaattcttcctgggtgataggcttgtaatagagatatccctggatcatgtcgcagccggcatcgagcaggaagtcgcgctgcgcctttgtctctacgccttcagcgataacagaggcaccgattccgtgccccatctctatagtcgagcgtataatagcctcggaggtacggcttgttccgattttgtggatgaagcccatatcgagctttatgatatcaaagtcgaagctctcaagagtcgatagagatgacattccactgccgtaatcgtcgagcaggatgtcgattccgaggtctttcagctcctttaagaaattgatgccctcagtttcgagaacagcaaacgaagattctgtgacctcgaacttgatgtagtcgttcgcattctcaatggctttaatcctttcgactatgtaattcattatagccggattgtaaaaatcaatctgcgagagattcacatcgcaaggcactgtcttaagcccctgactctttctccacagattaaaatccagtacagaatctaccatcaggcgggtgatctttgagatctcgccgtttttactgaaggccgggagaaatttgtacggagccagaagtcctctcgagtgatgattccagcggaccagagcctcagcactgactatctgggaagtgccggtatcgacgacaggctggtagtaaggaatcagctcattgtcctttatcgagtgatccagatcccgaatcaggttctgagtcttcaggtagtcttcgcgcatcttactgtcaaacacgcctgtatagtgctcttcctcactcgtcttgttctcggccagtttcgcccagctgatcattacagacatattttcattgctgtcatgtatgtggtaaattccaagtcttatattgtaatcgtattcgattacattgtcctcgtaagtcctgaaggtgatgcggtcgagattctcctctgtcaggttgtcgtcagggacgagcatgacaaagtggtcggcctcgagacgacccataaggagcggatggagaatgtcttttagcacatgctgttcgttaaagatcagcagatcgccgttcttatccccaaagctgtcgttgaaatctttgaaatcctgaatatttgcgtagcagatcgagtacccgatcgagaggtcgaggctctttatcatattcgaggcagcccttgtgaagccgtcgctcgagtattcgtctgtcatccagtcgtggtcgatgataagctcgatatcgatgattagagccatgaattcgtcactgctggatcctctgtagattcgaaggctcttcgtccttttcccctccggggtatttacgtgaaaagccctgacaaagacgcctgctcttctgatatcagagaggacgacagacagtccggcctgatctggcagagtctgcttttcatcatctacactcagcttgtcagaaatcgtctggatcagctcatcgtaatcatttatagtaaggtcgcttataccatttttcttgaaaaaatcactgtagtggaagaactgtacggatttgtcctgtgcattgatctgaaacacagcgtcaaatgccgaatcggagagggtgctgatatccggagtctttcggtaatcactggctgtggagccggaaccgtaagttttctcctttgaatctgaaaaaatgcccatattgtccacgctttcataaaaactgtaaagtttatttgttacagcccacttctttattttaccactagaacagtactagtgacaatactataaaaagttaattctttactaagacactttacaatcccggacttttcatataaagtatggatgtttaaaaaaataaggattttttagaaagactgcaattatgacagaaaaaaataatacacgcaagccgatgtcgcttgaagaaatacacgcccgtcttctctatatgatgaaggtctttacgggctactgcgaagagcacggtctgaaatattacctggtcggaggaactctgctcggggctataaggcaccacggctttatcccgtgggatgatgatgtcgatatagggatgccaaggcctgactatgagaggcttttagaccttgcagagaaggagcctataggtgagggattcgatcttcgttccggggaccgcgggacactttcgattccgtatgccaatttcatggaccttcatactgaactcgatcgtgcgacctcagaatatctggcagagaagtatcagaacctgcatctttttctggatatttttccgtatgacggctggggtgatactgacgaagagtgcaggcaggtggtaaagaagggacagaggtatcttttccacgtgctgaattcgagagccaagtgctttcatggcacgacccttgcaaagaaaattttgaagacgcccgttgtactctttgagaggatcaggggaaataagagaatagtgcactctttctgctcatgggctaagtccgtggctgactacgacaccgcgaaattcattggctcaatcacctgtgtcacaggcgggatgggcgagagggtccacgctgaagatatcaaaagattcagaaaggtcccgttcgaggatacggaattctatgtgaccgaggcagccaacgagtacctgtgcggcaaatacggtgaagactatatggaacttccacctgctgagaaacgggtcacacacagaatgaaagtctatttagtttaaaatttctgcttgacttaaacggccaaatactataaaatatcatttgttcgtgactaaggcggacatgcccagttagctcagttggtagagcaggggactgaaaatccccgtgtctctggttcgattccggaactgggcacgcaggtgtagttcaatggtagaacaccagccttccaagctggatacgtgagttcgattctcatcacctgcttttttgatatcataatttatgcaggcgtcgtataacggttattatatcagcttcccaagctaaggatgcgggtccgactcccgtcgcttgctttttattgaatacgttcttgacgcttatcataaatctctgtaatattgaatggcatttcattctgtacggaggtttatttttttatgacaaagagcatgacggaaggtgccatccttccacagatcgttaaattttcaattcctctcctgctcggcaatatagtccagcagacgtacaatttcatagatgcgatgatcgtagggcggacgctcggagccgatgcccttggagccgtcggagcgagcagttctgtacagtttctggtgctcgggctttgcattggcacatgtatcgggttcggagtgcctgtggcgcagagattcggcgccaacgacctgaaaaatatgagacgattcatttataacagctgggttcttaccgcaattatgatggtagttatcacggcactgacggcgcttctctgcaatccgatccttatgcttcttaagactccgaagtctatttatcatgatgcttactggtatcttttgataatctttttagggattccggcgactctcgcctacaacctgctgtcgtcagttcttcgcgcagtcggggactcgacgacgccgtttattttcctgctgttcagcgcagtgctgaatattttcctggatctcttctgcatccttgtactgcatctcggggttccgggagcagcactcgctacgatcgcatctcaggcggtttcagcgcttctctgttatttttatcagaaaaagaagtttaaaatactgactattcaggaagaggagaagggcttcgataaaaagaaggcgctgaaacttctttacatcggacttccgatgggactgcagtattctatcacagcgatcggctcgatggtcgagcagtccggaaacaattcgctcggagccgtctacacttcggctttctcggctgcgtacaggataaagcagatggcgatgtgcccgtttgatgctgtggcctctgccgtatcgactttcgtcgggcagaactacggcgcgagaaatggagacaggatcaaaaaaggcatcagacagggcgttgtgcttggcgtaagttacggtattctgatagggcttgtcctgatatttttcggaagatatatgtcgatggcgcttatctcagataccggagccaaaacatcgcagatcctcgatgcttcggctgagctgctcagatacaacgggatcttcttctggcttctcggcattttaaatgtagtaaggcttgcggttcaggcactaggctactcaaatctggcgatcgtatctggtgttaccgagatggtggcgcgctctgtgacagtaatcggattcgtaccgctcagcggctacagggtcatctgctttacagatccgatagcctggatttttgcgacggcctattcggcgctgatctgcatctatgtcacagggaagatagcgaagagacttaaggcggaaaagggaagaccagcggttatgccttcataaaaacatgatttaaaaggtggttaagaaatttaacaccggaaccgatatagaaattagaattgtattgtgccatcacggatgcggcacgaattcatattttacagtcatatattcacaaggaggtacggattatggcaataggttcagttggatttggcggaataaatccactttacaacaagactcaggcgaagaaagccgacaagtcagagacgaagaagactgagactgatgcgcggcagacagcagagatttcgaacaagagcgcatgggcttcagacctcgagaagaaggttacagagaagaaggatacgacagagaagtctgacagcgacgaggctgtttacacgaatggcaagactgtcggaaagccgactctttcgaagaaggcagctgcttactacgagactctgaagaagaagttctcgaatatggacttcgtactcgtttcagaggaccagaaggcgaacgcccaggcgaatgctgcggcctatgcttctccgaataagaagacagtacttataaatgaggacaagatcgagcagatggctgcagatccggagtacgccaagaagtacgagaacatcattgaaaactctgcaaagcagctcgacggcatcagcaaggacctcgaatccaagcttggaaaagacgttctgaagggtgttggaatgcaggtcgaggacaacggtatggttaggttctttgccaccgtccgcgatcagaataaggtcagcaacgaggctttacagaagagacaggctgctaagaaggctgcagctaaggaagctgcaaagaagtcagcgaagaaggccgctgagaagaaggcagaggagaagaaagccgaaaaggcggagaaatccaggacagggacagcagaccagaagtccacagatacgaagacagatgcagccaaagatacgaagacgcagacgactgcagatacgaaagcggccgatcggtcttcggattcagatgatgacttcacatacgttgagaagaaccccggcagcagcgataccggtgaggttactccatgggacatgtatggtacgaagaccatttatgctaattcgatagaagatctgtacaatgcagtctccggatatctctcaggttcagatgcctacacctcaggcaactctgttgactatcatggctgatgattttatttgtcagagattggtatagcgaggattgatgtataaactggcggtatatgggaaaggtggcatcggcaagtcgactatgacgtcgaatcttgccgccgccttttcttttttaggaaaaaaagtaattcagataggctgcgatccgaaggccgattcgactatgaatctgctgggtggaaagcctataaatgctgtgatgaatatgctgcgggacgatatggacccgcagagcattgaggatgtagcgaaagtcggctatggcggagtagtctgcatcgagacaggtggtccgacgcctggccttgggtgcgccggcaggggcattattgcgacctttcaaatacttaaagatttgaaattagtagagacgataaagccggatgtaatactattcgacgtattgggagacgtcgtctgcggaggctttgccgccccggtcagggagggctacgccgacgaagtcatgatcgtaacttccggcgaaaaaatgtctctctacgctgcagacaacatctgcaccgctgtaaaaaatttcgaggacagaagctatgcgaaagtccgcggcgttcttttaaacaagagaaatgtcccggacgaggacgaaaaagtaaaggctttcgctgatgaaaagggaatccaggtccttggcactataccgcgctccgacgatataaacagggcggaggagaaagggatgacagtgatagagatggaccccgagcttcgaatcagcaggaaatttatcgaactggcagagaaacttattgacaaaagagactgagacagagaggcttatcgatgagagaagttgaagcggaatactatacggcagaggacttagccaggaggattgaagcggatccatctgactggatacctgacgactttaagagcggtcatactcttgtctattcgtctcctgctacactcgcattcaattcgccgggagccgagggctttggcgttaagcgggccgcgctctgccttccggaatcgatcgagcttatagtctctccgcgttgctgtggtcatatgagtacagacctgccgggaggaagggagctcaatgaccgtatttttttcatggaattaagtgagacagacctcgtgaccggaaggtatataaagaggattccggacgaggcacagactgctgtagatgaaaggactggtgcgggatttccgaagccaaaggcggtaatgctggtctttacctgtgtagatgcgctccttggcacggatatggattatgtggcggcggcctgtgaaaaaaaaacagggatcagagttgtcccggctccgatgtatgcgcttacacgggagggcatgaaccctccgatggtgcaggtcagaaggagcatattctctctccttgaaaaaagagagagaaatccgcatgcggtaaatgtccttggaagtctcggaggaattacaaaggagtgcagagaagagctggaagagatcctttttcctgcagggatcactaagatacggactctctctgactgcaaaacctttgaagaattcaaggaaatggctgatgccgggtttaatatcgtaatagatcaggatgccagggctgcagccgctgatatgcaggagaagcttggaatcggatatattgaattgcagagattctatggggctgacaggataagctcgcagtacactgcgttctgcagagctctgggaacagactccggaatagttgataaacttcaaaaggaatacgagccgcatattccgtcaggtgattttaatttttcaatcggtgagtgtgagaatgccattccggcagaactcgcgctggctctgctggaatatggttttgatgtttctgaagttttctgcgctctggcgccaagagatgcctggtatatccttcatatcgcagagaagaatccgaatacgaagttcttttttaatcagcatccttcaatggtaggatttcgaccagacccagatgcagacatctgtatcggaaaggatgcctgctggtattaccgggatcagaatacgaataagatatcctttaacagcgacagacagccatttggattctcagctctccagggattttttaaggaaatctctgattcgaatcccttaaaacttgagaaatatcaggaaaataacaaggtcagaaatccagatatgataaccgaccagtcgggggctgtttctgtagtttttccaatggattcgcttactgtaataatagatgcaggcggatgtaccggaaatatctgtggttttgatgaaccgcgatggttcagccagaaggctgtgatattttctgcgggcttaagagatatggatgccataatgggccgcgacagagaacttattagaaaaataaaagatgcagcagaactgctgcatccttcatttatcacattgatagggacccctgttccttctactatcggaactgactacgccggactaaagagagaactcgagaagcagactggaattcccgtagcggctgtaaatacaaacggtatggagagccgtgaaaagggcgttgacaaggcgaagcgcgcattaaagagcatatttccggatcagatctgatttaagaatttcgatacatgataccaggcggcaccttttatagcagccttcgaggaacttgctatcgtcagatagtcgactttatcgccgaatggatcgagccgcccgacctcttctttgagataatccaggtatggacccatatagtcagccatgatgccgccgatcacaatatcgcagtcgaaagccatgcgcaggtttattatgccgattgccaggtggtacaatatatcgtagaaaagtgcggtccttggacccttgccgtgctctttgttcaactcatcgaaaaactggtcgagtgagatgccgagatcccttgtgatacgcagggcagagcagtaggcttcaaggcagcctctctgaccgcagttgcacattcggccatcgggcacgatgcgcatgtgaccgaattcgcagctgtgcccggtctttccgcggagctgttttccgtcgataaaggctgatccgccgacgccgttttctacgagaagatatacgaaatccttcgactgaccggtagtctcccttatccttctctcttcaaaaccagcgcaggtcgagtcgttcattacacagaccggaaggttggatttcttgataaaatcggataggttgaagttctttaacttgagagttggagagagtacgatcgtttcactcttcggatcgaaaataccagggatagcgatgcttataccgagaagcctgtcatatgggatcttcgactccttaaaaaatgcatccatatctttcatcagggcatcgctgtctatctcgtcgagcgctgcgtttggaatccggatgcttttataggcaatctcctgctgtttcaggttgcctgcccagaatctgaaatggtttgaggaaatattgatgccgagagagtaccttacaccgggatttacctcatagccgatcggcgggcgtccgccggtcgactgctttatctcgccggctctgatgaggtctgcattcagaagttctgtgatgttctggtgtacagtcggaagagaaatgttaagagagccagatatctcctgcctgctcaccggctctgcagaattgtaaataaacctgtatatagaatttctcgtgtgtcttctgcgttcggtcacagtcgactttaatttttgattttttacatcctgcatttaatatccctcaatgaaaagtctttaagacatcatcatatttcgtttataaatttagatacctgaagccacgctgctccctggattactgatttcgaggtcttcgcgagctcaagatagtcgacttcctcattgaatggatcgaggtttcttacggtagctctgaggtagtccatataaggtccaagatattcagtcagataaccgccgactactatgtcgcagtcgtacgccattcgaagatttacgatgccgatagccaggtatttaagcatatcatagaaaagagcggtccttggtcctctgccctgttccctgcctacttcatcgaaaaactgctcaacggaaatgccgagatcccttgtgatacgaagcttagtcgtataggcttcgagacagcctctctggccgcagttgcacattctgccgtcgggtacgatgcgcatgtggccgaattctccattgtggccggtctttccgtctatctttttcccgttgataaaaattgctccgccgactccatcgtctaagttcagagagacgaagtcaagtgattcaccgttgatctgtctgatacgcctttcctcgtatcctgcacttgaagcgtcgttcatgactgagaccggaaggcttgtcttcttcttgaaatcagacagatggaaattcttcattttcagggtaggagagatgactatcttttcagtcttatcgtcaaagattccgggaatcgcaatcgtaatacccaggaccttgtcaatcgggatatttgactcctcaagaaatctgtccatgttattcttcaaagcatcactgtcaatatcgtcaaactcggtgtttgcgatatcgatgcttttgtaggcaatctctttctgctttaagtcaccgacccagaatctgaaatggttgtaggtgatctcgattcccagtgaatagcggatatccgggtctatctcgtatcctacaggaggccgtcccccgcttgattccttgatctcgccggctcttataagccccgcatccatgagctcagtgatattctggtgaacagttggaagggaaatatccagtgatgaagatatatcctgtcggcttaccggctctgctgagttgtaaataaacctgtatatggaatttcttgtcttccttctgcgctcagtagcagtcggcataagctttttcttttttccgttcgccatctcatttccctttcctggagagcttttccctgagctcttcgaggcggtctgctgccagatcgtcaacgaggcagtatgcttcctttacagcattgcttaccggtgcaagctcttcgtccatgttaagcacctgtggagcgccatagattatcctccacgcgtccatgcactgatctgcaatcttgtactcgtcgctgacggaaccgaaccccagaagcctttgcccctcgccttttgtcccacttgttgaaaaaagtctcatagcggcgtttctcatctcatctataaagaactgatcgacgccggcactccccgtaagtgcattaagagtcttctttactttctttgcttcacgtttcacaaagaaagggcgctgccttactaatatatcaagacacatcagaaaccagagataacggtctctgcctaagttcttttctccggtcttctcatcgctgtgccttattagaaagagctcctttgccctctcttcccccgattcggccagaagctgctgccggatctgtgggtctgtttcaaaatagtatttgtctgtcataatgccaatcatagcacaataatcagagttttacaaaagatatttacaaaagtccttttcaaaacaactgaatttcggacaaaataatgctattttagcataaagttaaaatcaattgaatatttgcgaaaacggttgtttttgggcattttgacaagtttgactttacagggtaaaaatacaacttgtgcaaactgcacaaaattgcaagactaaatttgttaaaattagacaaaaaggacatttatgaacattttatgttgactttcacagtgaaaaattgtatattacttttcgtaaagcacttttgttaaataactttacgaaagccgagggtcaatcatctgggacgctggatattaccgccgacgagcggaagccccttgacttttatcaaaggtcttagtaaaagtggaggttgataaaggttcagaaggaggacttttatgaaagcaaagaaggttgtatcattattaatggcaggagctatggctctgtcaatggcagcatgcggaagcactgcatcgaattcaggctcatcaagcagcggatcaagcagcaagagcacaagcacaagctcatccaagtcaggtggcaagacagttggtatttcaatgcctacgaaatctcttgagagatggaaccgtgatggttcttacctgaagaagcagttcgagtcgaagggttacaaagtagagcttacatattcagataataagtcagctcagcagaacaacgatatcgagggacttatcgctgataaggttgatgtacttgttgtagctgctatcgatggtgaagctctttcacaggtacttggtgaggcaaaggatgccaatatcccggttatttcttatgaccgtctgatcatgaatacagattccatcagctactatgtatcattcgataactacaaagtaggtcagttacagggtaactacattaaggatcagctgaagctcgatagcgcaggcagcaagaagtacaccattgagatgacaggtggtgacccggctgataacaacgcaccattcttcttcaagggcgctatggatgtccttcagccgtacatagacaagggcgttcttacagttccatcaggacagactaagttcaaccagtgcgctacagacagatgggatacatcgacagctatgaagcgtatgcagaacattcttggttcttactactcaggtggtaagcagcttgacgcagctctctgctcaaacgattctactgcacttggtgttactaaggctattgagtcagattacgcaggaaagaataaagtacttatcaccggacaggatggtgatgagccgaaccttaagaacatcgttgatggcaagcagtctatgacagtttacaaggcagttgctaacgaggcagtcgttacacttgacctcgctattcagatcatggatggcaagaagccggatgcaagccttatcaagagctcaggatggaagttcgattgcgcatatgatacaaagtcatatgacaacggcaagggaattgttccttcatacctgctgactccagaggttgttactaaggacaacatggataagcttctcgtagatacaggatactacaagaagggcagtgacggataccttaaagcagtaggctgaggtttcgctttaacagtacattgtttacaacacaggaggtaattacttgtcagacactattcttgaaatgaagaatatagtcaaggaatatcctggtgtcaaagcacttaataatgtcacatttaaagtagaacggggtgagatccatgcgctggtcggggagaacggcgcagggaaatccacccttatgaatgtgctctccggagttattccttatggggaatacaccggagatattatttataacgggaaagaatgtcagttccacagcattaacgaatctgaggagaccggtattgcggttgttcatcaggagctcgctcttattccggagcttacgattgctgagaatatgttcatgggaaatgaacgtcgcaacaagttcggagttatcgactgggacaggacattcaaagaggcacaggacgctatgacacgcgttggcctcaaggaatcatcccacgtgcttattaaagacatcggaacaggaaagcagcagctggtcgagatagccaaggctctctcaaagaactgtaagcttttagtacttgacgaacctacttcatcacttaacgaagaagattcgaagatgctcctcgatatgcttctcgatttcaaaaagcagggcatcacttctattcttatcacacataagcttaacgaagttgcatattgtgcagaccagatcacaattctccgtgatggccagacaattgagactatcccaaacccaaatcacactatcgatgagaatcgaatcattaaaggaatggttggccgtgagctgaccgacagatatccagagcgtgagcacaatgtcggaagcgaagtcgtatttgagtgcaaagactggtcagtatttcatccggtttacaccgagaaatgcctggatgatcatgtaagtttcaaagtacataagggcgaagtagtcggattctcaggactgcagggtgccggacgtacagagcttgcaatgtcgcttttcggaaagagttatggttcccatatcacaggacatgagtatatcaatggcaaggaagttcatcttaagaacgagtcggatgccatcaagcacggccttgcatatgccactgaggatcgtaagactaacggactgatcctcgacgagactattgcccgtaatactacacttgcccgcatggaaaagatagcaaacaggcacggtattgtaaatgttcctgaagagaacaagcaggctgaaatatatgtcaaggaaatgcataccaagacacctagtattcagcagcatgttggcaacctttcaggaggaaaccagcagaaggttcttcttgctaagtggatgtttacagagcctgatgttctgatcctcgatgaaccgacaagaggtatcgatgtcggagcaaagtatgagatctatcagatcataaatgatatggtttctcagggtaaggctgttgtgatgatttcatcggagctgccagaacttcttggaatgtgcgaccgcatttacgccatgaatgagggacgcgtagtcggtgaatttgaagctaaggatgctactcaggagaagatcatgagtgctatactttcttcaaataataagaacgtaagtcaagccggctgatatttgatatacggaggatatcaatgaaaggtaaagattttgtaaagaaatataccatggtcctggcactgatcctggtatttattctgttcacgatattgacgggcggccgacttatcatggcacagaatatatcgaacctgcttctgcagaacgcatatgttcttgtcatggccagcggtatgcttctttgtatcctgacaggtggtaacgtagacctttcggtaggttctacactgtgtctttcagctgctatagcagccaagctgatgcagacaaatcattcttctgcaacagctgttatcgtagctcttcttatttcagcagttatcggtctctggcagggctggctggtcggatatgttcatatccctccattcatttgtactcttgccggaatgttcctcttcagaggaatcgcccgtactatccttgattcaaagaccatcagtatttcaaaagagggcttcctgaatctcttcacatcttacattcagatcaagggagtcgatcaccttggaaactgcccatcagctatggtaatcggtattatcatcgctatattcatttctatcttcatgatcgctgatcgtggaaagaaagctaagcagggctatcaggtagcttcaatgggaagcacgatcgcaaaggttatcattttcgatatcctgatcatcgcttattcttatgaacttatgggttacaagggtgtcccggtaatggttatctggatcctcgttgttgtactcatctttggtttcatcactgaaaagacagtattcggccgttacttctacgcagtaggtggtaacgagaaggctacaaagctttcaggtatcgatcctagaatggtatacttctgggcatacttccttatgtcagttctcgcaggtctctcaggacttctcgttggagccagaatcggatctgtagatggtaacatgggtaactcatacgagatggacgccatcgcatcctgcttcatcggcggtgcttctgcttatggtggttctggtaagatccctggagttatggtaggtgccattcttcttggtgttatcaacatgggtatgtcaatccttggacttcctgatcagtatcagtacatcgtaaaaggtgcagttcttcttgcagccgttatcttcgacgtagtaactaaccataagacaggaaagtcatgatactggagtgacgcaaatgtattatattggcgtagaccttggtacatcagcagtaaaattactgctgatgaccggggatggtaaaattgaaaaaattgtatcagaagaatactctctctacttcccgcatccgggctggtcagagcagaagcctgaggactggctcgatgcagtattaaaaggcatcaaagagctgacagagggtattgacaagactcaggtcgctggcattggtgccggtggccagatgcacggtctggtagttctcgataaggacgatcaggtaattcgcccggctattctctggaatgacggacgtacacaggaagagacagattatctgaacgataccataggaaaggacaagctgagatcatataccggaaatatcgcatttgccggttttacagctccgaagattctgtggatgaagaagaacgaaccggagaattttgcaaagatcgcaaagatcatgcttccgaaggattacattaactataagctttcgggtgtaaattctaccgattattcggatgcatcaggtatgcttcttctcgatgttaagaataaatgctggagcaaagaaatgctcgatatctgcggtatcacagaagatatgatgccgaagctctatgagagctatgatatcacgggtactcttcttccggagatggctaaggagctcggacttcctgaatctgtaaagattgtagcaggtgcaggagataacgccgctgctgccattggtacaggtactgttggaaatggcagatgtaatatcagtcttggaaccagcggtactcttttcatttcaagcgacagcttcaatgttcctccagatggaatccactcatttgcacatgcagatggagcctaccatctgatgggatgcatgctttcagctgcttcctgcaacaagtggttcatggatcagatcatcagaacttctgattacccaaaggagcaggagggcattacagatgacaagcttggcagaaaccacgtctactatctgccgtatctgatgggtgagagagctccgcacaacgatccgttctgcagaagctgctttatcggcatgacgatggatacttcacgtgaggatatgacacaggcagttcttgaaggagttgccttcggaatccgcgattctcttgaggagatcaagaggctcggtgtcgatgtaaaaaagagcatggcttgtggaggcggaatgaagagtccgctctggagaatgatttttgccaacgtccttaacatcacactcactattcctgagacagagcagggacctggttacggcggtgcgattctcgctgcagttgcatgcggagagtattcatcggttcaggatgcctgcgataagcttataagagtcactggtgaagtgaaacctgatcctgatctcgctgctctttacgagaagagatatcagacatttagaaagttatatccggcactgaagggaatcttccctgagctgtgatattttcatttattttttggaaaggatgaatgaatagtatgacatcaaatattccagtagttaaggttggaatcgttgcagtttcaagagactgcttcccggctccacttgctgtaaacagacgtaaggctgttgtagaagcctacactaagaaatatggcgcagatgacatttacgagtgtcctatcacgatcgtagagtcagagatcgacatggtaaatgcgatcgaggatgtaaagaagaatggctgcaatgcaatttgcgtattcttaggaaactttggacctgagatttcagagactcttcttgcaaagcacttcgacggaccagttatgttctctgcagctgctgaggagagatcagacagccttggagttgagggacgtggagacgcttattgcggaatgctcaacgcttcctacaacctcgctctcagaaatacaaatgcatggattcctgagaacccggttcgcgatgcagagggcgttgccgacaacatccatgacttccttccgatcgctcgtgtaaagcttggacttgacaacttaaagatcatttcatttggacctcgtcctgcaaacttcctcgcctgcaacgctcctataaagcagctctacaatctgaatgtagagatcgaagaggagtcagagcttgatctctttgaggcttacaagaagcactacacaccggacgagttcgatcttgatccggctgttgtaaagaagcagaacgaagagatcgcttctatcaaggctgatatgcagaaagagctcggaatcgcaaatccaaacgacaagcagtcagatatgctcgacaagttcgcagcatatgaggctactcttctcgactgggttgaggccaacaagggatatcgtaagtatgttgcccttactacaaagtgctggcctgcattcgaggatatgttcagattcgttccttgctatgtaaactcaagacttactggcagaggaatccctgtatcctgcgaggttgatatttacggtgctctttcagagtacatcggatggtgcgtttcaggtgagcctgttacacttctcgacatcaacaactctgtaccgaaggatatgttcgagaactctatcaaaggaaagttcgactacgattggaagcagacagatacattcatgggcttccactgtggaaatacatgctctacaaggcttgttaaaccgcacataggataccagaagatcatggcaaatacacatccgaaggagtggtgcgacggaactatggagggcgacatccagccaggcgatatcacattctatcgtcttcagtctacagctgatgcaaagcttcgcgcttatgcagctgaaggtcaggttctcgatgttcctactcagtcatttggttcgatcggtgtattcgctatccctgagatgggccgcttctaccgttactggctgatcggaaagaacttcccacaccatggcgctgtaatgttcggtcactatggaaagactctttacgaggcgctgaagtttgtaggtgttaacccaactgagatcggctacaaccatccggctggcgatcgctatgaggatgagaatccttggggaactctttgataattttttgataagaggaattctatgaaaatttacaatgtaacagatcctgagttcaaagaatacggcaggatcattgaaggatacgatgtatccgaaatactcgatgcattgaataaaaagacgccgtgtcctgaagagggtacaggctatgtgccgaaagaggaagcaattcagaatctcgattctgcaaaaactttagctccttccctctttggtggtatgcctgttgagtttggctggtgcaacggccacaacacaaagctcaattgccttgagtatcacagaaattccgagttcaatctcggcacagaggattttatcctgattcttggcctggctaaggacatcactgactggaagctcgacacttctacctgcaaggcctttaaagttcctgctggtgtcctggtcgaagtcttcgagacaactcttcactatgctccgtgctctgcttcaaagggcgcaggctttcgagttctcgttgcgcttcctgaaggcacgaatacggatgctcctgctactgctggtaagagccctgaggataagctccttcgtgcaaataataaatggctcctcgcacatcctgatgctccggaagctaaggatggtgcctggattggcctcactggagaaaatattgatattgctgacgatatctgatcagttcctccttttgtgttttggccccgtggatcgtttggtccgcggggttctttgcatcctccgccagcgtatggcgaactcagtccgcgttttcctgttcggtcgcgcgcgcctattcgcgggcctctgaccaatgtatggttttgtaatgtttatggttttggcgggtggtcacccggcccgctgctagcgcgctccctctcttcggaaaacgcgcattcgttcgccatacgctggcggaggatgcataaatcgccgaacttgtcatacgcccaggctggggagaaaattatcacaataaagctcgcctgtgttcaaatgtataaaatatcagaatcttccggctccgcggggcggaagattatcactatagtgtctttctggggcgatttaactcatttcattttcacggtagattagaaaagtaatcagtttgctacaacggtttttttatattttctctatacgattaaataagcttgcgttgctccaaatctgatatttttattttcactttaagataagaattaaatattttgctacaatgccgtgttgcatattagctacgcgggagctggatgtgataaaacagtacttttataatgcgcagtgtattttggcagttggagcatatccgcgctggaagaacatattgtgagaatttcaggctcccataagtcaaatgatgtgaaaacgcgccataggctatctctggggcgaagtttttctgccaggtggtgtgcaatattagcagtttattatatagttctgtaattgcgttttcacgcgcctgactgtataattgtcacatggattattttcgaataaaaatatacggtattgttcagggcgtgggttttcggccgttcatatcaagactttttcaaggctgcaggggttctgtaaaaaattgtggttcttatgtagatgtgctgcttaaggctgcgacagagaaggagcagctgagaaatcggataatagtgaatgcccctaagcgcgctgaaatcgtcgatattcaaatacaaaatctctcaaaacaggaatatcaggatcttttaagtgaagatattccggagaggggcgaatctggcaagagctttttcattgcgaagagtcccgaagagaaacctgctggtgagcctgtgttcattccgccggatctcgctgtttgtgatgactgtgcgagggagctatacgacccgtcgaaccgaaggtatcttcacccttttataaactgtactcagtgtggcccgcggcttacaatcatcgattcgctgccgtatgaccgctatcgcacttcgatgaaaatttttccgatgtgtgggccttgcgggaaggaatatacggatccgcatgaccgcaggtatgatgcgcagccggtctgctgcaatgactgcgggccgaaggtttattttctgaagcatgattcgaagagcggccctgaaattgaatctcacgatgcggattattctaagattacacgtcacaatgcggattattctaagattacacgtcacaatgcggattattctaagattacatgtcacaacgcggatgattatgaaatttcatcccgtaatggcgacgcgataacacaggccagacgggctctgataaatggggaaattattgcggtaaaaggtattggtggttttcatctctactgtgatgcctcaaatgaaaatgcagtgactgaattgagacggcgcaaagggagaccagcgaaaccttttgccgtgatggcgaaaaacctgttaaccgtcaaaaaaatctgcgtcgtcggaaatgacgcgcagactgaacttctcacaggacacagaaagccgatagtgcttcttgaaaaaagggctgtgtctcaaaaaaacgtcgccgattctgtcgctcccgagaacgattcccttggcgttatgcttccgtatgcgcccctgcagctccttcttttttcgtatcctgacggactcgatgaaaaaatgccagaggttcttgtagcaacgagtgcaaacagaagcggcggggtaatctgccggacagaggaggaagttgagaagactctcggaaatgtctgtgacgcaattctctcgcatgacagagaaattcttacgagagccgacgattcggtcgtggatttttttgaagagaagccatatatgataagacggtcgaggggatatgcgccgctgccggtgacagttacggagaaactctttgacaaaaatgtaaaaaccgcttcagagccctcggctgacaggaattctgatgatatcctggctttcggcggtgagctgaaaaataccttctgcattggaaaaggaaggctcctctatccatcttcctatattggggatctgagtgatctgaatagtgacagagctctcgaggagacggttgagagatttctccgtatgctcgatgcgcatcctgcggtcgtggtatgtgacaaacacccttcttacaggagcagggcctgcgccgtaaagtttgttgagaatcatcctgggacaaggcttgtcgaggtgcagcatcactacgcccatgtgctctcggtaatggctgagaaccatttttacgataaggttatcggagtatcctacgatggcactggttacggagatgacgggactatctggggcggcgagatttttctctgtgatgtaaaaaaatacaggagagtctggcatataagtccgtttattttttcgggaggggatgtctcggcgagagagggattccgcgtcgcgctgtcgatgctttttgacaaatataaaacggaagagatttatgatataataaaaaggcttgatctctgcgatgaaaagtatgtgaagcctttgagagcgatgcacgatacgggcatcaattcagtgatgtcgacgagctgcggcagacttttcgatgcggtaagcgcagtgctcgggatctgccggagcgcaagctacgaaggtgaggcttcgatgggcttagagaccgcggcggagaggtatctgcgaagcagaaatgtgacttcccgatatgcagatgatctttacagaaaagtctttttagatgatgcagatgatccctgcggaaatgaaaacgatctttgcctggatgtgacagatccgcaaagcacttcggagcttttttacaggatagttgacgcaaagcttgccgggggagacagtggaaagctggctttttatttccatcgcgagcttgcgaggatcactgtagaagaggctcttaaagtaagaagcgagtcgggatgcgctgctgtggctctttccggtggctgttttcagaacaccctgctcctagctcttacgaaaaacggactcgaaaaaaatggatttaaggtgctgactgcgcacgagattccgccaaatgacggtggtatttcactggggcagtgcctgaaaggaaaagtatgtgtgtaggtttatcagttaaagttttgtctgttgacaaggatacgatgatcgtcgattcgggtggcgcgaaacgaaaagtttcggcggcgcttctaaacgacctgcgtcccggtgactatgtcatggtccatgccggggccgcaatttcaaagataacagacgatgatgccgatgagagctcctctgtctgggagagcttcaaatgagcgcgacagaagaggcaaaacagctgctgtcagattacgatgggcctgcgattcacattatggaagtatgtggaacgcacacgcatgagatttttaaggatggaatcaggcagctcctttcacctaagatcaatctgatctcggggccgggatgccctgtctgtgtgacgccagccgattttatcgacgaagccgtgatgctcgcacttgagaaaaactgcacgatcacgacttttggagatctggtcagggttcccggctctgaaaaatctctcgctgatgcgagagccggaggcgcgaaggtaaaggtcgtctatgcgccttctgatgcagtcgattatgcgaaaaagcatccggatgaggacgtggtatttttgtcagtcgggttcgagacaacggtgccatccgagtgccttactgtgcagcaggctgtagagcagggaattaaaaatttctcactgcttaccgcaaacaagaccatgccgggcgcctatcttgcgatgcgcgaggcgacagatgcttttctctatcctgggcatgttcatgcgattatcggaacttcactctgtgaaaaacttcgcgacgaatatggcatcagtggtgtctgtgccggctttactccgtcggaacttctgatcgctctggcgcttgaagtcaggggactttcaaagggcaagccattttttatcaatgcgtatccgcgcgttgtgacacatgaaggctctccgaaagcagtcgaattgattcataaatatttgaagcctgtcgatgcagtctggcgtggaatcggtgagataaagggctcaggtcttgcactccgtgatgaatatgccgacttcgatgccaggaaaaaatattcgctgcctcacattacaggtcgtgacaatcctgcctgccgctgcggcgaagtgctccagggcaggtgtacatcaaaggactgcccgcttttcggaaaagcctgcactccggaacatccggcaggagcatgcatggtttcatcagaaggcgcatgctcagcctactatctttacggacgtggcttttaaaagggtgattctatgctggaatttaacatgccggtccacgagggctggaacatcgttcatattgcaatgcaggtgccggagtgccaccagatctacgtgtgtccggagaactgcgcccgcggcgtcgtgatgacggcatatgagatgggagcgcaggacaggttttcgtgtgtcagtgtaagtgagagagatctgattgttgacaatcttgagaccgtgactatagacggagtttcgaatgtcgttgaggagctgcgcgaaggcagtgagcttcccagggtgatctttctgtttacagtatgctctcacagaatcctctcatgcgatttcaactatgttttcaagactctcagggataaatttcctgagattatctgggtgcacgcctttatggactgcattgcgcagaaggaaggcccgacgccggatatgaagctcagaaaggcgatgtacgagttcattccgaaaacacattccgatgaacaaattgtaaatatcctcgggagcgaggttacggcgactcgcgaaaataacgaccttataaagcaatatgaatctcatggttataaggtcagacagcttgcagatatcaaaacttttgacgagtatatgcagcttggcaatgcagctttaaacatctgcatgttaccgcatggcgattatggagtgagaaatttttcggagaggctcgggattccgtatcagtacaaacttccatattacgataagattgatttgggctggatcagacctgaattggaatcagcacgaaatgtaataggagatactccaatcgttatcgattcgatggctgtcgtttgtccatacagtttcgctgaatttttgcttgataatagttttaatgtttttgcagtcatcagcgatggcccggctgattacgaacagggaatctttgagaaacttcaagaaaaatatccatcgcttattactattaatcctattgatcctgtattacgggaagaaaagtacagggagaatctaataaaaaaggcggattcttcaaagattctcggcatcggccccatggccggctgggtatttgatacaccttattttgtaaatcagattgaaaatgacggggcctatggaaatcttggagtgaaggctctatttgaaaaaatcagggaagctgttaacattccgaaggacatcgaaaaaactgtagtgcagaagggacttggcagcgagaggtgcctttttggataggaataattttatatgataagtattagaacagcagaaaaaaaggacttcgaggctcttgagaaaatctcggtatcatcgatgagcgagccctggcatgaaaaggacttcgaggcggcttacaagaatgaattcgcggtcatcatagcagcgtttgataaaaaagatggcgaagagccagtggggtatgctgtcggatattttgcttgtgatgaggcggagcttccgtcgatcgcggtaagaagcgacaggagaagactaggtatcggaaacaggcttctcgaggcactttttaaagagatgaaaggacacggggctgcgaagattttccttgaggtcagggagtcaaacgaggccgggcttgcgctctatgagaagaatggctttatcacagtggggacgagacggcatttttacggggatccggaggaagacgccctggtgatgatgagattactttaatttttaataagattttacattttactactttacggacggttgattttgtgagaaaataagctttgatgttaaaagtatgtaattgaaaggagtttcaatgatttacacagcagaagtacagaatatgtgccctgtcgctaaaggtgcaaagcatgagccggcaccgattcctgaggaaggcaaatgggtttatgcaaagaaaatcgaggatatctcgggattcacacacggcgtaggctggtgtgctccacagcagggtgcctgcaagctttcactgaacatcaagaatggtgttattgaggaagctcttatcgagacgattggatgctcaggtatgactcattcagcagctatggcagctgagatccttcagggaaagacgatccttgaggcactgaacactgaccttgtatgcgatgccatcaacacagctatgagagaacttttccttcagatcgtttacggacgttcacagtctgcattctccgatgacggtctcgctatcggatccggactcgatgaccttggaaagggacttcgttcacaggttggtactatgtatggtacaaaggctaagggcgtaagatacctcgagatgaccgaaggatatgttacagaccttgctctcgatgagaacaacgaagttatcggctacaagtacgttaaccttggaaagatgactgatttcatcaagaatggtgacgagccgaacgttgcctgggagaaagccaagggccagtatggtcgtatcgatgatgcagtgaagtttattgatccacgtaaagaataatagaagggaaacgtacaatggctttatttgaaaaatatgacgaaagaataaaacagatcaccgagacccttaacaaatatgggatcaaggatatcaaagaagcagagaagatcacaaaggatgccggccttgatgtttatcatcaggtagagggcgttcagggtatctgctttgagaacgctaagtgggcttacacagtaggcgccgctatcgctatcaagaagggatgcagaaaagctacagatgctgctgcagctatcggagaaggacttcagtcattctgtattcctggatcagttgctgatcaccgtaaggtaggtctcggacatggtaacttaggaaagatgctgctcgaggagagcacagagtgcttctgcttcctcgcaggccacgagtcattcgcagcagctgagggcgccatcggtatcgctaccatggctaacaaggttcgtaagaaacctctcagagttatccttaacggacttggaaaagacgcagctcagatcatctcacgtatcaacggtttcacatatgttgagactaagtttgattacaagaaccagaagctcaatatcgtttctgaaactccttactcaaagggcgtcagagcttcagttaagtgctacggtgccgacgatgttcaggaaggtgtagctatcatgtggcaggagaacgtaggcgtttctatcacaggaaactctactaaccctacaagattccagcaccctgttgcaggtacttacaagaaggagagaattgctgctggcaagccttacttctcagtcgcatcaggcggcggcacaggacgtacacttcacccggataacatggcagcaggtcctgcatcatatggtatgacagatactatgggccgtatgcattcagacgctcagttcgctggttcttcatcagttcctgcacacgtagagatgatgggacttatcggaatgggcaacaaccctatggttggtgctactgttgcagttgccgtttccattgaggaagctgcagaggctggtaaattctgattccagaataacgaattaagataaaaaaagagaccgtgaggagatttctcctcatggccttttttttaataaagatatgaaattaatgcacgatcctggcattgtattccatgtttatctcttttatctctttctctccgtctatatagggctggtagaagctgtctatactgccgccgcctaaagtgtcgcagccgttgcagaattcacactcatggccgcaggctgaaagcgcctgctttacgatacggattcgctcttctctggtagtgtcttttataagaattgacttcatcagatcacctctttcttaaaaaaatcacctgtacctgataattatatcacgaagtttatggaagttcactctcaaaatacgatatcagtgcgttgatatttatgtccgagtgctcgacctccctcgaatagaggtagatgacttcattcaaaggaatttctgtgttggcggcagagatcatttttatccatctcacactcattactgcgatcatcgccctcgcgtaaatttctccgtcgtaaatactcccgcagaaatagacgaaaagaagcgattccaggatcttttcaaaagtgaaggtatcggcggaaaacatcacctcacgccacttgtcttctgaagcttctgaccagaattctgaagtggaatttattgtttctgtccaggatgactccatgacttcgaggctttctaacagctcaaagctgcgcatcatgtaatcatacgaaaaaataaagccgtggcggaggtcgtcgccggggtctttaagtgtctcgtatgagacatcgtccatcccggctatatttccctcgtcaaaaagttcctgaagccgaaacgatgcttgtgatatcatatcgagcctcttctcgaaagggatatcctttttcttagcgatagagagcatccaatctcttgcgaagacaagcttgtcgtataaaaaatagtcgaacccgtcgtaatcctgtgaatcctctctgtcgtcttcgcgctcttcaaatgaaaaatcagctttcgattcaagcatcatgcggacgacttccgggcaggacagggagagggagtactccctgatatcagggaactcttcaatgtgacggggaaagagacggcaggtgttgcagagagcgccttcaccaagaaagctctgcaggtcgcagaggccgcttacagccaacatgctgcagcatcgaccgtgctgcctgaagcaggagtttttgaaatcgactccttctctgaaacggtcttcgaaaggaccggagtatttacgatatttttttaaggacttgtcgtcaatcattatctgccagccttcgcagcagctcttagggcatttgtcggcgatgcatttgaacttatcaaaatcaatctgttttctatagagcatttatatcaccttgtggctcagccatttgccactgaaaaatcttatcatgattattactccgcgaatggcccagtcgcagaacattccaatccagactgctataggtccgaaatggaagactcttatcaggaccgtcgcgaggactactctgcagagccacatcgaaatggtcgagaggatcatcataaatttcacgtcgccagccgcgcgcattccgtatgccgggtcgaaggccggcacccagagtatcggtttcattatggaaatccagcccatcatatacatcgtaaggtcgatggatttctgtgagagtcccgagaggataagtataggctttgcaataagatagactatggcgcagcctataataatcaggatctctgcgtaggcggacatttttacaacatagtatttggcctcttccttccggccggcgccaagggtctggcctacaatagtcatcatcgagattccgattcccattcccgcgattccattcagggcttcgaaaattattgccatggcttcggctgacatctgatacggagcgagcagagaaacggaggactggatagctagcttaccgaactggaacataccgttctcaactccggatggaatcccaatcccgagcactctccctatcatatgaaaatccgggcggatcagatagttttttattactattggctgctttggctttctgagaaaaaagtagacgaccgcgaagcaaagtattcttgaaaacagtgtcgaaagagcggcgcctgctacgcccatattgaagataaatataaggacagcatttccggcgatatttacgcagtttgagataagggagataagcatcgggaaacggctgttgccgcctgctctgtaaaatgccgagcccgcctcgaaaagagcgtagaatggaaatgagaacgatgtgatgaagaaatacacgatcgcatcggacatgacctctgcgtcagtctgtccgaagataagatggagcagtggcatcctgagagtgatgcagaatattgctacaagtgtcgataatacgaaaatcgtaagaactacctgcctggctgcctcgtttgctttcttcgtattttcctggccgaggtactgtgagcagattatcgtgcctccggcggcgagagcctcgaagagctggatgacgagggtgtttatcgagtctgacagcgaaactgccgagacggcagcgtctccgcatctggcgaccatcgtcgtatccatcattcccataaatgaattcaggaactgctcgatgatcagcggaatcataatcgcccagagctgtttgtttgaaaatatcagatttgaaaaatcaatttttgacctgtcgtagaatttatttctaattttttccttcatataaaactacacatacacctttcgcgtaaatgtaattctactttaatattgtatactatgtcaataatttgtcttttttcgttgcccttaaatcgctaatgcgttaaaatgtagggtaaggcagacgggctgtctttagactggagaaaaaatgcattttatcaatcaaataaaagcgggcgagcagatccgcgagatctatctggtaaaagaggtaaagcagttaactacaaagaacggcaagccttattggaatgtgacactgcaggataagactggtacgataaatgccaaggtctgggatccgaattcaccgggaatcgaggactttgaggcgatggactatatcagtgtgatggctgaatcccaggagtatcagggaaatatgcagcttatcatccgccaggcgaagacagccgattccggtgactatgtgccttcagactacctgccatgctctgaatacgatgtagatgagatgtactccgagcttcagaggcttatcgattcagtgaagaccgactatatgaaaaaactcctgaagtcatttttcgatgatgctgattttaaaaagaagttctgcttcagctctgcagccaagtccgtccatcacaactttgtcggtggcctcttagagcatacgctttcggttacaagagtctgcaacttttttgcaaagcactatacgttcctcgacagagatctgctcctgactgctgcgatctgccacgatatcggaaaaacgaaggaactttcaccttaccctgcgaatgactacactgacgaggggcagctgatcggacatatcgtgatcggcgccgagatggtgagagaccacataaaggatattccggaattcccggagaccaaggccagagagctgatccactgcattcttgctcaccacggcgagctcgaattcggctcgccgaagaagccggccctctgcgaagcgatggcactttcatttgcagacaacgtcgatgcgaagatggagacgatgagagagactatctacagtggaacggcctcatcacctacgacctggaagggcatgaaccgtttcctcggaacgaatctccgcggaacgacacctgaagaatagggctggttcttacgacttgttgtgtgaaaacaccacgattcaggctctgcacgtaaatccaaacaaaagaggctcgctgcaattttgcagctgcctctttatttttttgccttcgcgccgataaaaatactgtaagcatatgtgaaaaggattttacattagacaggtcgtaccggctgcgcaaggaagtcgctctgcggtacagacaggaacgattttttatgatcataaataataacatatctgcggtcatcgcaaacaagcatctccttagaaatgagacgaagcttgcggcttcttctgaaaaactttccagtggctacaagataaatcacgcgtaccagaacccttcgggcatggctatttcaaacaaaatgcgctcccagatcttagctctcgacagagctatcgacaacactagcgacggaatcagtgttatccagactgccgacggcgcattaaacgaagtcacttcgatgctccagcgtatgcgtgagctcgctgttcaggcggcaaacgatacgaatactcctgaagacagagcggagattcagaaagaagttgcacagcttcgcgacgaggtcgaccgcgtttcctcatctactgagttcaacaagatgcagatttttaacggggacatgcagacgaaggtctacgccgacaatgtaacgaggctttcggtttcggatgcggttgaccctggtacatataccttaacggtaaccccacctacgaaaacagggacgtccggttcgatgaattccagtgctacggtaccaaatggatcctttactatcaatggccagacagtgactctgaatgacaagatgacttctgacgatgcttttaatgctttaagacaggctgccagagccggcgatgtcacggcaaaaaaagacggatcgattatttctctgtcatctggtattacaactgatggttacgaggaggtattggggaatgcctggggcgccgttccaataattatagatacacagggagatgaggcttcttctaaagcagccttgaattattttaattttactcaagggcaattggggactgatgctaaagttgttcttaacgatgtgaacaacactgcaggtgatgcgaaaaaattctcttcatcagcgactgctgctattgatggaaagaaagttactataaccgataataacggctttgagatgagcttccttctcgatggtgttgaggaaacgactggcagctcctcaacaacaggttcaacaccgaccactccaaaaccggttaatctgacaatcaaagtcaccgatatcggcaagatgactttccatgtcggagcgaacaaggaccagaccatagatatagacattccttcgatcagtgcgaagaacctctatctggatcaggtaaatgtaggatcgcatgtcagtgccagccgtacgataaatcttatagacgatgcgatctcaaagatcagctctattcgttcggaccttggtgctgcccagaacaggctccaaagcacctacgattcgaataattcgacaagtgaaaatgtaaacgacgctatttcacgaatcaaagatacagatatggctaccgagatggtcgaatacacaaagggcaacgtcctgcagcaggctggtacatcggtgctctctcaggccaatgaactccctcagatggctctgcagctcctgcagtaaggcactacaaattttcaaaagtgtattaaaagctgacagttccgaaattttgtatatagacaaaagcgggtcaggtgtttaaaatctcttaatagatttataaacaggctgattcgctttttatttagataaaattttttaatgaaatggaggaaccataataatgggaattaaagaactttcacacgctgcagagagaaaagcattttctacagccattgatggttttttaaaacacatcaagaaaaaggattatgcagacagatctcaggcttatgtaaagcttgtcgatacagcagccacattctggaagagtgtagataaggataagatggagggcgttaaaaaggctctttcaaatcctgataacagatgggtcaagttcatcaacagagttatcgatgagacagatcctcactacgctaagacgatgcttttaaacctcggctacgaagcatttttccgtggcacaaagatgatcagagccaaccgtatcaaatatggctgcaacatcccatggcttatcctctttgatccgactatggcctgcaacatgcactgtgtaggctgctggtcaggtacatacggacacaagtcaaacctctctttcgaggatatggataagatcgttacacagggcaaagagctcggtgtttacctctatatgatgactggtggtgagccgactgtccgcatgaaggatatcttcagactcgctgagaagcacaacgactgcttcttcggactgtattcgaactccactctgatcacagatgagcttgccgagaaggtaagacagcttggaaatattacattcatgctttcactcgagggcactcctgatactaacgatgagcgccgtggtgagggacattacgccaaggttatgaaggctatggatattctccgtgagcacggtatcgtattcggtacttctgtatgctatacgagagacaatatcgaggcagttacgagcgatgatttcttccgtctccttgagaagaagggagcccgcttcggattctacttccaccttatgccggttggaaacaacgctgtaccagagcttatgcctacagtagagcagagaaaatatatcatcaacagaatccgctatgtcagaagcgacaagtgcgatttcggattcttcccgatggacttccagaacgatggtgagtatgtaggcggatgtatcgccggaggaagaaactacttccacattaattcaaatggagatgcagagccatgtgtattcatccacttctctgattcaaacatcaaggacaagagtattctcgagatgctccagtcgcctctgttcatggagtaccgtaagggacagccgttcaaccgtaaccagcttcgtccgtgccctatgcttgagaatccgcagctccttcgcaagatggttcacgacacaggcgctcaccagacgaaccttgagtcacctgagagcgttgagcatctctgcgcgaagtgcgacgattacgcagcaaagtgggctccggcagctgaggaagtctggagagaagagactcataagccaaaggcctatgtcaactactcggaagagcatgtagagcatccagagcttgcagctttccagactgaagcaaatgtatcagatgcagccagaaaggatccgtcactcgcagcttacagaagcgattcagatgtgacaggacagaaggtttttgattcttcattaaataacaatgaacagggtctcaagaaggaggcctgataccacgccccggcatttcgccggggcgttttgtttttttcaatagcgcgaatgcaccgcccatttatctataattgcgccgctcgcttaaaatctgtataatcagaagtatgaaaatcatttttatcagattatttgaatcgtattatgacaagatcctgccggcggctatgagacgcctcggctggcaggtggacgaggagtcgttctatacaccggcggatcagaccagagatgacaggctgcagcagatggtgcgtgaccgcatcaaagataaaaacggcagctatgactttgccttcacggtaaatttctggccgctcctagcgccggtccttgatgaccttggaatccgctacgtctcttggagctacgacgcgccgctcgccttcgttgggacgcctgagatggagagaaagaataactatatttttctctttgacagagggcaggtcagaaattacaagaagcagggcatcacgagggtgtggcatctgccacttgcttctgatccggacattttttcaagggagatagaaaggcacggggacgaattttcggggtgcggcgtaagctttatcggctcgttctactattcgccatatccatctgtcgtcaagaatctttccgaccacctgaggggatacctcgacggaatacttacagctcagagaaatttatatggctcctatctgctgccgcaggtcattgatgacaaaattgtcggggcggtaaatgcagaactgctaaggaaaaaagacacctcgaaggatgcgggggttttcgcaggcagcgtgtcgaaagagaatctgatctatgcaatggcgacaaggataacctgttttgacaggctgactcttctcgccgtcgcttcaaaaattaccgacacccgtgtctttacatcgaataaaccggatgagatatcaggtacgctcttcaaagccagggtaaaaggaaaggtcgattaccacacgcagatgccggtcatttttaacaggagccgcatcaatctctgtccgacgcttcggtgcatcgagaccggaattccgctcagggcccttgatatcatggcctgtcacggagtcgttatgatgccgctttcggaggagacggctgagtactttgaaaatgggacagacagcctgctctactcgtcggatgaggaggcctttgagctgatgaggttctacctttctcacgacagcgaaatcgacaggatccgtgaaaacgcttacgaaaaaatccggactgatttttcttttgaaaagagacttgacacaatggcaaggatacttaaagaaaattgacagttcctcaaggatttattttcagggaaaggactatatgaacactataaaattatacgacgataagccttacaacacagaattcagtgcggaggtcttaagatgtgacggcgggaaaatcgtactcgacaggacgctgtttttcccggaagagggcggccagacctgcgacacgggatttatcgaatgtcacgggagacgctttgaagtggagcatgtaagtgaagaggacggggtgatatttcatcggatttcagatgcgtatgatcagtcttcagatgcgataaaggcaggtgataaggtcacaggttctatcgactggaagaggcgcttcgacaatatgcagaatcacaccggcgagcacatgttttccgggatcgtacattctctcaagggatacgataacgtcggtttttcactgactgaaaatacctgtcagatggattacaatggaaagctgacagataaagagatcagagacatcgaagagcaggtgaatcaggcaatctataaggcaatcccggtcgagtgcaggtatccttcggaagaagaacttaaaagtatcgactacaggagcaaaaaagagctgaatggagccgtaaggatcgttacgatccctgggatagatgtctgtgcctgctgcgccccgcatgtaagaactacggccgaagtaggtgctttgaaagtgctttcacacctcaattacaaaggcggtacgagactctatatcgcctgtggcaacagggcctaccgtgagtttgtatcgtcatttgatgctcttacagatatcggctatctgttttcaacgggaaggcctgatgcctttggcgctgtcaaaaaattgatctctgagaagcaggagcttaccggaaaacttgtcagctgtcaaaaggatgagctgttccgccagatcgacgaagaggatggaaatgagatatttacagaggtagatgataggaatatcctgactgcagcttttaatcatttaaaggagacacatgacggggcctgctttattttttcaaagaagggggatgagaattacaccttcctcgcaggtggagaaggcatcgacgcgagaactctgcttgatcagctgaagagccggtttacagtgcgcggtggcggcagcagagacatgatccagggcacggtatcgccgctacagtgatgaaatagtgtgcggaatcggttattctactacttttatgacaaaatcaactttaaatatttgttatttttatgaaaatttccaatatttcaaaaaaaagtttgctttacttgtgcaatatgctataattttatttgagacaaagaacagttttggtaatttttgtcaaaacagaggatgaggggagaaacctctcataaagacacgaggtggttagatgagtagtaaagaaatgatagccatgcttctggccggaggccagggcagcaggcttggcgtactgacttccgatgttgccaaaccggcggtggcatttggcgggaaatacaggatcattgatttcccgttgagcaactgcatcaattcaggcatcgacactgtcggtgttttgacgcagtatcagccgcttgcactgaacagacatatcggcatcggaactccttgggatctcgacagaaataacggtggtgtatctgtacttccaccttacgagagaagcgacaattctgagtggtattcaggtacggcgaacgccatttatcagaacctgaagtacatggagagctacaatcctgagtatgtactgatcctttcaggagaccatatctacaagatggattatgaggcaatgcttgatttccacaagcagaatcaggcagatgtgactattgccgttctccctgttcctatggaggaggccagccgtttcggtatagtcgttacggatgataacaagaggatcacagagtttgaagagaagccggctcatccgaagagcaacctcgcatctatgggtatctacattttctcatggccggttctgaagcaggcactgactgcccttaaagaccagcagaactgcgattttggtaagcatatcattccgtactgccacgagaatggcaagaggatttttgcatacgagttcaacggatactggaaagacgttggaacgctcggttcctactggcaggccaatatggagcttatcaaccttatacctgagttcaacctctatgaggagttctggaagatttacacgaagcaggataagattgaaccacactacattggacctgatgccgaagtcgggagagccattatcggggcaggcgatcagatttacggcaaggttttcggttcggtgctttcagcgggagttatcgtagaagagggtgcagtcgtaaaagactcgatcattatgaaggacacagtgataaagaagggcgcttatatagagaagtccattatcgctgagaactgtgagatcggtgagaacgccaggattggagtcggagaagaggctgagtcgaagctgaatccgaagatctacagtttcggacttgcgactataggagacgattccgtgatacctgcgaatgtcactattggcaagaatacagctatcaagggagtgaccgttcctgaggattatcaggacggagtgttaccaggtggcggatatctgataaaggcaggtgaacaggcatgaaagcattaggaatcattttggcaggtggcaattccacccgtatgaaggaactgtcgaagaagagagccatagctgccatgccgatcgcatgcagctacagagccattgatttcgctctgtcgaatatgacgaactcgaacattcagaccgtagcggttctgtcacagtacaatgcgaggtcactgaatgaacatctgaattcttcgaagtggtggaatttcggacgtaagcagggcggactttttgttttcactcctactgttacttcagagaacaactggtggtacagaggcacggcagatgcgatgtggcagaacatcgacttcctcaagaagagacatgagccgtacgtagtcattacaagtggtgactgcgtctgcaaatgcgatttcggaccgatcatagactatcacatccagaagcaggccgacatcacagtagtctgcacgaaggctccggaatgggacgacatcagccgtttcggtactgtaaagatcgacgataacggacttatctccaatttcgaagagaaacctatgatagcccattcgaatatcgtgtcgactggtacatacatcatcaggaggagaaagcttatagagcttcttgagcagtgcaacgccgagggcagatacaacttcgttacagatatcctgatcagatacgagggaatgaagaaagtctacggatacatgctgaactcctactggtcgaacatcgcttcactgaactcttatttcaggacgaatatggatttcctgaagaaggatgtcagagacttcttctttgcaaaggaaccgaagatctattcaaaggcgcgcgaccttcctcctgcaaagttcaatcaggatgcgaaagtccgcgattcgctgattggctccggaactatcataaacagcgtggttgagaattcagtcatcttcaaaaatgtcttcattggcaacaacactgtgatcaagaattcgatcgtcctcgatggcgcttacatcggtgacaatgtccgtgttgagaactgcatagtcgagtcgaacgagacacttctctcagacacgagctatgttggcgacgaccagattaagatcgttattgaaaataataacagacttggaatctgataataaaaagagacctgcttgatgcaggtcttttttttgcgaaaatgggcggagatcatttattgtgagaattcttctgattgaatttgttcatcgcgccatcgatatctcctgctatgatcatttcacaggcgtcgcaggcgcgcttagaagcttcatcgaaaagcttctggtcgctctgatcgagacggccaagaacgtgagaaatcatatctccgtgcggcagcatgtgtccggtgccgatgcggatgcggataaatttgtcagtgccgaggtgttcgattatattcttaaggccattgtggccgccggcagatcccttttttctaattcttagatttccacagtccagatcgacgtcatctgaaaaaactacgacctgagttgcaggatcaagtttgtaaaaattggcaaagtcacctaccgattcgccgctcagattcataaaagtctgaggctttatcaggatgaccttctgtccttctatgactccgtcgccacggagagcttttctgtcaggccgctctattacaatgccatggcgcgcggcaagcctgtcaatagtatcgaaaccggcattgtgcctggtgtgctcatattttgtgcccgggtttccgagccctgcaataagtatcataaaaacctccaattacaatccatagacactaattatatcagactttacaagtatggtataatacttttctatgagagataatatttcaacagtaaaaaataatcatgcaattggtattggtcttgtcatcgcggattctttcttcttttcgctgatgacactttttgtaaggctttcgggcgatctgccgacgatgcagaagtgttttttcaggaacgccatcgcggcagtcgtcgcagtcattacactattgagaactgacgagaagtttcacataaagaagggctcgatgccgggcctccttatgagatcgatctgcggcggacttggcatgatctgcaatttctacgcgatcgacaggataggacttgctgatgcaaatatcctgaataaaatgtcgccgttcttcgccatcatcgcatcgatcttcgtattaaaggagatcccgaagaaggcagactggattgcagtcatcatcgcctttgccggttcgatcttcataataaagccgtcgtttaatgtagtctctctctactcacttgccggtcttctgggcggcctcggagcaggaatcgcttacacttatgtaaggaagctcggacagcacggtgagaggggaccggtgatagtggcatttttctcgatctttacctgctgtctctgtctgccgtttatgatcgctgatttccatccgatgacatggcagcagtggctcttccttatcctcgcaggattcgcagcagcaggcggacagtttacggtgaccgccgcatacaaatttgccccggcaaagaacatttcggtcttcgactactcgcaggtcatcttcgcatcgatctggggtgtcgccttcttcggcgagattccggacatgtactcgataatcggctatgtgatcgtcatcggctgcgcagtcttcagatggctgtacctgatgaaaacagaagattgaaaactgcagaaggcttatgacggtatcaatataagaaaaaagcatgacagaaaactacagaagtcattgtgcggtttcaatataagaaaaaagcaagaatgaaaactacaaaaggcttagggcggtttcaataaaagaaaaaagcaagacagaaaactacaaaaggcttaggacggtttcaatataagaacaaagcatgaaagaaaactacagaagtcattgtgcggtttcaatataagaaaaaagcaagaatgaaaactacaaaaggcttaggacggtttcaatataagaacaaagcatgaaagaaaactgcaaaaggcttagggcggtttcaataaaagaaaaaagcaagacagaaaactacaaaaggcttaggacggtttcaatataagaataatacatgacagaaaacttaaaagaaattcttgaattttaaaagtatattgatattgcttaaaaaaaatacaatagaaaaattttattttcaaagtaagaattactgggagaaattttatacaagtcattgttttttatagcaatattaatcatatatattgaaatttcaaaagacaggttgtagattttgaatccgtgaaattcttatattaaaagaccaggtgatataaatactttttctaaaaagcaattgttctatattgaaaaataaggaatgtcaacggtgaagagcgcctgagcaggcgctaaagattggcaaacgagcggcatggcaggcgctaaagatccggcaaatgaatgtcatggcatatgcgggtaagtggcgaacaaaagttatagcagaattggaatagcggagaacgaacgtcatggcgggcgcggagaagtgacgaacaaaagttatagcaggtgcggaagaagtcggtaaacgaacgtctgggcaggcgcggaagaagtggcgaacgaacgtctgggcaggtgcggaagaagtggcgcccgcccagacgtgacccaaaccatatttgaaacgaaaggagcagaaaatgaatccaacatcactatttaagatccagggcgcattcagaaaatttcaggaagcacacccaaaggtagtagcatattttcagagtgtatttggaagcggcgtcccggagggaacaataatggagcttacagttacgaagccgggcgaagagccggtcacaacgaatatgagagtgacacaggaagacctcgaactgatacagtcactcagagacttacagtaattgatacagtcgctcagagacttacagtaattgagacagccactcagagacttacagtaattgagacagttatttgagagataacagtaactgatacagtcgcttgggaatttgcataaatggataaattcatattacattcgaaatatcagccgaccggagatcagccgaaggcgataaagaaactggtggacgggttcagagacggaaaccagtttgagacgcttctgggcgtgacaggatccggcaagacatttacaatggccaacgtcatagcggctctgaacaagccgactcttataatgagccacaacaagacgctggcaggacagctctacagcgagatgaaggattttttcccggagaacgctgtagagtattttgtctcatattatgattactaccagccggaggcgtatgtgcctcagtcggatacttatattgcgaaggattcggcagtaaatgatgagatcgataagctgaggctctctgcgacgacagcgctctcagagcggaaagacgtaatagtagtcgcgtcggtgtcctgcatatacggcattggaagtcctgacgactatgagaatctctgtgtctcgctgcgccccggccaggaaaaggacagggacgaagtcattaaagaacttgtcgctatgcagtatctgagaaacgatatggatttcaagcgtggaacgtttcgggtgcgcggagatacgctcgaagtgatccctgcgaacacgactgattacgcgtacaggatcgagtggttcggcgacgagatagatcgaatagtacagactgaccctctgacaggaaaagttcagtacgagatgcagcacgttgcaatttttccggcgtcgcattatgttgttccgaaagaaaaaattgatcacgcctgcgataccatagaggctgagctgaaggagagagtcaattttttcaaggcgcatgacaagctgctcgaggcacagaggattgcggagaggacgaacttcgatgtcgagatgctgagagagaccgggttctgctcgggaattgaaaactattcgaggcatctcaccggagcagcaccgggagagccgcctaagtgtcttatagactattttggaaatgattttcttacgataatagacgaaagccacattactgtgccgcagatcggcggtatgtacaatggagacaaggccagaaagacaacgcttgtcgactacggcttcagacttccgtcggcgctcgacaacaggccgctaaatttcaatgagtgggagcagaagatcgaccagctgcttttcgtgtcggctacaccgggagactatgaaaaggaacacgagcttttgagggcagagcagatcataagacctaccggacttcttgacccgtcgatcgatgtgcgcccgactgagggacagatcgatgatctgtattccgagatcgagaaggagacaaaagaccatcacaaggtacttgtcacaactcttacaaagaggatggcagaggaccttacggattatctggcagaactcggagtccgtgtcaaatacctgcattcggatatcgatacgcttgagagagctgagatcatcagggatttgagacttgatgtattcgatgtcttggtcgggataaacctcctgcgtgagggacttgatattcctgagatcactctggttgcaatcctcgatgcagacaaagaaggattcctgcgaaatgagacttctcttatccagacgatcggacgtgcatcgcgaaacgaccacggtcatgttataatgtacgcggatacggtaacagagtcgatgcagaaggcaatcgacgagacgaagcgccgccgcacgatacagcaggagtacaacgagaagcaccatatcactccgaagactatccagaagagagttcaggatgtcattgcgatttcgaaggaagttgcagccgacgagaacgagatgaagaggcagcctgaggagatgtccttggatgagcttaagaaatatatagcaaagataagggacaagatggagaaggcagcggcagacttaaacttcgaggcggctgccgagtacagagacagacttatagaacttaaaaatatgctccgcgatgaagaggtaagcacaagtgagagaagcagcacaggaactgacaccaagaaaatacataaaaataaggggagcaaaggttcataatttaaaaaatatcaatctcgatatcccgcgtgactcgtttacggtatttaccggactttcgggttcgggcaagagctccctggcctttgacacgatttttgccgaagggcagagaaggtatatggagtcactttcgagctacgcgaggcagtttctgggacagatggaaaaacctgacgttgacaagatcgaggggcttccacctgctatttcgatcgatcagaaatcgacgaaccacaacccgagatctactgtcggaactgtgactgagatttacgattacctccgacttctgtatgcgagatgtggaatcccgcactgccctaagtgcggccggccaattttcaagcagacagttgaccagatgtgcgaccagataaaaaaactcccggaaaagaccagattccaggtcctctctccggtggtcaggggccggaagggcgctcaggaaaaactcttcgcgagagccagaaagagcggttatgtcaggacgatagtcgatggagacctctacgacctctccgaggacatcaagctcgacaagaataaaaagcacaatatcgaaatcgttgtggaccgtctcgttatgaaggatggcatagatgcgagacttgtcggctcacttgaaaatgcgctgaagctctccggcggactcgtgatcatcgatgtgatcggcggtgagcagatgaatttttcggagagctactcgtgtccatacgacggtacttcgatagatgaaatcgagccgagaacattttcattcaacaatccgttcggcgcctgcccggagtgctacggcctcggctacaagatggagtttgacgagaatcttatgatccctgataagaatctgtcattcaatcagggctgcgttcaggtcatcggatggcagaattccaaagacccgaagagctattcacatgcgcttctcgtcgcactttcaaaggagtatggcttttcactcgacaccccatacaaggacctcccgaaaaatatccgggagatgtttatgaatggatttgaccgggaagtcaaagtccactattccggcagatggtccacgggagtctacgatgtgcagtttgagggacttctcgagaacacgaagcgaagataccgtgagacaaagtcagactccgcgaaggagatgttcaaggagtacatgcggatcactccgtgtccgtcatgccacggacagaggcttaagcctgaagcgctcgccgtcactgttgctgacaaaaatatctacgagatgacgacgatgtctataaaggacctccgcagatttctggatcagatgaagctttctgatcagcagatgaaaatcggaaggctcgttctgcgcgagatcaaagccagagtcaaattcttagacgacgtcgggctggactatctttcactgtcacgagccacagccactttgtccggcggcgagtcacagcgaataaggcttgcgacgcagattggctcaggacttgtcggagtcgcatatatcctcgacgaaccgtcgatcggactgcaccagagggataacgacaaacttctggcatctctcaaaggcctgcgtgatcttggaaatactcttattgtcgtagagcacgacgaggatacgatgagggcggctgattttcttgtagacataggacctggcgctggagaccacggcggagaggttgtcgctgccggaactccggaggaagttgaagcctgcccggattccattaccggtcagtacctttctgggaaaagatgtattccggttccgggagtcagaagaaagccgacaggctatattactataagaggagccagagagcacaatttaaaaaatatagatgtaaagattcctctcgggatcatgactgttgtaaccggagtttcgggttcgggaaagtcgtcacttataaatgagatcctctacaagactcttgcccgtgaccttaacagggcaaggactatcccgggagactgtgacggcgtagatggagaggatcagctcgacaagatcatcgatatcgaccagtcgccgatcggcaggactccgagatcgaacccggcgacttacaccggagttttcgaccttataagggatcttttcgcagcaactcccgacgcaaaggcccgcggctacgcaaagggcagattttcgtttaatgtcaagggcggacgctgcgaggcctgcggcggagacggcatcaaaaaaattgagatgcattttttgccggatgtgtatgtgccgtgtgaggtctgccacggcaggaggtacaacagagagactctcgaggtcaaatacaaggggaagtctatttacgatgtcctcgatatgacagtagaagaggctgtaaaatttttcgagccgataccttcgatctacagaaaaataaagactctgatggatgttggactcggctatattaagctcggccagccatcgacagagctctccggcggagaggcacagcgtattaagcttgcgacggagctctcgagacgtggcaccggaaagacgatctatgtcctcgatgagccgacgaccggacttcacttcgaagatgtaaacaagctcgtaaatatcctgcgtgcgctctcggacagtggaaatactgtagtcgtgatcgagcacaatctcgacgttataaagacggcggattacattatcgacttaggcccggaaggcggcgacggaggcggaaccgtgattgcagagggtacgccagaggaaatctgcagggtaaagaagagctatacaggacagtaccttaagaaatacctgaagtaatatattgagccgttttgttgtgaaagaattaagatattcaaaaaatgccagagacatcgggaaatttttgtaaagtttgatacttgaaaaagggaaattttccgctataatattttatgtatgtgtagaaatagattttcgcgggatttttccgcttttttatatagattggaagggagttctacagcatggctgcaacagacattggtatagatttaggaactgcgagtatcctcgtttatctgaagggaaagggtgtagttctgaaggaaccttcagtagtcgcttttgaccgtgacacgaataagatcaaggctattggagaggaagcccgccttatgctcggccgtacccctggaaacatcgtcgccgtaaggcctctgcgtcagggtgttatttccgattatacagttactgagaagatgataaagtacttcatccagaaggctctcggaaagagaacttacagaaagccaaggatgtcagtctgcgttccttcaggcgtcactgaggttgagaagcgtgccgttgaggatgccgcatatgcagcaggcgccagagaggtctacatcatcgaggagccaatcgccgcagctatcggcgcaggcatagatatcagccgtccttgcggtaacatgatcgttgatataggtggtggtaccgcagatatcgccgttatttcactcggcggatctgttgtgtcgacttctataaaggtcgccggcgataacttcgacgaggcactcgtcagatacatgagaaagaagcataacctcctgatcggtgagagaactgcagaggatatgaagataaatatcggaacctgctatccgctctctactccggagactatgaatgtcagaggccgtaacctcgttacaggtcttccgaagacgattgaggtatcatccgaggaaacagaggaagcgcttcgtgagcctacagcacagatcgttgaggctgtacactctgttctcgagaagactccgccagagcttgctgccgatgtcgccgacagaggtattatcctgacaggaggcggcgcacttctccgcggacttgaagagctgatggaggagaggaccgggatcaacacgatgacagccgaggatcctatgacctgcgttgccataggtactggtaagtatgtcgagttcatggctggaaaccacgatctctcacagccgtaaatataatgaattggtggtcaaaaggttgaccaccgattcatatgattacattcgaaaaaaatacgctcccgcctttcacaggtgggagcgtatttttaatggtgcggatagcaccgctcattaattattttccataatagcttttcttagttcttcagcattcgacactattttttcaacaggtatccgctcaaggtactcgtggcttctgaagccccagtcgaccgagatcacatgcatgtctgaattctgtccggtcgcaaagtcgacttcggaatcgccaatatagacgcagtcttcacgcgggatatttaaaacgcgaaggcattcgtttaccatgtccggagcgggctttctcttgatgcccttcttctcgccgagagaaaaatcaaaggcgcccgggaacatgtctgctacaagtgtctggaccgccgtgtccggtttatttgaaacgactgcggttttgatgccggagctgtgaaggtcatccatcagtttgagaattccaggatagggtccggtcttatcggcgcagtgcgcatcgtagtaaggacggtaaatctccgaaatcctttcgatctcatcgtcatctttaaagcagtcatctggctccttatcggtgcctatcaggtcgagcttttcgtatgggaagccctgctcgactgagagagcgcgcttcagcgctacatagactccgcttccaaaaaaatacgccacatttttttcagtgaaatcatgctcgtgacctgtcttttcgagcgcatagtcgatcgaagctgtaaggtcgccgagggtgttcaggatcgttccatccatatcaaaaacagctgctttatatcccataatgcatctcctttataatcgttacaatctgcaatacgccgggggttttaccgggacgcaaggatactttaacatagaaaacggaaatggtaaaatctgtttcgataaaaatgcaataaggtattaaacttttcgtgattccatccgataaaagcattgtaaagaaaataaagacctgttttttaatatatgttgaaaggagtggtctggatgagaataagtgcatataacgccattacacaggtatatcaggccagaaaaccttccactgcaaagactaagaggacatcgggcttcagggacgaagttgatatctcagaagccggtaaggattatcagatagcgaagaaagcagtttctgagagttcggatacgaggaaggatctcgtatcggagatgaagaagaagtacgcaggtgatgtgaaggtagatacactggactttgccgatgtgcttttgcagaaggcccagggactgaaatactgatttttttagcatgaattgttacctcgtcgacatggatgtccgtggggttatgaattcacccaggttccagggacgggacgatatacgaagcagcgggctgctttttatgtacgggcggatgggcctttcattgcgaagggtccttccgctttttgcgtgataaggagaaatgatggcaagtcttgcagaagaacttatctctgtgatgcaggaggaaacgaagggttatgatgagctctacgacctgtcacagaagaagagaaaagctatagtccagaggaagctcaaagagcttcagaacataaataccgaggaagagacgatcacgagccgtctgaagaatcttgagaaccgccgtgtcaagaacctgactgatatgtcagtcgttatgggacacgataacgagatcctgactgtcacacaggttatagatctcctcgacaatcagccacaagagcagaagaagcttaacgatgcgaagagggaacttgtgaatgctgcgaccaggatgcacaagctgaatgagcagatccagattcttttaaaccaggctctcgagatgacacagttcgatctgaacctctttgagaatctgaagaaagcacccgagacaggaaattacgataaacacgcatataacaccggagacgtgctgccgagtggcggctttgatctgaagcagtaacaggagtaaattatggcaaacagttttggaagcttatacgttggggcgtccggaatccagaattcccagcatggccttaacgttgtagctaataacctctcgaatatggataccacagggtacgtaagacagaggacatttttttcagatcagatttatctgccgacaggaaagtccgctatttcgaaccagcagaccggacttggcctcaagatcggtgatgtcatccatcagagagatcagttcctcgatcgggcttacagacaggagagcggtcgtaaggcttattacgatgctgcttacgaagccacgggtgaagtcgagaatttcctcagagagggtgagggcacggctttttcgagttcgatcgaatcactctatgatgcgttcagccagtatgcgacaaatccggctgcagaggaaatacagaacctcgtggtccagaaatcgcagcttttcttaagccgcgccaagtcagtgtatcagggactttcagattatcaggacaatgttaaccagaagataaaggacgatatcgaccagatcaattccattggaaaaaagatccagaagctgaatgtcacgatccaggctacagaggcaggcggtgtcgagacagcgatggcggaccgtgacaccagggacaagcttatcgatgacctctcgaagttctgcgaaatttcaacgaaggagacacctgaaggcgtagtcaaggtaagtatcgaaggagttgaatttgtcagtgaagacagagtttatccgatctcacttgacaccgacaatacgaccggattcgttacaccttactggcagcagctgtcgaaaagctctggcagccatcaggagaaaagatacgtatttgatacctatcttacggatacggcgaagaaccaggatatcggagaagtcaagtcactgcttttgatgaggggcgaccaccgcgcgacctacagggatttttacaggacgacagatgatggtgaaatgaatgagatcggggccaacgagtattcagatacgataatctcaaaagatgatggccgcaagaaggcggggctcggcaagtcagtgatcatgaacgcacaggcggagctcgatcgtatgatgaacaaagtagcttcgaatatcaacgatctgctttcacctgtttccactgttcagacaatctatgacaggagcggtgatgattctacaaagactgagtttaaccagaagcttaaggaactgtacgataatgacactgagtttactgtcaacggagtgacttacaaaatgaagaccgacgcggataagatcaagatcatggatcaggattatgccgttgtcggggccgatggcaagcttcctccaaacgaactgttttcaagggtggtaggagataaaaatgaaaatgccaccaaataccagagatattcgaaggccactctttcctgcaatgatgggtcgactctcgatatgtatgtttacaataaggaagatgattcagatctggcgagccagtacacactctcacagctgactgtaaattcaaagcttgtagagcagccgaacaggattccttacaagcatctgagcggaactttaaacagtgattcgtcgaaccttcatcagaatgacgatatcgcatacgacattgctagaaagatatacgagtgctgggataacgaggatttcaagctgaatccggcagatacgacaccgacgactttcaacggattctatacgaagtacattggagatctcgcagataagggaaatgtctacaagaccacatccgaggtcctctcagacacagtcgaaagtgtttcctcgagccgcgaaggcgttatcggagtcaatgctgatgaggagctcgagaatatgatcaaataccagaacgcctacaacgcatcgtcacgatttatgaatactatcacatcgatgatcgatgtgcttttgaactcattgacataaaggagcagatttatggcatctacatttttcggattgggaatagcggcatccggactcaatgcatttcaggcaaaaataaatacgaccggaaacaacgtctcgaaccttaagaccgagggctattcgagacagcaggtgaatgtttcatcggcaatctcactgcgtgcctatacccgatacggggccataagcaccggtgtttcaactgattccgtgacccgtatgagagaccagtattacaacgtgaagtactgggagaatcagtcgaattacggtcagatgaacatcgaggaatattatatgaagcagatcgaggattactttactgataatgcctcgaatccgggtttttcgactatatacgctaagatgttcaacgctctcgacactgtaaaaaataatgccggagacaacacaaagagagctcagtttgtaagcactgccaaagagctttgtgactactttaatcagaacgccgagagcttaaagacactccagacagatgtcaacgaccagatcaaggatacggttgattcgataaattctattgccaagaaaatctcggttttaaataagcagatcaatcttatagagactgaggcggggcacccgaatgccaatgagctccgtgaccagagagagctgcttattgatcagctttcagagtatgtatctgtggagacagaggaagtcaaggtccgcgacagccgcagtaaggagcttgcgaagaaaaatcctaatacagaggagatttacacaggcgccactacattcactgtaaaagtcggcggacagcttcttgtagacaattacgactacaaccctcttcaggtcagcgcccgcgataagaagtataaccagtcagatgttgacggcctctacgatgtgacctgggccaaagatggcaggtacagtggacagagtctgaatttatatggcacgaatcaggctggaaagctccggggtcttcttgagataagagatggaaatgaccaggagaatctccagggaacagccgagctcgtaaagccgatgatctatgtgacaagtggtaacggttcccagacttcagaaggcacaatatctcctaatagtggaaatgcctttacgaatgatccggataagatcggacagattgtgacaaacagcgatggctcgatagtagagaatccgaagggtgaatacagctcttcgtatattaaaataaaagagggaatcaatatcactgatgccgacagaatgaacatgccggagcagggtgcaatttatgtgaacaatcacaagtacgagtacaattcattttttgcacaaacggatgagagtggaaaggtagtttcctatattttcgagcttaaggagcctatttcagcaaaggagatcggacatgtagcaggacataccgctacagtcggctccagtgtggatttcaagggaattccgtattatcagaacgagatgaatgctttcctccgcaaatttgcgaaggctttcaacaagatccagaagagcggacaggacgccaatggagacagcggcagatcgattttcgtagctgataatacttcgcagagttcttcaaataccgagcttgattttacaactgattcggcagtagacaataattactatacgacagacgcaaacaaaaacagtgtcgtaaatgacaagcgtgagacggtacacgccaccaaaaaagatgacaatggctcatacaaagacggaaggatcacaggaacgtccaacagctattacaagcttacagcatcagacataaagattgccgatgctgtttccaagagcccttcgcttttttcgacgactataaacaagagctacaatggaaataaggacctgggctatgatacctacgatatcatgcagcagatgttagacctcgaggacaagacgactctctacaaggatggcacaggtgataaattccttcagagaatctacgcggatgtgactgtcgacacacaggagtgcacgcagtttacgaaaaattacaaggcgattcagaagtcgattgacacgcagagacagtctgtatcgggagtcgacaaggatgaggaggccatgaaccttgtgaagttcctgaacgcttacaacctctcctgcaaagttatctccactctttcagaaatgtatgaccagctgatacttcgtaccggagtataaggaggcttttatgagaataaccaacaatatgatattgcataacgctgcatcaaacataaacagcaataagatcttagtcgaccagggtgagaatcagatgaccacacagacgaagatccagcgtccgtcggatgacccggtagtcgctgtcaggtctctttcactccagacgagactttcaaagatcaatcagtactacgagacaaatatccctgatgctgaagagtggatgaacgtcaccgagacagctctgaacaatatcattgaaaatatcaccgacctgaagaaatactgcgttcagggttctacaggtacgatgcagcaggacgacaggaaaactatcctccagcagctcgaagctctccagaagtcgatcttcgcacagggaaacgcagactatgccggccgtactgtcttcacaggataccgcacagacaagaccctagtcttcaccgatgccgactgcgacaagaagtacaacatcactcaggagctttcggcaaacgacttcgagaaggtcaagtatttcaaccacaacgtagaggttccttccaatgccagtgaagtgaataaactagacagctccaacgcacttacaaaggatgatatcacgattcaggactcttcatacaagaggcttcgcctcggatacgataatatttctgatgtggagagtctcgtattttcatacaagaacacaagtggagaaactgtttcgaatacctttcaatttgtagtacaggatgagaaaagaatcccgcctcttgcaaaagctgataccagtggaaatctcacatatggcagcaccaaacaatctacttcgaggtcagttaaggatacggccggcaataccaacacaattaattatgattattatacggtatcgggatctacatcaggtgcagagcctaagacagtatatgtttttgagaatgaagccgactgggcaggctggagcgctgataagcaaggtaagcagacaaagtacgttccggacgatgcagctgtccttataaaagagactggcgatattgtctttggaaaaggtgcttctgatgatatgtcagcaaaggagacggcggtttctgtcaattacgataagaactctttttcagctggtgagctgaagccggagtactattacgactgcgttgacaataccggtgtaaattacagcgatctcgatggaacggttggcagcaggctcgtttacaacagatcggatatttcatacgatatcaattacacggtggctgtaaatcagacacttactgtaaacctccaggcaaatgagatatttgactcatctgttcagcaggatatgaaggaccttacttccgttatcacgaatacgcagaatgcgtatgagaagcgcgagaagatttcagcactgatgaaggactcggattatcagggttctgaaacacagaagaaactttcagagtggtacacagctgcgagcaaggaatacgactactacaaggactacatgcaggacgaattcgagagagttcttggaaactgcgacacttacctgaataaggcaaatctcgccgagaccacactcggatgccgcggagatgagctttcgatgacaaagactagaatggatgagcagcaggagtcagttaccgacttaaagagcaagaacgacaacctcgacctgtcgactattatgatgaattatacggcgtactacactgcctaccaggcatcgcttgtggcagcaggaaagcttggccagcagtcgcttctgaactatatctgacaatactgattcgttgaaaaatcattgacaccccaggaagggaaggaaatcaaatgaaggtaaacacaagactatttggagagatagatatcgccgatgacaagattatagagttcccgggaggaatcatcggttttccggacatgcagaaatttaccctgatctatgatctggatggcaaaggatcgaaggaggaccagacggcgctgatgtatcttcagtctatggacgagccgcagtttgccatgcctgtagtaatgccggtggatatttttccggactacaatccggtgatagacgacgatctgctgacggacatcggaaagctgacacctttgaacacgtactgcctggtgacgatcagcgttccatctgatataaagaaaatgacggtgaaccttaaagctccttttatcatcaacactgataccttgaaaggcgcacaggtcatggtggaggacgacgtcgcagtcaagactccggtatatgatatccttgcagcccgcaagagcggaaaggaggcctgaatatgctggctcttaccagaaaaaaagatgaatcgatcattatcaatggaaacattgttgtcacagtcatggaagtcaagggggatcatgtgaaactcggcatccaggctccgaagaatgtttcaatttaccgtaaggagatatacgagcagatccagaaggagaatgaagaggcaatgaacacaaagaacgttcagaacctgaaggatcttctgtgattttttatatatgttattcgcccgaactcctgtgaacgacaaaaaatgcaaaaaaaatgcaatccatataatgacatgggttgtatttttttttacaattgccgatattagaactgaaatacaggtgtagtttatacattgccaatacacggaggtggcagttatggacatatcagtgaagtcaggatactcacagcagggaagctatacagtgagtaattcctcacagacagaaggcgattctccagatacgaaggtattgggaagcgggaaaactcaggacatagatccggttaatgcagagtctgccgacgtgaatgaatcgaagatctcatcacagcagcagacagcagatcaggtggctgatattatctctgagaagaaggataaagagaagcttgagaagaagcagagagagcagataaagcaggctgtatctgctattaacaagtacgcgcatggcacagaagctgtttttggcattcacgaaaagacaaatcgtgtcactataaagatcgtcgattgcgatacgaggaaagtgattaaggagtttccgccagagaagacgctcgatatgatagcgaaggtttgggagcttgcaggaattttagttgacgagaagaagtaatttacaaaggagaaaaggctatgtcatcacctatcagaatgagtggtatggtatcaggactcgatacagagtcgatcgtcacagccctgacgagcaactaccagaccaaagttgataattataaaaaggcacagaccaagctttcctggaagcaggatgcctggaaggaagtaaacaccaagattaacgacttctacaacagcctcgacaaatacagatattcttcagcctggaacctgcagaaggtcacagcatctgactcaacgaaggctgcggtctcagcaggtggttcagcgttcaacgggacacagacactcagcataaatgcacttgcgtccggagcatcactcgttggcggtgaagtttcaagtattaagggtacggataacacttcgactgctgtcacaggaagcaccaagctcacggctttaggcggaactgaaggccagaatattactttaacacaaggctctggcgataatgcgaaaactacagcaacgctcgagatcggtgcagatacgactgtaaatgatctggtcaatacactgaagcaggcagggctgaatgcctcttttgatgagactcagcacaggttctatatcagctcacagaagtcaggaaaggatcagagctttaagctggctttaactgatagtaccggagcagaagttacttcaagtggtaacgttttggataagcttggcgtttctgccagcacagctgccaaacgttcagatggctcagatgctgagattgtactggacggagtcaaatatacaaactcctcgaacaacttctccatcaacggtctgaacatccaggcgctcgcaaagacagacagtgatatcacgatcaatacccagacagatactcagggcatctacgataaggtgaaggagtttatctcgtcatacaacgacctgataaatgacctgaccgacagatacaatgccgcaagctcaggcagctatgagccactcacagatgatgagaagtcacagatgtctgataagcaggtcgagaagtgggagacgaagatcaagaccggactcctgagacgtgaccagacacttgattctctgatgactactctgaccaatggcatgatggatgtctatactgagggtgcggatgccaatggaaatggcggaacgaaggtaagtcttgccacattcggtatcatgacgaagggtatccttcagtcggctacaaacagacagaacgagtaccatatcgatggcgacgaggacgattcatcagtttcatcgaagacagacaagcttatgacagctatcacgaaggatcccgattcagtggttgatttcatgaaggatctgactacgaagctttcgtcttcactgaagaagcagatgacatctacatcactgcgctcagtatttacggtttacaacgacaaagagatggcaagcgagtactcgagctacacgactcagataaaagagtggactacgagactcaacgacatgcaggacagctactacaagaagtttgcgaagatggagtctatgctgcaggagcttcagagcaacacaagttctatttcaggaatgatttcataacagcttttttctgagagcaaagagccgcagaaattgcggcttctaaatttttttcatagaaaagggaaaataaaatgcgtagaaatccttacgaagtttacagaagaagtcaggtagagacagcctcacaggcagagctcgttctgatgctctatgacggagctctcaagttcgtaaatattgctcacgatgctattgagaagggtgagattgaaaaggcgaatacgaatatcaagaaagcagacgacatcatcgtagagcttttaagcactttaaaccacaagtacgcagtcgccgaggactttaagaatgtctacgattatatcagggacagacttctctgggcgaatatgaagaaggacaatgacatccttaaggaagctcatgacaatatcgagatcatgagagatacctggaaagaggtcatgagaaagactaacaacggacagaatttaaacgtaggagagcctgcggcaacggagtgatgttttatggaagatgaagcttacgtcaaagtgctgcgtgagtctttggaaaaaaaggtggagcttctgaagctgatctctcatgagaacgagattcagaaaactgtcttgaatgatcagacgtcgacgcctgacgagcttcaggaaaccatggatcacaaggacgaatgggtcaatcagatctccactttagatgacggctttgctgtgatttttgagaaggttaagccgctgctcacaaagcagagagacaaatacagagatgatattgctgcgatgaaggatcttgtcagggagattacggacctgactgagaaagtcaagaagcaggagagcgagaattacactttagtagagcagaaattcgcgggtatccggcagcaggtgaaaaagatccggaagagccagtcggcagtatcaaactactacaagactatgaacggcgagtacaattcgcagtttctcgacaagtccaaataaaaaaaacggtcatgcattgcatgaccgcttttttaatattaatattcagatgatagattgaatcgagaggtccggttctttcaacaggtctatgatctcgccgtcgtcgaactgtacgatcggcctgctctgtgtgttgttgtgatggtggatgtagacgactttgcagcggcggccatcatttaaaataactctggcattctggtaggcacctgcaagccttctgagaaaagtcataacgactttcggagagtacttctgaagaccgtcattctcaaaggcagctatgacctggaacgcgcagagcggagccctgtagactctggctgtagtcatcgcgtcatagacgtcggcaacggctatgatcgaggcgataggatctatctcatcacctgagagacctctcgggtagcccgagccatcgtttctctcgtgatgctggagagctgaggtcagtattctgctgtcgatattcggaatcttcgagaggagtttcttgccaagcatagggtgctgcttcataagggcgaactcctcgtctgtgagcttaccgttcttattcagcacctcatccgggatctggagtttcccgatgtcgtgaaaatatccggcgagggttatagtactcagagtatcagcgtccagattcatccacctgccgatgcctctcgcgatgagggccacattcagtgaatgaacgtagacagcgtcgtcgagcgaatccatcgtatggaggatgtcgaataagtctaatgtagtcttctgagcgaagagcgctgatacgttgcgcaggacagtcttgaaatccacttcaggcttttctgacctgataatgcgtgagaaaagtccccgcatcagagctatgttcttcgaataatcgatctgaaatgactggtagaccggggtgctcttaatcttctgtgagtaaggtatggtctctttcgctttgacaggagcaggctccggtttctcttctggtgcttcctccggggcggcctcagatttgatctttacgcttgcaatagaataaaacgtaaattttgaaataaggctcttgtctaagacttcgccggctttcgctatgcgctgcccatggagcgtaacgacatccttggctaaaaccatgcctggtctcaattcacttggcttgtagtttatatccattgggatccccctttaaatcaacaacttccttctacattataaattttttatatagcttacgcaatacatttttttatttatgtataaaacagtagtcgaattggcagggttgtacttgacagaatcaaaaactctgctagaatttgacatgtcttaaaaatagtaactaaataaagattctcttattcagaatggtggaggcacatagggcctgtgaagccatggcaaccccgtaaagccggcaggtgccttcctgagcgagacgcataagcgtgattcgaacaataaggggatttgaacctattcaaatccgccttcgggcggaattttttttcccaaggaggaaaccatggagaagcgtttattcacttcagaatcagttaccgaaggacatcctgacaaagtctgcgacgcagtcagtgatgccattcttgatgcctgcatggagcaggatccgatgagccgtgtcgcatgtgagacagctgcatgcacaggtttcattcttgttacaggtgagatcacaacaaaggccaacatcgatatcccagcaattgtcagaaaaactgtaaatgagatcggctacaacgatgcaaagactggtttcgatggaaatacctgtgctgttttcgtagcgctcgacaagcagtcacctgatatcgcaatgggcgttgacaaggctctcgaggctaaagagggcgagctgaaggatgaccttgataccggtgccggcgaccagggtatgatgtttggctacgctacaaatgagactgacgactatatgccgtatcctatctctcttgctcacaagctcgccaagagacttacagatgtaagaaaagacggaacgttaaagtatctccgtccggatggaaagactcaggtttctgtagagtacgatgagaacggaaagccattccgtcttgaggctgttgttctttctactcagcacgatgaggatgtaactcaggagcagatccacaaggatataaagaagtatgtcttcgatcctgtccttccaaaggagcttattgatgacaagacaaagttctacatcaacccgacaggccgtttcgttatcggcggacctcacggtgacgcaggactgacaggcagaaagatcatcgtagatacttacggtggtatggctcgtcacggcggtggtgctttctctggtaaggactgcacaaaggttgaccgttcagctgcatacgctgcccgctatgtcgcaaagaacatcgtagcagcaggccttgcagacaaggcagagatccagctctcttacgctatcggtgtcgcacagcctacatcaattaacatcgatacatttggaacaggaaagctctcagatgagaagcttgttgagatcatccgtgacaacttcgaccttcgtccggctggaatcatcaagatgcttgaccttcgtcgtcctatctaccgtcagaccgcagcttacggccacttcggcagaaatgacttaaaccttccttgggaagctttagataaggttgacgatttaaagaaatatctttaatcatctatataaaaaatgacagtggtctctgctgctatctggcggcagagattttttattgcaaaataaccttatacgtattaaaataaaaatagtgtgcattgaaaaagcgcattcaaacaaacaatattttgatgaggtactttagatgaagatcattgtaacaggcggagccggattcataggcagcaattttgttttttatgagagaaagaagcatccggaggacgagatcctctgtgtcgattccctgacatacgctggaaacctctcgacactcgagccggtgatgaatgacgacaagttcaaattttttaagatcgatatcagagaccgcgatagcgtctacaggcttttcgaggatgagaagcctgatatcgtcgtaaacttcgcggctgagagccacgtggacagatcgatcgagaaccctacgatcttcctcgagacaaatatcatcggcacttccgtactgatggacgcctgcagaaagtatggcataaagagataccatcaggtaagtaccgacgaggtctatggagaccttccgctcgacagaccggatatgttcttccacgaagatacgccgatccacacctcgagcccgtattcgacttcgaaggcttcggcagatcttcttgtaatggcataccacaggacatacggcctgcctgttactataagcagatgctctaataactacggcccttaccagttccctgagaagctgatccctcttatgatcgcaaatgccctggctgacaagcctctcccggtctacggtgaaggaaagaacgtccgtgactggctctatgtcgaggatcactgcaaggctatcgaccttatcataagaaacgccaaagacggcgagacctacaatatcggcggccacaatgagatgaaaaatatcgagatcgtaaagcttatctgcgactacttggacaagccgtacagccttatagagcatgtcgaggacagaaaaggtcacgacatgagatacgctatcgatccgacgaagatccacaacgatctcggctggcttcctgagactgcttttgcagacggaatcaagaagacgatccagtggtaccttgacaacaagccatggtgggagaacatcatctcaggcgactatatgaactactatgagaagatgtacggaaaccgaaaggtattagattaagaggaacgatacatgaagggaattattcttgctggcggttcgggtacaagactctatccgcttacgatggttacaagtaaacagcttctgccggtatatgacaagccgatgatctactatccgctttctacactgatgcttgccggcatccgcgatatacttatcatttcgactccggcagacactccgaggtttgaggagcttctgggagacggatcgcagttcggtataaagctgagctataaggtgcagccttcaccggacggactcgcgcaggcattcatcatcggaaaggatttcatcggggatgacgcgtgtgcgatggtccttggtgacaatatcttctatggaaacggccttggagccctgatgagggatgcaaagaagaacgccgaggagaacggtcaggcaaatatcttcggatactatgtaaatgacccggagcgcttcggtgtagtggagtttgacagggacggaaaggcagtatcgatcgaggagaagccggagaagccgaagagcaactacgctgttaccggactctatttttacccggcaggagtcgctgagatggcatcaaaggtaaagccgtccgccaggggcgagctcgagatcacgaccttaaacgatatgtaccttcagggcggaaacctgatggtaaagcttttaggccgtggattcgcatggcttgacacaggtacgatggagagcctccacgaggcggcaggatttgtccgcaccgtagagacacttcagggaatcatgatctcagcacctgaggagataagctacaagaacggctggatagacgaggcaaagctcctggagtcggccgagaaatacggaaagagcccatacggaaagcacttgaaggctgtcgcagagggcaggttcagatactaatagttacagaggaaagaatagatttcaaggagcagcaatgcagatcaaagttgagaaaaatgtcggcggtatcgaaggccttgcggtcatcacgccgaatgtacacagggatgagagaggatatttcgtagagacatggaactcccgcgagatgaaggaggccggtctcgatgtgaacttcgtacaggacaaccagtcgatgtccgagaagggagttctgcgcggactccacttccagaagcactatccgcagtgcaagctggtccgtgcggtgcgcggcgaggtctttgatgtcgcagtcgatctgagaaaggattcgaagacctacggcaaatggtacggagtcgtcctctcagatgagaatatgaagcagttccttataccagagggcttcgcacatggattcctcgttctctcagatgtagcagagttctgctacaaggtaaatgatttctggcatccgaacgacgagggcggcatggcatggaacgaccctgagatcggcatcgagtggccgaaggtaaagggcagctacaacgggacaccttccgcttcaggctacaccttagaggacggcacaccgcttatcctctcggacaaggaccagaagtgggccggtataaaggatactttctctttctaaattttagtaaaatattgtggcacggagccgggcggtcgtagcctgccccgtgccatcatcttgcagagatattggagaatttttgaacaatggcgatgattgaatgcgaaaattgcgggaccatgtacgatgagtcactggaccattgtccggagtgcctgtcatctgtccacgagacaaacgacgacggcgaagagtgcgggggaatatttgagccggtctcagtctggataaaggacaagggaaggcctgagctcatctgccgctgccagttttgcggagccttaaagacagaaccgatcgaggaggacgacaacccggttactattatgtcgatcgcatcaaggcctctggcgaatcctccgttccctgtcgagaggcttcaggaacttacggacctgatgggcggacagggagatatgagcggatattacaggaaataaactacgggtaaaatagaaaatgaacagagagaacaagcgtagaaaatacgataagaattactataagaaaaatccctgcaccgattcatttacctgcaggaactgcggctggcctatagtctccgcgggagccggttcaaatcaccgcaatcactgtccgaactgcctttgctcacttcacgtagacaatgagccgggagacagggcttcagactgtggaggcataatggagccgatcggtgtctgggtcagaggcgatggcgagtgggcgataatccaccgctgcaggagatgcggcaaactgtcgtcgaacaggatcgcggcagatgacaatccgatgaaacttatggcgcttgccatgaagccggtggtaagtgatttcctggacaggggcagacttaaggagatgctttcttcaatgcagtctcagggagatttaatctgacaggaggtatcataggtcctgtaaaagatacttgcgaaacgaggggcgtgcaggtataatgtattagttgtgtatctttacaactaataattctggaggttttttgatgagaaggaataaagcagcagtcctcgtttctatggcgcttgtcggcacctttcttttgagcggctgcgcagcgaaatcgagtgatacacttataaatattgacaatggcaaggcgaagattacatacggatacggcaactttgtagccaaatacaaccaggccacctacgaccagtactatctgcagtacatgggacagaattactggagccagtcgcagggctcgaagacgatggaggagactgtaaaggacaacgtcatcgacggtatcgaagagcagtatgtcgacaagcagcatgccggcgactacaatgtcaaggttacttccgaagacaaaaagaagatagaagcggccgcgaagaaattcatttcgaagaattccagcaaggccatcaagcagatgggtgcgactgagagctatgtcaaggacctgctcgagtacgagacataccaggccagagtaagaaatgcagtcgaggacaaggccagtgtcacagtcacagacgatgaggccaggcagtcaacaatctcctatgtatgtttttcaacggcatcgactacagacgcttccggtaatgcgaagactctgacagaagctgaaaagcaggatatgaagaagaaggcggaaaacgttgccaacgcctcggatttcgataaagctgcaaaggcagcaggcggcaatgtttcgacgcactcctatacaacaaatgccaaatcttatgacagtgatgttcttggaaaggacgttattaaagcagctaagaagctgactaaggaaggccagatctctgatgtaatctatgtaaagaacaggggatatttcgtgcttcgcatggataagcttactgacgagaaagccacaaagagcaagaagaaagatctgacttctgagaagaagcagaaagtatacgagaagctggtaaagaagtgggtcaagcaggccaactttaaactggacaagaatctctgggaacaggtcaaatttgaggacctcttcaccgccaagacaaaaaatgccagcggaaacgcttccggaagttcgatttccaaataataaaagatacgactgcccgcagagggcagtcttgttttagctataaagaattttttaagaggatctattatgagatttgcagctcactatctcggtgattacaaaaaagagtcacttctcgcgccggtatttaaaatgcttgaggccatcttcgagcttttagtcccgcttgtaatggcaaagatcattgacgtcggaatcgcaaataaggacgcaggttatattttaaagatgtgcggtgtcctgataatttttgcagtagtagggcttgttgtagctattattgcccagtatttcagtgcgaaggctgcgataaatgcagccggaaaaataagagaggacgtatttttccatataatgaagttctcgaggggctcactcgagaaggcaggaaccgcatcgcttgtgacgagaattacaaacgatgtaaaccaggtgcagaatggaatgaatatgttcctccgtcttttcctgaggtcgcctttcatcgtattcggtgcgatgatcatgtcatttacagtcgatgtgaaggctgctcttgtcttctgcgtagtcatccctctgctgggactaatcgtatatctcgtgatgagggctacgcttccaaagtttaaaaggatacaggagggacttgagaagatccttctgacagtaaatgaaaacctcgagggtgtaagagtcatcagggctttcagagtagaggataaacaggacaggaggttcaaggacgagacagcagacctctatggaagacagatctcgacaggaaggctctcggcactcttaaatcctgcaacttacgcagttattaatcttggaatcgcatcgatcctctggatcagcggagcgcgcgtaaatgccggaatcctgacacagggtgagacagtagcactcgtaaactacatgtcgcagattctgatcgagcttattaagcttgcaaacctgatcatcctccttacgagagcgctttcttcctgcggaagacttcaggagatcctcgagatgaatccggacgagagagttcatgaggaggccgccgcaaaggaatcagatgatacagcgatcgagttcaagaacctctcatttacatatccgggaagccgtgacagctcgctttcagatatcaatgtaagcatcaaaaagggacagagcctcggaatcattggaggcactggttcaggcaagagctctctcgtaaggcttctgcgccacgcctacgatccgacatcaggagagctgctgctgttcggaaatgacattaagacatactcggatgaagagcttgtaaaaatgatcggacacgttccgcagaaagcaaatctttttacaggaacgataagctacaacttaaggctcgcaaagccagacgccagtgagcaggagatgtgggacgcccttgaagctgcccaggcgaaagagatagtagaaaataaggagaaaaaactcgaggagccggtattaagaggcggcacgaatttttcaggtggacagaagcagagacttacgatagcgagagcccttatcaagaaaccacagatccttatcttagatgattcggcatcagctcttgatatgctgaccgagcgccatcttcacgaggcgattttaaagctgccgtggcatccgacatcagttatcatctcgcagcgtgcatcgtctgttatgacctgcgaccagatcctcgtgctcgagggcggaaagccggtcggacttggaacgagcgatgagctacttaagacctgcccgatctacaaagagatttacacgactcagtttgaatacaaggaggagggcagatcatgaaaaaagattcgacaatgaagagagttttaaagcttttgaagccatatacaggatttattattttatcgctgatatttgcgcttggtactgttatttcgactctgatgattccggtactcgaaggaagagccgtagaccacatcattggaaaaggaaaggtggacttttccggtcttctctttgtcttaaaggagatagcagccgtggcagccgtcacatttttctgccagctgtttatgaacctgataaataaccacatcacctattcggtggctaagaccctgaggcagagagcgtttgagaggctcctgcgcgtccctgtaaaagtgatcgacagcgagagccatggcgatatcgcaagccggatagtaacggatgcggactcgtttacagacggactcctgcttgggtttacacagctctttacaggaatcatgacgatagcaggaactatcattttcatgataaggatccgctttacgatagcccttatcgttatcgcagctaccccggtatcgcttcttattgcaaaatttatttcaggcagaacgtacagatacttcactcagcagtcgaaggacaggggcgatttgacagagtacatcgatgagagaatttcgcttgaggatctggtgagtcagctcggagccggagaattatcgaaagaggaatttgtaaaaaagaacaataagcttacggattctgccacgaaggcaacgttttactcatctctcacgaacccttctacaagatttgtaaacgcggtcatatatgctgtagtcggagtagtcggagcatttttggcagtggccggaagcatttcggtcggtgaacttacaagcttcctcggttacgccagagagtatgcccgcccgttcaacgagatcaccggcgtcatcacagagatgcagaacgccatggcctgcgctgccaggatcttcgagataatcgatcaggatcaggtcgaggactgtgacggtgagttcgacggagaggtaaagggcgccgtagacatggaacacgtcgatttttcgtatgttcctgagaagccgcttattacagatttaaatgtcaaggtaaatcctggtgagaaagtcgctatcgttggtcctaccggagccggaaagaccacacttattaaccttctgatgcgcttctacgatgtaaatgccggctctgtaaaagtcgatggcagagacataaggacggtaagcagaaatgcactgcgcagccgctttggtatggtgctgcaggagacattcctgttttcaggcactataagagacaaccttactcttggaaaaccggatgctacggacgaggagatcatagaggcttcgaaagccgcccatgctcacgaatttatcaggaaacttcctgacggctatgacacagtcctctcgccttcggggacactcagccagggccagaaacagcttctgtgtattgcaaggcttatgcttgcgcttccgccgatgctgatacttgacgaggcaacgtcatctatcgatacgagaaccgagatgaagattcaggacgcattcaacaagatgatgaaggggaggacgactttcgtcgttgcccaccgtctgcagaccatccgcgatgcggacatgattttgtacatggagaatggccatgttttagagcagggcaatcacaaggagcttcttgcaaaaaatggatactatgcaaaattgtacaggtcgcagtttatgtcttgactttttttcgattctatataaaatatatacggatattgagaataactttacaaaattgttacacatgtaaggataggtaattatggaacagtacgtgatgaaaggcggtacgccgctgatcgggtccgtaaatatatcaggggcgaagaatgcggcgctggctattgtggcagctgccgtcatgtctgacgaggatgtgtatatcacaaacctgccggatgtgaacgacattcatgtgatgctcgaagctataaaagagattggggcgaaagtcgtcaggccggacaggcattctgcgattattaacgggtcaactatcgacaatctcgtagtagactatgagtttatcaagaaaatccgcgcttcatactatctgcttggttcgcttctcggcaagtacaagcaggctgaggtcgcacttccgggaggatgtgacatcggtgcgagacctatggatctgcacaccaagggattcaaggcactcggagctacagtcgatgagggctacgggcttatctctgccaaggcggacagactcgtcggaacgcacatctacctcgataaggtttctgtcggcgccactataaatatcatgatggcagccgttatggctgagggcaggaccagcattgagaatgcagccaaggagccgcacgtcgtagatgttgcgaatttcctgaacagcatgggggccgagatcaagggcgccggaactgacctgatcaggataaatggcgtagaccatctgcacggaacagagtactctgttatccctgaccagatagaggccggtacttttatgtatgctgcagcagctacgcacggagagattaccgtaatgaacgtcataccgaagcacctggaggctacgactgcgaagcttctcgaagccggatgccggattgcagagggagatgatctggtgaccgtttcggcgaaggatatagagctccagccgactcaggttacgacacttccttatccgggatttccgactgatatgcagcctcagatgacagtcgttttaggacttgccaatggagtaagcactgttactgaaagtatttttgagaacagatttaaatatgtcgcagagctaaaccgcatgggcgcgaaggtaaaggtcgagagcaacattgcgataatcaccggagtcgatcactacaccggcgccagagtcgatgcaccggatttaagagccggagcagctcttgtcattgcaggacttgcagcagatggtttgactactgtagacgatatcaagtatattcagcgaggctatgaggatttcacagagaagctccgcggagttggcgcatcgattgagaaagttgacgacgagcgcgcattaaagaagtttgtttttcaggtgtcataaaaatgagaatactgtttctacgttggaactgcttcaatagagaatcgacggtagaggcgatgaaaaagcagggccatcaagtcctgcctttttttcaccgcgattacaatcagctcgagtccgatgatttcaaggaatcatttgcagattttgcagaagaaaataaaccggatataacattttcctacaactatttcccgattgtggcagagtgctgccatgacctggggcttccatatgtatcagttgtttatgacaatccggctgtctatgtctactcgtatacgctgatgtatccgacgaaccacgtctatattttcgactcgcagtgggtaagtgaattcaatgccggaggacttaataacgtacactacattacgcttcctgctgataccagccggatggacatgataaaaaaggaccacgagaaaaaacacgcctgtgatatctcgtttgtaggtgccttatataatgagaggcacaatttttacgagaggatggaagaaaaccttccggagtatatgaggggatatctcgaggggcttatggatgcgcagtccctcgtgtatggatctgatatcattaagcctgccttgaatggagaagtcattgctgccttaaggaaggccttaccggtattcccggacaagctctcggtagagccggacaactacagattcttaaaatatgtgatcgggagaaaacagacgagtcgtgagaggataaagtatctgactgcaatcgggaaagaccacagggtcgatctctacactttagatgatacggctgagataccgggagtaattaatcacggagtcgcggactacgactacgacatgccgctggtattcgcccagagcagaattaatctgaatattactctaaggagcattgataccggaatcccgcagcgctgcatggatatcatgagctgtggtggatttcttctgacaaattatcaggctgatttttcactcgatacggtaagcagtgacggctcagcagcatttgtgccgggggtcgattacgacttttactcgagtactgatgagctgattgaaaaggtcgattactatttaagtcacgaagaagagagggcgcagattgctgagaatggatttaagaaagtaaagaagtactattcgatcgattcattcctgcaccggatcctcgatgaatttttaaaatgaaaaagcggtgtacaagagcttctgcatgatggtctcgtaggtgtaattgttttttgttttctcaaagccggcgtacgcgatctcacggcgccgctcatcgtgttcgaggtagtaggcgcagaggccgcgcagctcgtcaaggctttcatacatgacgatctcctcacctggaacgaagagttcagggatctcttcctgatagtttgagatgcagaatccaccgcaggatgtgatatcaaaaatcctctgaggaagcccggtacggatcgtcttcgaggtcgtatttatatttattttggattcatgaaaaatgatcggcatctcttcaagggatttcgcgagtccgagattgtgaatctttggcatccccgaggtatcagacccagtatagatcgatgtgtcgaagtgttctgagagcattttgaaagtgtcgtcacgctctatcgcagtgacagcgtttccgaggtactcctgtgcgactgtccgcttatctgtaagaaaacttccttccggagcatatggaaaattcggaagagcgttttttatctcctttgtgatctcatcggtcagaagatcttcgatgaaaaaatatccatagactgactcctgtgcttttaaaattccgtcgatatatccggcggtgtgcatagagaggcctttcgcactcagatggtatggatccttttcggagtagagacttccgacgaacgctatctcgtgagaaaatctctgcttctgttcttcggaagcggagtctatgacctgcatcctgcgctttactgaaccggcgagcggcagatgaaagacacagtcgggattcagtggatggatctcgttgtagacagcccggtcgaagataaaagtcctgttgtatttgtttgtgataggacgggtgtagagctcgagcaccggcgcatcgactacccacgagatatacctcagatggtagatattcgcgagctccgagacatacgggaagaaattgatcgaaaagagaaagtcacacgggtgcttttcaacgaactcgtttaatagcttaagggatgtggaaggatagtcgttcttcacagtgacttcgcggctgtactctatgacttcaatcccgaattccttgaatgtggctatgatgtcgggctcattcaggcttccatagcgaacgaatatgactttcatatgattcctcctgtaaataaattcattatatacttaaagagcagaaaatgaaaataaattctacaaaaaagatcctggtctaccgctggaaagcctataactacgacgacgtgatagccgcgttcgagagagcgggctgcgaagtaaagtgcattgcccagaaactcttgaactacgaggtgaatgacgacttcgctgcggtttttgaaaaagagctggcgtctgataattatgaattcgtcttttcgataaactactttcctgtcatctcagacatctgccagaaaaatggcatcgaatacgtctcgtacagctgtgacagcccgctgatttcaatgtaccatgagtcggtattcaaccaagtaaacaggatctttctcttcgatgctttggctgtggccaatttcagggcgatcggtgcatctcatgtcaggtatcttccgctcggagtcgacactgcgcgtctcgacaggctcttcacattcagctctccatttaaggaggagactgaaaggctgctcgagcgctcccttacttttgtaggaagcctctatgaaaaaaattcctatgataaaatatcagataagcttccggagtatctgcgtggctactttgacgctgcaatgcagcttgaaagcgcacgattcgggactgagcattttttcgatgagataatgacgcctgaaatcagtgaagagcttttggagtgcgtagatttcgaaaaatcagaccgctcattttcagaccttccgtttgtcttctcagtaacctcactcggcttcaagtgcgcgcagatccagcggaagcgggctcttactgacctttcaaaaaagcacagcgtctgtctttttaccgagagcgatacctctgatattttttctgtaaaaaatatgggtggagtcgactacaggcttataatgccatgggttttcaggaaatcggcgataagcctcaattttactatttcaaatataaagacagggattccacttcgggtctgggatgtgcttggtgccaggggatttctttttacgaaccatcagaaggaactcgatatttattttaaggatggagaagatctggtctggtttgacagcgaagaggagctgatcgagaaagcggacttctatcttgatgaaaaaaatgcctccctgcgggataagatctcgcagagaggttatgaaaaagtctccacttaccatactttcgataacaggatatcacagcttctcgtcgataaggagtcctgagtaagggcttgacgcgtagactgctgtgaaatgattcttcgtaggatccttgtactcgactgtgatcttcttcacatagcggagcgggtcgatagaagacttctcggcctcggtgtgcatcgcggccttgaatttattaatattgtggatcgcgtcctttacatccacacctgagatcgagtcatcaagcttggtcttgtcgatctgaaggagtccgtagtcatcggctgtaatgccaagctggccgagttcgtctttaagtccggtgctgactgaggccatatctttaatcaggctgtcgtttccgttcgtatcggcatacttgcggccgacagcgataaagctgttgtacgagtcgataaggtcagaaacagaatcggcgatcatatcggtatctgctttgaaaccgactgtaacaggctttcctgcctcggtcttctctttaagatcgatggcaaagcgctgatttatcgtaaatgaattcgagagtgaatggtgccgagatccgttcagacgaaatgaagaattcgaggctggctggcttacagtatcgatacctaaagctttcagggcgttgtagctggtgccggagcttatcttaaagaggcagtcttcggtagaagagagtccggtctgcttcgatgtgatcacaagagctgccatccgtccgaaatccttgatgcctgctgtgaggcctgtgtctgaattatttatcaggcgctcgatcttctgctggacatcatagttcgtgtcaccgtcatttaccgtgaactggaactcgtatgagccggcattcgaatcgagatcgaaactgtatgagccgggcttgaacgcagtgtcgtcctttataaggggatttccctcgttcacctgaggctttgcgagctcgtctacatcgatggtaaaagtctctgatgtgtcgacatcgtcggactggcttccgatatagtcaaccttgaccttgtcttcatctgaagaataggctttcttctcgttcaggacggactctatgctctcggaaccgccgcccatattcaaaacgacgttctcgagcttgtgcgcgttcgccttcaggtcgatcgcaaattcggccatacgaggggtgtagttgatcttgtagaccggagcgttccggttggtcatgagcattctgctgtagaccttctgaagatcgctcttcttatggttatcatgctccgcggaggaagtctgattgccataagtggacatcaggtagcctaaaaccaatgtgctgtttatgatggccatagcacttcctcctttcttccttgaaattatactgccagtttccgaatccctttcgaaaataataatctgacaatatgaaaatgccggtcaatttgaatgacatctgtatctccctatagaaatacaaccctatactatcacaaatactaaaaaaaataaagaaaatcgtgaagataatgtgaaaaaacttgacagaataccttctgcatggtaatattgttcccgtgacggaaggcagggccttatttttttgtgcaaaattagcggaatgcacgaacgaagaaagccctaacaaacacaacaaatacattgatttggaggtggaagttgtgcgtacaaaaataacacttgcctgcacagaatgtcagcacaggaactacaacctgacaaaagacaagaagactcatccagagagaatggaaaccaagaagtactgcccattctgcagaaaacacactttacacaaagagactaagtaaaggggcgtttctatggcagagacaaagaaaaagcgcaagcgcatttccgaatggtgggatggcgttaaagccgagttcggaaagatagtttgggctgacagaaagaccgtgggccgccagacggtagctgtggtcattatttctgtggtactcgcactgcttatcgtatttttcgatatgataatcagatacgggttggacaaactgattaagctctgatggaggagatgcgttaatggcagagacagagacacagaatccggcacaggatcaggatgtagaacaggttgcagcgaatcagccgacagatccggatgtagagaaagttacggcggatctggaagaggattcacagagccaggtacatgactcagaagaggactctgatgagagtccggcaaagtggtatgtggcccatacctattcaggttatgagaacaaagtaaagaccactattgaggaaacggtggcaaaccgccatctcgaggatcagatcctcgaagttatggtcccgactgaagaggtctcagaattaaagaacggcagaaagcgtcaggttcagaagaagctgtttccgggctatgttatgatcagaatgatcatgaacgacgatacctggtatatcgtcaggaacacccgtggagtcacaggatttgtaggacctggaagcaagccggtacctcttacagaatatgacatgagaaaccttggcattaagactaaggtcagaactgatgtcgattttgccgaaggagatacagtttctgttatcggaggcatctggaaggatactaccggagtcattacagctcttaatccaagcaagcagacggttactatctcggttgagatgttcgggcgcgaaacccctgtagagattggtttcgcggatgttaagaagatctgataagcgtcagatcgcggaaggagaattaaagtggcaaagaagatcgaaggttatatcaaacttcagattcaggccggaaaagctacaccggctccaccagttggcccggcacttggtcagcatggtgtaaacatcgtagaattcacgaagcagttcaacgcaaagacagctgatatgggcgacactgtcgttcctactatcatcactgtctatgcagacagaagcttctcattcatcacaaagactccgccagcagctgttcttattaagaaggcagcaaagattgacaaagcttcaggcgagccaaacaagaagaaagttgcaaagattacaaaggctcaggtcaaggaaatcgccgagaccaagatgccagacttaaatgccgcaacgatcgagtccgctatctcgatggtcgagggtactgcccgttcaatgggtgttgaagtcgtagattgatcttaaattgtgggagggaacctcttcccatacagaccacaggaggaatttttcatcatgaaaagaggaaaaaagtatcaggacgcattaaagtccttcgataaatcaaagcagtacgatccagcagaagctgttgcgatcgttaagaaaaatgccactgctaagttcgacgagactatcgaagttcacatccgtacaggatgcgatggccgtcatgctgatcagcagatccgtggcgctgtagttcttcctcatggtacaggaaagactgtacgtgtccttgtattcgccaagggtgcaaaggctgatgaggcaaaggccgcaggagctgattacgttggagctgaggagcttattccgaagatccagaatgacggatggcttgatttcgatgttgtagtagctacaccggatatgatgagcgttgttggacgtcttggacgtgtccttggacctaagggattaatgccaaaccctaaggctggaacagtcacgatggatgtcacaaaggctatcaacgatattaaagccggtaagatcgagtatcgtctggacaaagcaaatattatccatgtaccagtaggaaaggcttcattcagtgaggctgatcttgctgacaacttccagtcgcttatggatgctattgtcaaggctcgtccgagcacactcaagggtacataccttaagaacatcaccctgacctctaccatgggtcctggtgtccgtgtaaatgccgcatcattcggcctttaatttcacccttgacaaatgcatctgatagatgtatattaataaagcttgccatagacagcaggtgctccatggagcgcaacgcgtaagctacctgccgaggtaatgattattcaagagatcattatgaatcctgtggcgcgtccacaggattttttattgcaagctgcagtactatactaacaggaggtaaagtaaattggctaaagtcgaattaaaacagcctatcgtagacgagatctcagagcagatcaaggatgcacagtctgttgtcgtcgttgactaccgtggccttactgttgcccaggatacggctctgcgtaagcagctccgtgaagctggctgcacttacaaggtttacaagaacacgatgatgaagcgtgcattcgcaggtactgactgtgagaagctttccgatgttctggaaggcacgaacgccatcgctatttcaaaggatgacgctacagctccagcacgtatcattgcaaaggcagcaaaggatgcacctgcactcgagatcaaggctggtgttgtagagggcaacttctatgacgctgatggtatgaagactatctcttctatcccttcaagagacgagctcctttcacgtcttcttggttctctgcagagccctatcgcaaacttcgcgagagtgcttaagcagatcgctgataagggtggcgctgatgaagctgcaccagcagaagaggcagctccagccgctgaagaaacaccagcagagtaattaaagtaatcaaaaagtatgatatcggcaccgccggtcatacaaacggttatcgaaagaagtgtgctcggcgcagccggacatacgaacagagattgatttatgaacgccttagagagtagatgtcgacgggcgcgacgactgtgtgtgctcgcgcgctaaatgcgccagcgagcgcaccagtcggaattagcccgtcgacttcataactaaagcgctcacctacaaatttttcggaggaaaaacaaatggcaaagatgactacagatgaatttatagcagcaatcaaagagctttcagttcttgagttaaatgaccttgtaaaggcttgcgaggaagagttcggcgtatcagcatcagcaggtgttgtagtagcagcaggcggtgcagcaggcggcgctgaggctgaggagaaggacagctacgatgtagagcttactgaggtaggcgcttctaagatcaaggttatcaaggttgttcgtgaggctactggacttggactcaaggatgccaaggatctcgttgatggcgctcctaaggttatcaaagagggtgctgacaaggctacagctgaggacctcaagaagaagcttgaggaagttggcgctaagatcactcttaaataatccaaccattatttcagactttaccggcacgggtgcatatcgcacccgtgcttttttttcgcgttacaaatgagcggtgctgaaatatcgtatcgatgccggcggacgcttgcgtacgcaaaggcaatcgatacgatatttcaatagcgcgaacgcgcgaatgagcagccgcgaagcgggtgcgaattgcaccgctcatttgtccatagcgcgaacgcgcgaatgagcagccgcgaagcgggtgcgaattgcaccgctcatttgtccatagcgcgaacgcgcgaatgagcatggagcggttgttatgctgccgcgagcctgaagggtgaagcgggagcattataaaccgcccatgcgatagccgtccgcgattggcgagcccgaagggcgaagacagagcggaaacggcgaaccgctggagcgaagcgggtgcgaacagcaccgctcatttattagctttcaattaaaaataataaactcttgacatttgctcttgacttgtgctatagtatagcgtgcttttaccatgggcacagattacgggatttttgtgcgcattttggcctgtggaagaccgcagtttaagtatatttttatcgaaaggtgagctttaaatggagaaaaacagaatacgtcctgttaaatccggcaagggcatacgaatgagctacgccaggcagaaggaagtactgaagatgccgaacttcatcgaagtacagaagaagtcatttcagtggtttcttgacgaaggcctgaaggaagcattcgatgatatcaaccctatcacggatttcagtgatcatctgagtcttgagtttgtcgatttccaactcatgagagacaaagcaaagtacaccatcccagagtgcaaggagagggacgctacatatgcagcacctcttcaggtgaaagtccgtctttacaataaagagacagacgagatgcaggagcatgagatcttcatgggagacctgcctcttatgactgagactggtacttttgttataaacggagcagagcgtgttatcgtaagccagcttgtccgttctccgggaatttattatggtatcgaccatgataagattggaaagaaactctattcatgcactgttattcctaaccgtggtgcatggcttgaatacgagactgattccaatgacgtattttatgttcgtgtagaccgtacgagaaaagtaccggttaccgtacttctccgtgctctcggtcttggcaccaaccagcagatcctcgatgtatttggcgatgagccgaaaatcaaggcaagcttcgagaaggacccgtgccttgagggagagaatgctcagggcagccacgagaagggcctgatcgaactctataagaagatccgcccgggcgagcctatcactcctgagaatgcagagggactcatcacatcgatgttcttcgaccctaggagatacgatcttgccaaggtcggcagatataagtttaataagaagcttgcattccgcgccaggattacaaaccagattcttgcagaggatgttgtaaacgaatctacaggagaggttatagctgaagccggaacgaaagttaccagagatattgcagacgagatccagaacgctgctgttccttttgtcatgatccagaccgaggagagaaacgagaaggttctgtcgaatatgatggtagacctcaaggcctatgttgactttgatcctctgaaggaagtcggtatcaaggagaaggtttactatcctgtactcaaaactatcctcgatgagtgcggcgatgacgaggaggctttaaaggaagctcttataagagataagaacgacctcgtcccgaagcatatcaccagagaagatatttttgcatctattaattacaacatgcatcttgagtggggaatcggtaataaagatgatatcgatcacctcggcaaccgtcgtgtacgtgcagtcggagagcttctccagaaccagtacagaatcggactttcacgtctcgagagagttgtacgcgagaggatgtcgactactgatgcagctgagatccagcctcagaagcttataaatataaagccggttacagcagcagtcaaggagttcttcggttcatcacagctgtcacagttcatggaccagaacaacccgttgtcagagcttacacataagagacgtctgtcagcccttggacctggaggtctttcgagagaccgtgcaggattcgaggtacgtgatgtccactacactcattacggccgtatgtgtcctatcgagacacctgaaggtcctaacatcggacttatcaactctctggcaagttacgccagaatcaatgagtacggctttatcgaagctccttaccgtaagatcgataagagcgatcctaagaatccgcgtgtcacgaacgatgttgtttacatgacagcagatgaagaggacaattatcatatagcacaggctaacgagaaactcgacgatgagggccacttcgtaagacagatggtttccggacgtttcagagaagagacacaggagtacgataagtccctgttcgactacatggacgtatctccacgtatggtcttctcggttgctacgtcactgatcccgttccttcagaacgatgatgctaaccgtgcgctgatgggctccaacatgcagcgtcaggccgtacctcttctcactaccgaggctccggtcatcggaaccgctatggaagagagagctgcccgcgattcaggagactgcgttattgcaaagcactctggaactgtagagaagtcagagtctacgaggattgttgtccgcacagacgagggagcaagagacgagtacgttctgatcaagttcgagagatcgaaccagtcgaactgctacaaccagcgccctatcgttttcaagggtgaccatgtagagaagggtgaggttattgccgatggaccttctacctgcaatggtgagctttcattaggtaagaacccgctgatcggattcatgacctgggaaggctacaactacgaggacgctgtacttctttcagagagacttgtcagagacgatgtatttacttctattcatatggaggaatttgacatcgaagcccgtgagacaaagctcggacctgaagagatcactaaggaagtaccgggagttggtgcagatgccttgaaggatctggattcagacggtgtcatccgtatcggagcagaggtcagggatggagatatcctcgttggaaaagttactcctaagggagagacagagcttacggcagaggagagactcctccgtgccatctttggtgagaaagccagagaggtccgtgatacatcacttcgagtacctcacggatactacggtattgtagtagcagccaagacatttacaagagaaaacgacgacctggcacctggtgtcaacaagtcggtacgtatatatattgctcagaagagaaagatcggcgtcggtgataagatggctggtcgtcacggaaacaaaggtgttgtttcacgtgtacttcctatcgaagatatgccatatcttcctaatggccgtccactcgatatctgcttgagccctatgggcgtgccttcacgtatgaatatcggacaggtgcttgagatccacctttcacttgctgcaaaggttttgggattcaacattgagacacctatcttcgatggcgcagacgagaaggacatcagagaatccttaaggatggcaaacgactatgcgaggatcgaccttaccggaaaggataaggagagaggcttcacaaacgatgccggccaggaatctatttcgtgggatgagttcagggacatgtacaaggacaaagtcagcgaagatgtcatgaactatctgtatgagcacagagagcatacgaagctctggcatggagtttctatcggagaagatggtaaggtacaggttcgcgatggaagaacaggaaaggccttcccttctaaggttactgtaggacacatgcactacctgaagctccatcaccttgtagacgacaagattcatgcccgttctactggtccgtactcactcgttacgcagcagcctctcggtggtaaagcacagttcggcggacagcgtttcggagagatggaggtttgggctcttgaagcttatggcgcagcctatacacttcaggagatcctgaccatgaagtcggatgatgttgtcggccgtgtcaagacctatgaggctatcattaagggccagaacattcctacgccaggcatccctgagtcattcaaggtaatgctgaaggaactccaggcactctgcctcgacgtcaaggtcctcgatgagagtggcgacgaagtgaaacttctggagtcacaggattacggaaatacgaacatcaataagctgatctcagatgacagcagagactacgctttcgagaagaaagagaactttgagaagcatggtttcattcatcaggaggtcaatgatgatacaggtgagttcgagaatgtaccgtcaggtgactccgataatttagacgaggatgacggcgattatgagctcgatccacagaaacttgcatcagagcttacagatatgtcagatgacgacgagtaacggaaggagaaattgatgccggaaaaaaagaaagaagcgacaaatcagtctgttggttttgactccataaagatcggtctggcttctccggaaacgataagacaatggtctcacggcgaggtcaagaagcctgagaccatcaactaccgtactttaaagcctgagaaggatggtcttttctgcgaaaagatttttggaccaaccaaggactatgagtgtcactgcggaaaatacaagaagatccgctataagggtgttgtttgtgaccgctgcggtgttgaggtcacaaaggcttccgtaagacgtgagagaatgggacacattgagctcgcagctcctgtatctcatatctggtatttcaagggtatcccttcgagaatgggactgatcctcgatctctcaccaagatcactcgagagagttctctacttcgcatcgtacattgtacttgatcctaaggacaccccgcttcagaagaagcagatcctttcggagcgtgagtatcagacgaatgtcgagcagtatggacctgacagtttccgcgctggaatgggcgctgaggctatccaggaactcctgaaggaaatcgaccttgacaaggagtacaaggaactcacagaggaactcgaaaaggcatcaggccagaagagagcccgcatcatgaagagactcgaagtagtcgaggctttccgcaactctggaaacaggcctgagtggatgatcctgaatgtacttccagtcatcccgccagatcttcgtcctatggttcagctggacggcggcagatttgccacatctgatctgaacgatctgtacagaagaatcatcaatagaaataaccgtctgagaagacttcttgagcttgcagctccagatatcattatcagaaatgagaagcgtatgcttcaggaagctgtcgatgccttaatcgataacggccgccgtggcagagctgtcacaggacctggaaacagagccttaaagtcactgtcagacatgctcaaaggtaagaacggaagattccgtcagaaccttctcggaaaacgtgtcgactattcaggccgttccgttatcgtcgttggaccagacctcaagatgtatcagtgtggtcttccaaaggagatggctatcgagctgttcaagcctttcgttatgagagagcttgttcatacaggcattgctcagaatattaagaatgccaagaagatggtcgagaagcagaacgatcctagagtctgggatgttcttgaggatgtcatcaaggagcacccggttatgctgaaccgtgccccgacactccacagacttggtatccaggcatttgaacctatcctcatcgaaggaaaggccataagactttctcctatggtctgcgcagcattcaatgccgatttcgatggagaccagatggctgtccaccttcctcttacacaggaagcacaggcagagtgccgttttatgctcctctcaccaaataacctcttaaagccttcggatggcggagttgtagccgtacctggacaggatatcgtcctcggtatttattacatgactcagatccgtaaaggcgtaaagggtgagggcaagatcttcaagagtatgaacgaggcaattcttgctcatgagaatgacgagctcgattggcacgctctgatcaaagtccgtgtagagaagactatgccggacggcagaaagctctccggacttatcgaatctactcttggacgtttcctcctcaatgagaaggtacctcaggatcttggattcgtagacagaagcattccgggcaacgaacttaagctcgaagtcgataagcttgtaaagaagaaggatatcaaggctattctcgagagagttatgcgtaagcatggtgctacaaggacagccgaggtactcgatgatatcaaggcatttggttacaagtactgcacactctcatctctgtcagtttctatttcagatatgactgtgccgcctcagaagccagagcttattgccggtgcagagaagacagttgacgtcatcaataagaaatacagaagaggtctccttacagaaggtgagcgttataaggaagtcattgagacctgggagaagacagataaggaacttacagacgaccttctgaatggacttgaagaacagaacgagatctacatgatggccgattctggagcccgtggttctgataagcagatcaaacagctcgctggtatgcgtggacttatggccgatactacaggtcatactatcgagatgcctatcaagtcgaacttccgtgaaggtctcgacgtactcgagtacttcatgtcagcacatggagcccgtaaaggaatgtccgataccgctctccgtactgcagattccggttaccttaccagacgaatggtcgatgtatctcaggagcttatcattcgcgagaatgactgcaacgagggtacaggaaaggaaatccctggcatgtatgtaagcgccttcatgaacggcaaagagctcgtagagagccttcaggaccgtatcacaggccgctacgctgccgagactatctgcgacaaggatggcaatgtcattgtaaaggccgaccacatgatcactcctgcccgtgcagaagctatctgcaccaatggtgttgacaaggacggaaagcctcttacacgcgtaaagatcagaaatatccttacatgccgctgcaagaatggtatctgtgctaagtgctacggcgccaacatggctactggtcagcctgttcaggtcggcgaggctgttggtatcatcgcagcccagtccattggtgagcctggtacacagcttacaatgcgtaccttccactcaggcggtgttgccggaacagatatcacccagggtcttcctcgagttgaggagcttttcgaggcccgcaggcctaaaggaatggctatcatcactgagatttctggtacagctcatatccgtgatgacaagaaccaccaggagatcgatgtagtagctccgaacggagatacaaagacataccttatcgtatacggaagccacatcagcattgccgatggacagcacgtagaagcaggagatccgcttacagctggttcaatcaacccgcacgatcttctcgatgtcaagggcattgaagccgttcagaactatatccttcaggaagttcagcgtgtgtacagacttcagggtgttgatatttccgataagcatatcgaggtcatcgtacaccagatgatgagaaaggttcacatcgacgatgccggcgactcagaattccttccaggcagccaggttgatttcctcgagtatgaggatgtcaatgaaaagctcgaagcagagggaaaagagcctgctaagggcgagcgtgtacttctcggaatcacgaaggccgctcttgctacagattcgttcctgtcggccgcatctttccaggagacgacaagggttcttaccgatgccgccatcaaaggaaaggtcgatcacctcgagggactcaaggaaaacgttatcatcggaaaacttatcccggctggtaccggtatgaagcgttacagagatatcaagctgaataccgactatgagaccgagatcctgaatggcaacggagacgaggaggatcttgtcgaggaagagactccggttgaggaagattctgacaccatagacatagattaatagaaatttatctggcccgctggcgtttgctggcgggcttttttaaaaaatatgaatgaaaaagtatctattataacgccgtgctacaacggtgcgaaatatgttggggagacgattgagtcagtgctcgcccaggactacacggactgggagatgataatcgtaaacgacggctcatcggacaactcctgcgatattgtctcatcctatgcggcaaaagatccgcggattactcttatcaaccagccgaacggaggctctgcaaaggccagaaataatggcattgagcatgcgaacggccgatacattgcgcttctcgacgctgatgatctttggaatccggactttttatcgtcgcaggtatcatttttaaaagaaaaaaatgctgcggtcgtctgctcaagttacgctcatatcgacgcagattcaaaagtctttggaaaagtggacgtggctaagccagtcatcacattgaaggatatgtatgtgatgaaccggataggctgcctgacagggctctacgatgccggtacctacggtaaggtctatctgagagaggaattgaaaagcctgagagacgactacgcgtattggatagactgcgtcaaaaagaccggtgtagcatatggaaaccagaaggtacttgcccgttacagggtgcttgacacctccacgacaggcaacaagaaaaaactgataaaggtgcagtggcatttttacagggactatctgcacttaaatccattcagggcttcggcaaacctcgtgcagtgggggattgcaggcctgagaaaatttgggaatagcaatgtttaaattatgtgaatttcaggagctcactataacccgtttcaaggagttcggagctcttttaagagaaaatatccacgatgaaaaaagcgtcctgcttccgcggaaagaaatccctgagggagcagagattggtgagcggatccgggtttttatctatttagacagcagggaccggccaatcgcgacaacggccaagccgcttatcactttagaccaggtaaaagttctaaaagtaagcgatgttacgaagatcggtcttttcctcgactggggtctgccgaaggatctgatgctgccgttccacgagattaatggccgcccggaaaagggcgatgatgtcctggtacgcctctacatcgacaagtccggccgtcctgccgccacgatgcgccacctctaccactacctgcgcaccgacagcccttaccagaaagatgacaccgtaagcggccgaatctacgagtttggtcacgacttcggtacattcgtggctgtcgatgatattttttcaggtatgataccgagacatgaagatgtttcttcttataaaataggtgacgtcctcaccctccgtgtcactgaagtaaagcccgacggcaagctcacactgaccacccgaaaagacgcctaccttgagctggatgacgacggagcaaagatcatgtctataatcgattcgtacgccggtgtgctgccgtttaccgagaaggcttccccggaagtcatcaagcgtgagacaggactttcaaaagctgcattcaaacgcgccatcgggcacctctacaaggagcgtaagataacgctcgaaggtggtcggatccgcaaagtgggtcagtagggacggttctttttgtcccatttttgaaattttctgacaaatcaaaccggcgctgacacgtgattatagtttcagcaggtggccacccgggccgccgccagcgcacacgtttacgacgaaaaatcctgaggccgccagcccgtttcaatctgcggcgctgcttcttgatgcagagccacctgtgttatctccggacccaggcggcaattttatgaaaaaaattatttgagtgacacttgacaaacaacaggtagaatgctaaattaaattgcgtacaatttaattacagtttcttgctgtaaaatgactctatgggagattaccatggccaataaaaaatagttatactttgacacatgtatacccgaattacactgcggcaagattttctaaattgtcagataatgggacaaaaagaaccgtccctggtgtcccaggaaaggagaatttttatgtatgatacagtgatcgtcggcagcgggccggctggacttacggctggaatttacgcgaagagagcaggacttgagtgtgttgtgatcgagaacactccgatcggaggcgggcagatcgctacgaccgacagagtcgacaattacccggggcttctcggcgtaaatggcatggatctcgggatgaagttcagggagcatgcagagaagctcggctgcgagtttaaagatggccaggtggtagagatagaggataagggcagtgccaaaatcgtaaagcttcaggatggaagcgggatcgagacgaagaccgtaatcctggcactaggtgctgatcacagacagctcggtgttccgggagaaaatgagcttcgtggaaagggagtttcctactgcgcgacctgcgacggagcatttttcagaggaaaagatgtagcagttgtaggaggcggagacgtagctttagaggatgcagcgttcctttcgaggtttgcctccaaagtatatctgatacacaggagaaatgagttccgcggagccaaggcgttagcagatgaggcagcttcaaaggaaaatgttacatttgtatttgatacaattgtaacaaaggttgacggtgaaaattctgttacaggtgtagagacagagaacaaaaagaccggtgaaaaaggggctattcctgtgaatggagtctttatggcagtcggaacaaaaccgaatgtagagggaattgcgggactgcctgaggccgatgaaaagggctatatcacggccggagaggactgcgtcacaagtattccgggaatttttgtggcaggagaccttcgtacgaagcagctcagacaggtcatcacagctgcagcggatggagcaaatgcagtgacgagcgtccagaaatacctaagtaattgacgataaaaatgaaactatttacgaaaaaatagtttattacgatgatatttcaactggcacaatcggttgcaaataaaaaattactgcccgataattagtggctgatgcgctattttgccccaaaatatggcgatttcgaggattttttacataaatttttgaaaaaacttgacaaaaaacctctaagagtgtatagtaacaatcgtaacaaatttgtaataaattttaagtagaatataacaattagaggaaaaagtttaaatgaatcgtaatcgtagaattcaggcagcagcagcaattaccctttcagcaggtatcatgtttgcaggagcttcaatcaatgcacaggcagctcctttagcaggtgcatccgctactattcttgaggcatcagctgaggatgcagcatcaggtaacgctgcagcacaggttacaggtacaggctcgactctttcaggtgtcagcagagtacttgcagagacagtttcagatacatctgaacagctcgacgcgaaggagcagcaggcagcagatcagcaggcagctaaggaagcaaagtatgataagctcgcagtcgctaaggtttctgatcatgctaatgtcagaaagcatgctaatgctgactcgaagcttgtaggacttatttataacaataacgtaggccaggttcttgatacaaagaatggctggacgaagattaagtcaggggatgttacaggctgggtcaagaacgactacatcacagtaggaagtgagtcagctgtaaagagtgccactgtaaagaaggcttcagtaaagaccactacattaaagatcagagagaaagctgataagaattcagatgttgtggatttgattcctggtggtacatcacttaaggtattaagcaccaaggataaggactgggtcaaggttcagagtggtgatgacactggttatgtagcagctgattatgttacagtgaagagtacttatcattatgctaagacagttgaagctgtaaaggctgataaccagaagaaagagaacgcaaagaaggcagccgcagctaagaaggccgcagccgcacagagaacgactactcagactacaagaactactacaagacatactcagcaggccgcagccgctcagacacagactacagcacctgccaagacacagactacagcacctgccaagacacagagttcagcaccagctaagacatacagtgctccttcaggtggaaatggaagcgcagttgcaagttacgcttgccagttcgttggaaacccatacagatggggcggcacatcacttacaggcggagctgattgctcaggattcgttatgagcgtttacagcaagttcggtgttggccttcctcactcatcaggagcagacagaggcgttggccgtgctgtttctacatcagatatgcagccgggagatatcgtttgcttcccaggtcatgtagctatttacattggtggtggccgtatcgtacacgcagctaactcacgtttaggtatcattacatcaagcttaaactttggttcgatcgtagcagttcgccgtgtactgtaattattagaatttttaaggccgtatccggcaacaccggatgcggcttttttttatgtattttcttgcataagtgcaattattattctaaaataatacaaatgaaagaaagaaaaatcctgaaaaacaaagcgtacctctacctgacggagtttttctccgggatggctctgatggccgtggagatcggggcacagagacttataagcccttatttttcgtcgtcacagatagtgtggacgataattataggaaccattatgatcgcgatggcgcttggaaatgtctacggaggcagatcagctgacaaggacccggacccggacaagctctacagaaggatacttatagccgcgatctggctcgcactgatcccggtcgttggaaaatatgtcatcatcggaatatcagctctccttatttttaaagttagccacggatttttgatcattgcggcatttgtagtctgcatggtcgtctttgtatttccactgtttctcctgggtactgtcactccatcgctcgcgaagtacacgatgggaagcctcgaggacaacggaaaaatagtcggaacgctcggagctgcaaacacgatcggaagcatcatcggcacatttatgccgacgtttgtgacgataccggctgtcgggacgaacatcacgtttttgatattttccgggatacttatagctctttcggtcatatattttataagcataggattttcgcagcataagaaaaaaatcatagcttcctgccttatatttgcactgtgtatagtcttcggacaccagactgatttcgcgttctgggagtcgaaagaaggtgtaaaatacgagggtgagagcatttacaattaccttcgcgtaaaggatgacggccagcaggtcgcgctttcgactaacgtgctcttcggagtgcagtccatttacaacaagaaaaagagcctgacaggcatgtattacgactacgccatggcagcgccactgatgactcgggatgctgctaagaggcaggatgtcctgatacttgggatggggtccggcacttttgcacaccagtgcagggagtacctgccgaacgtgcgctgcgaaggagtagagatcgaccagaagatcacagatctcgcgagaaaatattttgacgagccgaagagcacgaaggtcgtgacatatgacggcagggcgtacctcaatgcgattgataaaaaatacgacgtgataatggtagatgcgtatcaggacattacgatcccgttccagatgtcatcagttgaattctttaaaatggttaagtcccatttaaatgatggcggcgtaatggtcgtaaatatgaacatgcgcggtcagtcgaaaggctctatcaccgactacctgactgatacgataaagactgtttttccggctgtctatacggcagatgtcgagggcaccacgaacagggagctcttcgcgagtactgatacaggcatcagggaaaatctcgagacgaatctttctatttcttcagaaaatgatgatttcaggcagatgatgagtacggtgtcaggtgaccttgtaaagcaggacggtggaaagtacattttaactgatgacaaggcgccggtcgaacttttagggataagggtcatcgaccgactgataaacgaagaagtcgcatattacagggatatttacaataagcggggtatccgcgcagtgatgcaggaacttgggatctgatctctgcgcggtgcggcctgtttttatgtcccttccgcggcattagaaaaaggaggaacaagatgggatacaaggagaaatacaacgagtggcttgaaaagcttccagagggcagcgctcttcgcgatgagctcctatctgtgacagatgaaggcgagatagaggagagattttacaaagacctgtcatttggaacagcaggacttcgcggaaaagtcggagcaggctccaatatgatgaacgtgataactgtcgggaaggccacccagggcatcgcagattttatcgtaagccagggggaggacgcgatgaaggctggggtcgtaatcgcccacgacccgagacatttttcaaaggagttttcagagcttgcggcaggaatctttgcggcaaacggcattaaggtctatacattcccggaccttcgcccgacacctgagcttgcttttatgataagaaaactgcacacagtctcgggtataaatatcacagcttcgcacaaccctaaggagtacaatggctacaaggcctactgggaagacggctgccaggtctcatcagatatcgcagatgcgatgactgactacattaataagaccgatcagtggaacggcgtaaagactgctgattacgacgagatggtaaaagcaggaaagatcacagttttaggaccagaatacgacaggatgtaccttgacaggatcgaggccctcgcgatccacagtggagacgagcttgacctctctatcccgctcgtctacactccgctcaatggctgcggatcgattccgttcaggcagatgcttactgaccgtggatttacaaactggactatagttccagagcagcaggatcctgacccggattttactacggtcggatatccgaatccagaggatccgaaggcgtttaaactgagtgagaaatacggacgagagaagggcgcagagcttcttatggctacagatccggattcggaccgcttcgcgatagagatcagaaattcggacggagattatgtgccgctgaatggaaatcagaccgggtatcttctcgtaaactatattctggaaggccacaagaccgcaggcacgcttccagagaagggagccatggtaaagtcgattgttacctctactctttcgacgaggatggcaaaagcttacggagtggatatgttcgagacccttacaggctttaaaaatatctgtggaaagatcccgtatctccatgaacacggttacacctatctcttcggatacgaggagtctgtagggtacgctgcctgcgaggacataagggacaaggacggcatctcagccggaatgctcgttgcagaggcagcggcctactacaggaagcagggaaaaacgctctgggacgttttaaacgacatctatgcgaagtacggctgctttgccgaggatgagccgaacatcatacttgagggcattgagggctcagagaggatcggacgcatgatgaagtgggtccgtgaaaatgagccggaaaagattgcaggaaataaggtagagaagataatcgactatatcgacggatatgaggacattccgccacagaactgtctcaaatttttcctggcaggagattcctggtttgcgatccgtccgtcgggcaccgagccgaagatcaagttttatttttactcatgccgcaattcactggatgaggcccataaggcaaatgacgcgataaagaacgaggtcattgagacgatcaaaaaagtacagtaactcatagataccataaggaaggtgtattaaatggatgacattatcgttgtaggaatagcaggtggaacaggttctggaaagactacgatcacgcagacgatcagggagcattttggaaatgaagtgtcggtcatttaccacgacaactactacaaggcccatcacgacctctcgtatgaggagagatcgaggctcaactacgaccatccaaacgcctttgacaccgaccttatggtaaaggatttaacgaagcttaaaaacggcgagccaatcgagtgccctgtttacgattacacgatccatgacaggtccaatacaactatgacgatacatccatcgagtatcatcatagtagagggcatacttattttttacgataagaggataagagacctctgcgacatcaagctgttcgtcgatgccgatgcagatgtcaggatcctgcgcaggatcaagcgcgacgtaaaggaacgtggcaggtcacttgattctgtgatcgaccagtatcttacgactgtaaagccgatgcacgaggcctttgttgagccgaccaagaaatttgccgacatcataattcctgagggtggccagaacaaggtcgccatggaaatggtaataaacaggctgcaggcacatctgaacagataaagcgcctgctgtaagttcatttttttgaggtattgatagaaaaatggcactagaaaccactgaccttttcaaacagactctttcgagggcgaagggccttcaccatatgacggatgaagaggtaaaaaaggtccagaaagtcgtttactcgatcacaaaggatgtagcagagatatgtgaggaaaatgacattccatatatgttatccgggggcaccgcgctcggagctgtaaggcatgggggatttataccctgggatgacgacatagatctcaatatttaccggaaggacatagacaggctggccgatctgatcgaagaaaaatatccggacaaatactatgtagtagtgccgcttcggacgccgggctactacagttcatttgtgcaggtgcagcttaaaggtacgactttcagggagtatctctggcaggaagacggaaagtgcggcatcaagatagacctctggattttggaaaatgactacgacaatccgataaagcgccgcttccagggcctgctctgcgacggagggtcgtttatcctgtcatgtatcaggatgcacagggagaaaaaggaagtcctttcccttgccgagggcaacaaaaaaggccagcggcttataaagataaaatcagctatcggagcgcttccgtcgctttcacggtggtggtggtacaggcgcgtccagcactggttttcaatgtgccatgacgaacattcgaaatacatttcgattccgggcggacgcaagcattttttcggagagatgtatgagagggcaaaattttcggatacggtgaagatgaagtttgaggactcgtatttccctgtaactaaagactatgaccactattttcatgtgctctatccgggagattacatgcagcttccgccgcctgagaagcgggaggaacatgtactctatgaactcaaattcaaagatgactgaccgggaaaacagtccttttcagaaaaaactggaaaaaatttgacaaatcatttataataacttgtaaattttggtaaaatccagattaaatatatattaaaaatcagacaggagttattttttcatggaagaacacagtggtattatagtagatgacctgtattttgcaagggtgctgcttcatgtaagggggcatatcaccgaggatgtcggggaactttcgaaggcaagcatttacatcaaggattcattccagggaaagcttgtgccttcgcacctcgatttcgacagaaaaaacaggactttccacatagtttatcatgtgctcgccgcaaatgcggattacccgatagagacaggagactattatctcagattaaaaaaccatggaaaaaggtattactcctacctgacagagagcctcagagagaccgagaaggacggaaagcttaagtacattccgaccgaggaggagttcaggacaggtgactacgatccggcaccgtatgaatttgagctcacgaagaatacggcaaagcacggcactgagacctttaatatgtactctatgatggatctcgatgaggatacgctctatttccgtgtgatctatatacctctgcttgaagatatgggaattctctacaacacaaagcagagatttatcgagtggaaaacgaatatgagaaaggccttcaatcctttcaaagagagtatcctgattaaatattttaacagatgccagaaaaagagaaagcagctgagagaagcaggtgcgaagcctacgatcctctttgcctcgggctcccgtgcgacgataagcggaaacgagggctttatctacgacaggatgaaggagagagatctcctgaaaaactacaatgtcctgttcaatttcaaggaaaatatcaatctccgctatggtgccttaggctcgtttaaatttacaaagcagctcgcaatgagcgatattatcctgatcgatgacttccttcctttcgtttacaaattcgactatccgaaggatgtgaagttcgttcaggtatggcacgcctgcggcgcattcaagactgtaggacttgagcgtgagggaaagccgggagcaccaaagacgaataccagagtccacaagtgctacacacatatgccggtaagctcggagcactcgggcagacacaatgccgaggctttcggtcttccagagaaggttttcctcccgataggtgtaccgaggacggatatatttttcgacgaagaatataagaaaaatatggtcgataagctcaggaatgagttccctatcataaaacagcgcaataaggtctatctctatgcaccgactttccgcggcaggaacgcacacgatgcccgcttccctatggagaggattgactggaaaaaatggggagcatttttaaaggagagaaatgagcttctgatcgtaaaaatgcatccattcgttaccagagaaatccctattccggaggagtacaaggaatacatcctcgacttttcgaagtacagagaggtaaacgatatcctctttatcgctgatgtcatgataaccgactactcgtcggtaatgtatgagtattcgcttctcagaagaccgatgtatttcttcgctttcgaccagagaatgtatgagaacagcagagatttctatgagccttacgagcagaccgtcccttcgacctctgttatctataagactttccccgcacttttacacgctctcgagaatactgacgattacgactacgatgctctcgacaggttcgtaaagaagaacttcaaatacacagacgggaagtccacagacagatttatcgatcaggtcattttaaaataaaaagccgttgacagattgctgaaaaagtagtaaagtattaaggctgatgtaatcaaaaggagtcccattagccccgggatgacttttcatcaatattagtttttcagctgcgtccggacatgcgcagaggagaagcgacatatttttttggaggatatactaatgaacaccacttatatgccaaacccgtctaaggttgagcgcaaatggtatgttgtcgatgccgatggccagacacttggacgtcttgcatcaaatgtagccaatgttttacgcggtaagaacaagccgatcttcactcctcacgaggattgcggagactacgttatcgttgtaaacgctgagaagatcaaggttacaggtaagaagcttgacgctaagcattattatcatcattcagatttcgtaggcggactcagtgatacaactctccgtgagatgattgccaagcatcctgatcgtgttattgaaaatgcagttaagggaatgcttccgaagggcgctcttggaaatcagatgtacaagaagcttttcgtttacgcaggaccggatcacaagcatgcagcccagaagcctgagcagcttacattctaatcggaggatattatggcaacagctaaatattacggaacaggaagaagaaagtcttctgtagccagagtttaccttgtacctggcactggaaagatcactataaataaagaggacatcgataagtatttcggacttgagacacttaaggttatcgttcgtcagcctctcgagcttacaggcactcttgataagttcgacgttttagtaaatgtcaagggcggcggctacacaggtcaggctggagctatccgtcacggcatctcacgtgctcttcttacggttgatgaagagtatcgtccagctttaaagaaggctggattcctttcacgtgacccacgtatgaaggaaagaaagaagtacggcttaaagaaagcccgccgtgctccacagttctcaaagagataattttccagaatatctggaatccttttggaagtctcggaaaccattggtttccggggcttttttcttatacaaaaaatagtgaatttcttttctgattatgatatagttttgatagtacttagctgagtacatatagaggctcatttggcatttttagaaaggcgaagacgatggagcgggtcagaaaattttttaagcgcacagcttatgcagcacttgctgctgcactgatgtttatcgcattatttgtgtacctggagagcagtaaaacgacagcagaagcagaagaagaaccatctgcttatgctttaaaaatagcgtatgtgactgatgccaacggctgcatgcatgtttttaacacggatcagacaaaaccatctgctgatggaagtatcaaaagtatccacaataatacctataaaccgaaagataacagtaaaacatatgcatatatcacatcacgtggcgatttgagcaactgtgatttcagcagtattggacatggcaaatatactgaagattctaatcctgataagaacggctattttgaagtgaagtcagttgatattgaggctgacacaacggctgtcagcgacatggaccgggcttttgggtggttacagaatgtaaaaaagatcaataccgaaaatctaaatactgataatgtgaccaatatggaggatatgttttacagatgcatgagtcttgtctctcttgatttaagtaatttcaggacaagtaaggtaactgaaatgggaggaatgttcggattctgcaaaaatcttacttcgctgaatgttttcaatttcgatacaagtcaggtaagaaacatgagttgtatgtttgaatattgtgaaaaacttacgtctcttaacctggatagtttttatacagctgtgctgcaactccctcacttctcttgatttgagcagctttgataccggaaatgtgacagatatgagtaagatgtttttgaaatgtgaaggacttaaacagcttgatttaagtggatttaatacaagcagggtgaccgatatggaaaaaatgttctattactgcagtgccttcacttctcttgatttgagcagcttcaatactgaaaatgtgacagaaatgggcagcatgtttgaaggctgtacagaactcactacacttgatgtaagccattttaatacaagcaaagtaacagatatgcaatctatatttaaagattgctggtcgcttgcacaggtggctctctcagaaaacgggtacgcaaagtttgctgctgagcttccaacaccgacaataacaattaatggtaaagagtcagatggaaaatggggtcttgatggagaaacagtatcaaaagaatacgcagcgaaagacattccgtctgccggtaagtggtatgcacagacagtagagagaccggctcagccgacaaaaccgacacagccgacagaaccgacaaaaccaacgcagccgacacagccagcaaaaccaacgcagccgacaaaaccgacgcagccgacacagccagcaaaaccaacgcagccgacacagccaactaaaccaaaaaatccagcacagcctgcaaagccgactgcgaagaagactactccaaccagaaaatcagaaaagacaattactggaaagcttgtcaaaaaaggaaagaagaccatgatcgttgacaagaagaccaggaaggctataaagaacaaaatcgtaaaagtcggtaagaagtattactacgctgacaagaatggccgggtagtcaacaaaatcaaggtcgtaaaggtcgggaagactacttatattacaaagaagaatggccagatttatactaacacgaccattaaggtgggaaagacaaaatacaggatttctaagaacggtaaggccacaaaaattactaagccgacaaaagttaaaaaaataaagaaggccgcaaagaaatctaaaaaggtcaataattcgaaaaatcagccagtaaatcgaaaaagacgtctaagaaacctaagaagtcaaaatcgaggaatgctaaaaagccgaagaaatcaacaaagaagacagacaaaaaaactaaaaaatcaaaaaagataaaaaagtcaaaaaagacggtcaaggcggctaaaaagtgaagaaaactactaagctattctttcaaaaaatacccgagtccgcgctttgtcttcagtgtgactttcgagcctgctgctttcagcttgttcctgacatacgaaatgtacacgaatacgactctgtcgtcggtatcggaatcgaggccccagatcttttccatgaaggtgtcctgattgatgaaggtgtcgtggtttaacatcagcatctcgagcatctggaattcctttgatgagagttcctcagaacctttaggaccgttcagaacgctcttcttgcggtctaaggtgatgtcaccgaaggagaggtcgacttccttcgtctcggctgtgcggcgtgtgatgctgcggaggcgggcgagaagctccttcatagcaaatggcttcggcagatagtcgtcggcgcctgcgtcgagcccttcaactctgtcgtcaatctctgactttgcggtcagaagcaggacggggagagtggagccttcggcgcggatttttttaaggacttcaaggccgctcatgcctggcatcatgatgtctaagatcgcggcgtcgtaagatgcgccggtcagatagtcgtaggcgtcgtctccattgttcacgatatcgaccgaatagttgtttttcttcaggacagcagcgaccggttcggtaagctcctcctcgtcatctgctaaaagtattcgcatagcgtaatccttctcaaaaattttatcaaagtgtcagccttatttcgaagctcttcccatcctttgaaaatgcgtgcgcctcgcccttgtggaatctgacgatctcggcaacgactgcgagtccgattccacttccaccggtctttcggatgcgggacttgtcaaaacgcgcgaagcggtcgaaaagattatcgagagagcctggtgttatcgcctcacaagggtttgaaactgtaagcgtgtaaccgtgacgctttaatttcgtggctttatacggctttcctttaaggcacacagacacatcgccagtggcgtatttcattgcgttgtcaaaaatcatagagaggcagcgggccatattttcgcggcttccatagtatggaagaaagtcgggtacatctaaggagatgtgcttcccctggtattcacctgcggtattttttacaagctcagcgaggtcgaagcctgaaagctctgtcctcccgccagcctcgtccattctggcaagaagcactaatttttcagtgagagaagtaaggcgggtgatctgattctttatgtttgtgagccatttgctcccgccgttttccatctcgatgacttcggcattcgacgagatgatagcgagtggagtcttgatctcgtggctcgcatcggtaataaacatcttctgcttctgaaaagcagcttcggccggtgccatcgcaagctttgtcaaaaatttcatcaggataaaaatggcaaaaaccccgataactcctacgagcatcgatgccctgagaaaatttctgacggaggccgcgtctctttctacatttaaaaaaatgatcagatagtggcttgaatcagtctgtgtcagcctgtagcggtaagctcccatgcctccggtacttttcccgctggatacagcttctgatatcatattctcggcctcggatgtgctgatgcttgcgatatcggtcatattggtcgagatgatctgcttcctgctgtcgagctgcgcggagaaatatctggtgtcatacaaagcttcactcatctgatttccggaaggtccgtcaggcatgctgccgccgtttgaactgccctgtttgtcagaactgcttccggagttatcagaaccggcaccgccgctggcaggattctttccagcatcagaagatgatgcagcgggctttggcgggggagttgtcccgtccctcatatcttcgagattgccgcccgacgcctggatcatatcgatcctgctgtcgcagtcctgtatgtaactgcggtaattcagggcgtttatcgccacgattatcagaagcattacaatgattactgaagtcattgccacgcggatgaattttttcctcaatgatcttaacatgaaaaaagtatagcataatatgattgacaaatctatattgaggtagtataatcaagagcataaaagaacattagttcgaattacggtgcagctatcattatatttttattaaatccgaaagttttttaaaaaggactttcattttactcccggatgtattattatattagagcaacactatatgtagtattttttattgagaaacacctctagagatagttgttttaagattccaccagcttgaaggggatacagggccgggcggctggtacagatttgattttaaggaaagaaggtttttaggtgaacagtatcgttgtgaagacaaatgtgatcaagaggaacggcgccgaggtgacattcgacgagacgaagatcactaatgccatcgcgaaggcgaataaggaggtagacgccatccatcagctgaaccaggcacaggttcaggctgttgcagacagtattgctaagcaggtggcccagcttcctcatgcggtgaatgtcgaggacatacaggatatggtagagaagggcatcatggagatgcgcggttacgaagtcgctcagaagtatgtccgttaccgctataccagagagcttgccaggaagtcgaatacgacggatgacaagatcctttcgctgatcgatcaggacaacgaagaggtaaaggaagagaactcgaacaagaatccagcgatcaactctacacagcgtgactatattgccggagaggtttcgagggaccttacgaaccgtgtcctccttcctgaggatgtcgtcagagctcaccgtgagggcatcattcacttccacgattcagactattttgcccagagagagcataactgcgaccttattaacttagacgatatgctacagaacggcacagttatctctgagactatgatcgagaagccgaagagcttctatacagcgtgcaacatcacgacacagatcgtagctcaggtagcttcgaaccagtacggcggacagtcattttccctcgcacacctggctccgttcgtagatgtatcacgtcagaagcttaagaagcaagttattgaggagagaaaggctgtaggcgatgacctggacgaagagaaggtcatgaagatcgtagaccaccgtctccagctcgagatcgagtcaggtatccagaccatccagtaccagctcgttactctgatgactacgaatggccagactcctttcgttactatgtttatatacctcgatgaggcacctgagggacagaccagggatgaccttgcccgtcttgcgaaggaagtcttcagacagcgtatccagggcactaagaacgagaagggtgtctgggttacaccggcgttcccgaagatcatctatgtcctcgatgaggacaatatcagcgagggcagcaagtactttgatctgacgaagcttgctgccgtatgcactgccaagcgtatggttccggactttatttcagctaaggtcatgagggaagtcaagggcgatgtttacccctgcatgggatgtcgttcattccttactcctgataatgagaagcagcgtgagggcctctgcaacgacgataacaaagccggcgccaagaactttaagaagggcgagcacaagtactatggccgcttcaatcagggcgtagtcactataaacctcgttgatgtagcctgctctgctgtcaaggagtctgaagaggaaggtactgacagattcgatgagttctggaggatatttgatgagagacttgagctctgccacaaggctcttcagtgcagacacaaccgtctgatgggaacttcatcagatgtagctcctatcctctggcagcatggagctcttgcccgtctgaagaagggtgagaagatcgacaagctccttttcggaaactattccactatatcactggggtatgccggcctctatgagatgacttatgagatgacaggcgttagccacacttcacctaagggtaagaagttcgcactctctgtcatgcagcacttgaatgacaagtgcagcgagtggagagctgccgagaacatcagctactcactctatggaacaccgatggagtccacgacttacaagttcgctaagagcctccagagaagatttggcatcattcctcatgttacggataagaactatatcacgaacagctaccatgttcatgttacagaggagatagatgctttctcgaagctgaagtttgagtcggagttccagaacctctcaccaggcggagccgtatcatatgttgaggttccgaacctccagaataatattccggcagtgctcgccattatgaggcacatatatgagaacatcatgtatgccgagctgaatacgaagagcgattactgcgaagtatgtggatatgatggtgagatacgtattgtagaggatgagaaccacaagctcgtctgggagtgccctaagtgcggtaacagagaccagacgaagatgtctgtagcccgccgtacctgcggatacatcggtacgcagttctggaatcagggccgtacacaggagatcaaggacagagtgctgcacctgtcgattcctgagtttgaaggcgaaaatatgaacgttaacgcagaatccaagtaagctcctttaagtgaggtttttagtgagcttttatggcagcaggcttatttggcctgccgccagagttttttcttatgaattacggacagatttattacacagatatagcaaatggcccgggctgcaggaccagtctttttgtcagtggctgtactcaccactgtaaagactgttttaatcaggagacctgggattttttatatggtcatgagtatacgaaagacgtcgaggacaagatcataaagtctcttgtgcctgaatatatagaaggcatcacgcttctgggtggtgagccaatggaagttaagaatcagcggactcttgtatcgctctgcagacgcatcaggagagaagttgtgcatgccacgatctggatatattcgggttacacctgggaggaacttactgacagggagaataaacgctgccactgtgaagtgacagatgagatactttcacttacagatgtcttggtggatggagagttcaaggaagaacttaaagacatatcgcttcacttccgtggctcttcgaaccagcgcattatagatgttccggccacactgaaagccgggaagatcgtgctttcagatcagatgtagggaaggactactggccgctgcagactgcagcggccaatttttatatctggattgcacaaagctattctgcagggcaatggacatccgcaggcgataatgctatcatatgctttagttttgtataccaaattattttcatgttaacgcagagatctgggattttattatgtcgaagatttattttttacgtcatggccagacggatatgaatataattcatatgcttcagggccgaagcgacacgagcttgaacgacagagggaggcagcaggccagagaggctggccgggtttttaaggagaagggcataacgccggatattattttttcatctcctcttacaagggtaaggcagactgtagacgaggcgcttggagcgcaggaccttgaggccctcgatatgacatacggtgaggctctggcctatcaggggaggaaaatcccgagagtcacagacaagcgccttatcgagatgagcttcggcgaagtcgagggcataccgattgacaagctgcctcgcggctttgagaaggtgttttttgagactccgtcgaagtataagccggtcccgggagcggagtcctatgacgagctgctttcccgcggcagagagtttattgagtttttgaggaaagagacacgtgagggagctccgatggcggataagaccgtagtctgcgctactcacggcggccttctgcatggtattttaaatcttctctggcacagggagatagatgatttctggaagtcgcatgtcttaaactgtgccatcattgaggccaggcttggggactcaaaggaagaagacgatgcgctcttcgtatcagacggctacactggagaagagtgatagtttcggtgaaccggctgataactgaatgaatacgctaattcggtacaatagtttcctaaaatttgacaaacaatgacatttgattgttttttttacaggacagttatgataaaatagatttagttgaacccgagaggcacttaaggaagggagggactgtgtatgtcatctgacagcggcaggaagtgcgtacttattatcgatgattctgagctgaacagaaagcagctgaaggatatcttaaaggatgaggtcgatgtcatcgaagcgaagaatggcgatgaaggtatgaacgttatccgggagaagttccatcagctcgatattgttctcctggatcttataatgccgggcaagctggatggctttggtgttttaagtgagatgaagagggagcatatgacagattatcttcctgtcattatgatctctacgaacaatgacccgaagaacatcgagaaagcttatgatctgggcgttctggatttcatatcgagaccgtacatcgagcgtattgtgcggcgcagagtccttacgactataaagctgttcaagaagcagagagatattgcaaacaggatcgacaggaattacaaggctgacgatgaggtccgtgattcgaggacaggccttctgtacaagacgaacttttttaatcaggctgacacgcagcttcggaacttgaatctcggaaatctttggatggtggccgtggatatcgaccacttcaagctcttcaacagctactatcagtgggagacaggagacgcctacataaagaagattggacagacactcttagagtcggcccagaggcacggcggtgtagcaggatatctgggcggagacgacttcgcgattctctgtcctgccagaatggatatagtcgagagcttatccaataatctgaaccgttacctgacagataacagtttcgagccgtcatttcgggtgaatttcggcatctatcctatagtcgcatctatgaagcagtcggccaatgacctctacgatctggcggctatcgctcttgagacgatcaagggagactacactgtaaatatcagtgtctacgacccgaccatgatccagaaggagcaggacgaatacaagcgtcttctgaacattcaggaaggtatcaagaatggcgagtttacgatctatctgcagcctaaggtgaatatctcgacaggaaagattatcggagcagaggctcttgcgagatggaatcacgatggacaggtactaggcccgaaccttttcgtacctgtcatggagaagaacggacttatctccactctcgacaagatcatctgggaccgtgcagcccgcttcataaaaaagcagatcgagaagcaggtacagcctattccgatttcggtgaatatttcagaggccgatatctatactatggatgtaccggaacttttcagtgagataatcagggcttacgatataccggcagggcttctggaagctgagatctcggaagcgacattcgcgaatgcgcctgcgaaggcggcagacactgtaaacaggctgcatgagataggaatgagcgtgtcgtacgatgactttggcacaggacttgcatcgatcaatacgatagagagcctgaacatagatatgttaaaggtcgatacctcttttttaaggctttcggcagatgcgcctgagcacagcaggaatatattagagccggtgcttggcatggcacagcagttccagctcccggtgatcatcgagggagtagagacagcggagcagatggaatttttagagcagatgggatgcgattacgcccagggctattatttccacaagccgatgccggcagagaagtttacgaagcttatcagcaatccgcagaagcttgaccttacaggcattcaggtcagcgtacctcagtcgtacaaggtgagacagatcttagactcgagctatatttccgatgaggtcattgcgaatatcttcggctcacttctgatcctgaacagagatggagagacagtaagagtcggctggtcgctgcaggatatcgatggagactcggaactctctgatctagtggatgcttcatccgaagtgcctctctcagatatggtaaaagacactgacagagaagccttcctgagactttttgacgaggctttaaagaacaggaagaagggcgccaagggctcgttcatatttgttttcggaggcagacagcatctgataagactccgcatcttctatatgagaaacaacatcaacgagcagatctactatgctatgtgcgacgagatagaggacgaagaaaaataaaatcattgtaaaatacccataagagtgttaatatatttcaggaattcaaaggctgtgaatgcaatttatttcacagccttttttaaaaaattcatatatagcttttgactataaaactacagatcaagaaggtaaatagaacgtgtctgatgtaaaagagatgactgaggagataagtcgtctgaagaaagagaagaacgccataatcatggcgcattactacgtggctgatgagatccaggatattgctgattttgtcggtgactcattttttctggcaaagaaggctaccgagacagatgccgatatcatagtactgtgcggcgtcaggtttatgggcgagagtgcgaagatcttaaatcctacgaagaaggtgctgatacctgagatcgcagcagactgcccgatggctcatatggcaacgacagacggtatcgcagagataagagacgagtacgacgatcttgcggtagtatgctatgtgaactccactgcagaccttaaggctgcaagtgatgtctgcgttacgagtgcgaatgcgcttaagatcgtaaagaacctccctcagaagaatatctacttcatccctgatcagaatctggcacattttattgccgaccagctccctgaaaagcattttatttttaacaatggtttctgccacgttcacaattcgataagcctcgattcactcaagaagaccagggccttaaagccagatgccccggtacttgttcacccggagtgtaaacctgaggtagtagcagaggcggattttgtaggatccacttcaggaattatcaaatatgctacagagtccgatcagaaggagtttatcgttgcgactgaactcggagttatgcatgagctgaagaagagaaatcctgacaagacattttacccggcaggacctatgcagatctgcccgaatatgaagaagctcactctggagaagcttctccatgttttaaaatatgaggattcggagatcactctgccagagaatctgatgaaggatgcgaaagctcctatggaagagatgttgaggcttgccaaatgaagaagagttatgacgttattatagtaggagctggtgttgcaggttgctttgcagcgcttcatctgcctcccgacagacagatacttatgatcacgaaggaggatatcaccgagtgtgattcctacctggcacagggagggatctgtgtgctcaaggatccttcggattacgatgcattttttgaagatacgatgagagcagggcactacgagaaccgaagggagtccgtagactgcatgatacgctcttcgaagggtgtgatagaggagctgatgggatacggcgtggatttcgcgagaaacccggacggtactcttgagtttacaagagagggggcccactcgacgaaccgtatcctgcaccacgaggatatcaccggaagagagatcactactcatcttcaggctgcgataaagagactcccgaatgtcgagatacatgagcataccaggatggtcgatattctctcagagaaaaaccgctgtgatggtattgtgctgatagatgaagacggaaaattaaggacagtttttgcatcgcatgttatgctcgctaccggaggaatcggtggtatctacgagaactcgacgaactatccatctcttacaggagattcgcttgctatctgcttgaagcgcggtatcgagctcgagcatgtaaattacgtccagattcacccgactacattttacagtgagaaaaaggagcgcaggttcttagtttctgaatctgtcagaggagagggcgcagtcctccgtgacaagaacggagatcgtttcacagatgagctccagccgagggatgtggtgagtgcggcaatccttaaacagatgtcaaaggaccatacgaagtacgtcaacctcgatatgactacgataacgaaatttgatatagcaaagcgtttcccgcacattgtagagcattgcttagagaacggcatcgacccgaagaaggactttgtccctgtagttccggcacagcactatttcatgggaggaattcatgtcgatctgaattcacacacttcgatggatcacctctatgcatcgggcgagacctgctgcaacggagttcacggaaagaacaggctggccagcaactcgcttctcgaaagtcttgtatttgcaaagaatgcggcagagcacatgcagatgatcgacggccagagagcctgggagggaaggaagccgaggtacttaaagcatatagatgaatcgccggctgaacttgccaggacatacagcttcgatccggaccagctccttgacacaaaggattcagacgaagagaacaagcagctgatctgggatgaaatcgacagggaaaataatttagctaattgacaggttaaaaaaatgacagatatcacacttaaattaaacgcagacccatatttactttcagctctacgggaggatgtcacatcagaggacgtgacaacggatgcgataatgcctgagaacaggatgggacaggttgaccttatcgcaaaagaggacggggtcctctgcggaatagatattttcgagcgtgtatttacactgctcgatgcaaataccagattttcactttttgcaaaggaaggcggagagatccacaagggtgaaaagattgccgaagttacgggcgacataaagactctgcttgttggtgaaagaacagctctgaactatcttcagaggatgagcggtatcgccactatgactcgccagatggtaaagcttctcgacggatcgaagacgaagcttctcgataccagaaagacgactccgaatatgcgtctcttcgagaagtatgctgtaaaggtcggtggcgctacgaaccacagatacaaccttactgacggcgttcttattaaggacaaccacatcggggcagcaggctctatcaccaaggcggtgcagctggctaaggattatgctccttttgttagaaaaatagaggttgagaccgagactatcgatcaggtgaaggaggcactcgaggccggtgctgacatcataatgcttgacaatatgtcacacgatacgatgaaagaggccattgctctgataggggacaaggctgaaacggagatttctggaaatgtcactgaggataatgtcgagcagataaaggacttaggcgctgactatgtatccagcggtgcgctgactcactcggcaccgatacttgacctgtcacttaagaacctccatccgatagactgatatatgagtacgagcatttttgtaatggcccacaagccttacaccagaccaatccggttatctgagatttatcggctttggcaggcagtcggcggaaatcatcctggcaggagatccatcagcgcagtttgggaaaaatccgctggacagaaagaaaattgaagaatttttcgggtaaatagaaacagctgccactacgaacggcgatcgaacagaaaaacgtgacacagcgagccgttgcagtggcagctgtttctgcgtaagtcaaaaaaatacctccagtctgttttcagactggaggatttttattggtttagacaggaactatagagttcacgctgagactataagctgttttttattggtttatactgcctgtgatgaggttttctcttccttctcaggctctttctctacgcggtctggatgctcttcggcccagagtctctttgcaactggtgcccaggcatcagcataaggcttggtcttcttgtacagatcctctggatcctctggagactcaggatctgtaggaacggcttttccttcctttacgagctgaccgaggatctcaggattctcaagcatcgggcaaggctgaagcatgttcttgttgaacggctgctgctgtctgtacagctggaagatcggctgcttaaagcagtcgagcaggctgtctttacggatgttagcgctggagtagtggatgaatacgcacggatcgacgtcacctctggcgttgatgtggcagtactcacgtcctccggctacgcagcccccgacgaactcaccgtcgttctggaagtcgagagcgaagataggcttgccgcccttaaatccacggatctcacgaactctgtggaacatatactcacgctgctctggtgtagggcagagctccggagctcccgcagcgccagtcggcatatagtggaagtaccagatgtaacgggcacccttctccacaaggagatcgaggaactcatcacaggtaacgttcttgtagtttacgcttgtgtagcagatcgagcatccgaagaagagcttgttcttcttcagaagatccatggcgtgcattactttatcaaatacacccttgccgcgacggccatcattggcctcttcgaatccctcaacagagagagcgaagctcatatttccaacttcacgaaccttctcacagaattcctgatcgataagagttccgtttgtaaacggctggaaatatgatgtctgatgcttggcagcaagctttataaggtcatcctttctgactaacggttcaccgcctgtgaaaagccagttgtggattcccatctcttcaccttcagtgataagcttgtcgagctcttcataggtgagatttaatttattgccatactcggcagcccagcatcctgtgcagtgaaggttacatgccgaggtcggatctacaagaatcgaccatgggatgttgcaaccctctttatcgcctaatgctcttgtatccttataacctctgaatgctgcttcgtatccaaggtttaaagctgccatctttataagtctcggatcaacttcatcgaagatcttattcgtgaactgcatccacttgctgttttcgtcttcaaattgagctctaagtgcatcatatgccttatcaggccaggtgtttttaagcaccttctgaaccaggtcaaccatctggcacatggccttgcctctacctttgtttacatgctttaacgcagcagtgatagcaacgtcaaaagcagcacgctctgccttatgctttaagtcagccatttgtaaaaacctcctgcaatacatattttattaacgattatcattttataggcatgagccaaaaaattcaaggcgcttgaacaaatgattaacacattcaaaaaattgtagcgatttcaaagatgacaaaatcgcaattctgtcttagagggcttctgctctacttgtagaaagcccgattttgatgtaaagtataaaggacgtttattgggccatacttaaaaatacgaggtgaaataaatgaagaccggacttatagtagagggcggtggaatgaaatgcgcgtactcagcaggagtactcgacgtattcatggaaaacgatatcaattttgactatgtaagcggtgtatcagccggaagtgcctgtgcggcctcttatctggcaggacagcgcgagagaaatcgcaggttctattcgattcactcaatgtcaaaaaagtacgcaggtgttgaaaaccttctaaagaccggaagctttttcgggctcgactatatctattcgacgctcacagacagcgacggcgcagatccgctggattttccggcacttatggccaatccggctgagttcgaagtcgtggctaccgacgcgctgacaggacacgccgtatattttaacaaaaatgatatgagccaggaccactatgaggctattaaggcaagctgcgccctgccggtcatgagcaatcctcaggtcgtaaacggcagggaatatttcgatggaggagtcagtgactcgatccctatccagagggcatacgagagaggtgtaaggaaggctgtgatcattttttcaaagccggaaggttatctgatggagccacagccccacagattcatctacacctttgcgcttcacaaatatccggcagtgatctacaggttaaaccacaggcacgagttctacaacaggcagattacgaaggccagaaaactgcgtgatgccggcagagtactcactttttcaccgtcgtcggatataaaggtcgacacctacaaggtcgaccaggatgtaatggaagcgctttatcagaatggaagacaggacgcagaggcgagagtatcggagcttaagaattttcttggattgaattaggagatttaatttgtcgatcaaatggaaaaatttctggctggcatttctgccgccgatactgatcctcgctgtccagaatattatggcgctggcgggttccgggattgttttcgggattaaggccgtatcctttcatggaaagaatttaacagaactctataaaagctacacctcgactatcacaagtcccgctttttcatccgttgtgctgctgatctatgcagtcatagctattgccatttttgcgccgtggtggtctaagaagagagttgcattcgattcgcgccggatgtcatttcgcggattcaagccgctcctcttaatatttggcataatactttttgtagtcggagctcaggtcgcgtcgaattacctggtgaactgtctcagtgcgctgttcccgaaagagctgataaagtactcgaagattatgaaaaatgccggactcgacagagcgggggctacaccggtcataataatctatgccggattcgtcgggcctgttgcggaggaatttgcgttcaggggactctccctcggatattttaagaaatccctgccttcatttgcggcggcaaatatcctgcaggctctgctctttgcagttatacatttgaattttattcagggtgtctatgcatttataatagggcttctgctcggctatgtggcatacaggaccgggagcctgctgctttctatggtgcttcacatctgctttaactcgacttcgtttatactgcagattctgacgccgaaggccatgaacggcggtgcattcctggcatttgcgatacttgttctgtctatgatggcagtgtacgcaggcatttttatgctgataggttcacagcctatggcaaaggagaagtgatgtcatttgttcatctgcacactcatacgcagtattcgatactggatgcgtcgaataagatagacaattacatacagagacttaaggatctggggatgaccgcaggagcgatcaccgatcacggcaatatgtacggagccatcgaattttaccagaaggcaatgaaggcaggcataaagcctatcattggctgtgagatgtatgttgcgaccggcagccgtctggataagtcttcacagaaaggtgatacgagatactatcaccttgttttattatgcgaaaatatgacgggctataagaatctgataaagctcgtctctattggaaatacagaagggttctattttaagccgaggatcgaccacgagtgcctggaaaagtaccacgagggccttatctgcctgtcagcctgcatagccggtgaagtggctcaggctgcacagatctcgtatgaaaaggcaaaggaagtcgcactctggcacgataaagtcttcgggcgtgggaactattttcttgagatgcaggaccacagggacggaagccttctgcagagggttacaaaccagacagtcataaagattcataaggagacaaaaattccattagtcattacgaatgactgccactatacgctcccggaggacgctgcctcccacgatattctgctctgcatgcaggaaaacaagctggtaaccgacgaggacaggatcaggtacgaaggcggccagtactatgtaaagagcgaagacgagatcagggagcttttcccgggctttgaagacgcaatagagaacactgcaaaaatagccgaccgctgcgatgtccgcttcgaattcaatgtctacaagaaaccatcctattcactgccaaagggtcatgaaaatgagactgctcttgaatttttgactggccttataaaaaaaggcttcagggaaaaatttgaggacaatcctgaatacagcgacgaacaggttgaagagattcgcaaagatacaaagcacgagctcgatgtcataaaagagaagggcttcgtcgagtacatcctaatcgtctgggactatatcaactgggcaaatacacacggctgcaagaccggaccaggaagaggctccgcggccggaagccgcgtctgctactgcatcgggattacgacagttgatcctgtaaagtacaatcttctctttgagcgtttcttaaacccggagcgtgtctcgatgcccgatatcgatgtcgatttcgaggataaggagagaagccgcgtcataaatgactacatctttaaaaaatacggcgaagaccacgtaagtcttatcactaccttccagaacatgaaggccaaggctgtaataaaggatgtcggacgtgccatgggaatcccgtattccgtgacgaacagagtttcgaagatgatcccgaacgagcttaatattactcttaccgaggcgcttcaaaaaagcccggaccttaaagctgcctcggaggagtccgatgagagcagacggtggtttgagactgcgatagagctcgagggcattccaaagtcgacaggtgtacacgctgccggagtcgtaatctatccggcgagagcggacgagtgcatgccgcagggccgatcgaaggacggaacgcctgcctgcgagtacaatatgatccagctcgagcagctcggatatctgaaaatggatttccttggactgcgtacacttaccgttataaaggatgcagtaaaaaatatccatgcttcgaagggaatcgatgtggatatcgaccatatcgacttagacgacgagaaggtcctctcatttattggaaccgggaagacggacggagtcttccagctcgagtcgtcgggaatgcagtcattcatgaaggaattaaaaccttcgcattttgaagatatcatcgccgggatttcactgtaccgcccgggtcctatggatttcataccggactacatcaagggaaaaaaggatccgtcggctgttgtatataagtgcagggcgctcgagccaattttaaaagatacatacggatgcatcgtctaccaggagcaggtcatgcagatcgtgcagaagctcgccggatactcgatgggccaggcagatatcgtgcgccgcgcgatgtcgaaaaagcaccaggacgagatagatgccggccgccacacatttgtctacggaaacgatattccgaagggagagaagggctacgttccgggctgcatcaaaaatcacatctgcgggacggatgaggagtccgaacgtgtcgctgacgagatctacgattcgatgatcgacttcgcgaagtacgcgttcaacaaatcacacgccgcctgctacgcagttctcagcatgcagaccgcatggcttaaatactactatccggcagagtacatggcagcgcttctcacatctgtcgaggacaactcgaataagatgatcgactatctgagcgctgcaagggagatgggacttaaagtcctgcctccggatgtaaataccggagtaggtgacttttctgtcgaagatggcgcgataaggttcggcttaaatgcgataaaggggatcggacctgctctcgtgtcggagattttaggggagagaaacaggggcgggaagttcgtctcctatgacgatttcctgacccgctgcctgccagccggcctcaagaaaaatcacatagaaaacctcgtaaaatccggcgcctgcgactgcttcggctatcacaggagagagatgtacgccgggataaattcgatggtagacgatattttaaaggagcagaaggagtcagtttccggacagatgtcgtttatggaccttctgggcggcgacgagcggaagaggttcgagcacagggtaccgacaagcccggagttcgaccgcgacatgaagcttgcatttgaaaaagatgtgcttggaatctatataagcgggcatccgctcgaggagtaccttccggtaattaagaaaaatgtaaatctgagctcccgcgacttcagattaaacgacgagacagggacgactgcggtaagacagaatcagcgcgggattattgccgtggttatcactgagatctctgtaaaatacacgaagacgaaccgcgcaatggcctttgtcaccggagaggacctttcggggccgcttgagatgatatttttcccggactgctatgacaagtacagaagcgtgctttcagaggatttaaagtgcctgataaaaggccacgcgtcggtagatgatgagaaggatgcgacttttatagtcgatgaactgatagaattttccgatatcccgaaggaggtctgggtcaggtttaacgacagggccgcatacgacaattccaaaaaggagatcgaatcgctgctaggccacatcgaagagggccacgacagctgcattatttacctggctgcggagaagcagatgaagcgcctggggaagactgtaaaatcggacggactttttatagatcagcttatgaaaattgccggagaggacaatgtcagcgtatccggcggcagagtataataaaatgcttgaaactgactgtaaaaagacttaaaattaggcgtggattagaatatttggaggaattcatacatggcaaaagaagtaaggactattggagtattgacaagcggcggcgacgcccctggaatgaatgcctgcatcagagcggtcgtccgtcagggtatcgcgagaggaagaaaaataatgggtatccgcagaggctattcaggtcttctgaatgaggagatcgtgccgatggatacgcacagtgtttcagatattatttcaagaggcggtactattttacagactgcacgctgtcctgagttcaaggagctcgagtaccagaagaaggcagcggacatctgccgcaagcacggtatcgacggactggtagtcatcggaggcgacggttcattcaagggagcccagaagctttcgaagcagggcatcaacactatcggtgttccgggaaccatcgaccttgatatcgcctgcaccgattacacgatcggtttcgatacagctgtaaatacagctatggacgctatcgataaagttcgtgatacatctacttcacacgagagatgctctatcatcgaggttatgggacgtggagccggctacattgccctctggtgcggcattgcaaacggagctgaggatgtgcttctcccggagctctacgactacgatgagcagaagctcgtaaaccacatcatcgacggcaggcgccgcggcaagcagcaccacatcatcgtaaacgctgagggcatcggccattcagcatctatggcaaagcgtatcgaggcagctacaggcatcgagacacgtgccaccatcttaggacacatgcagcgtggcggctctcctacagctaaggacagagtttacgcttctacgatgggcgctatggcagcagatctgctctgcgagggcaagagtgacagactcgtagcacacaagcacggcgatttcgtggatttcgatatcgacgaggcacttgctatgacaaagacactcgatccgttccaggttgagatctgccagacactcggcaacagtgattacaagctcaaagataagtgattacatcaaaaaataacgatctgataaaatacgtcaaaaaaatctcctcaaagccgaaagcgcgccgcgaggagaatgtgttttttgcggaaggaaggcggcttctctctgagacacctgccaggctccttaagaaagtactggtctctgagaatttttcattcaaagatacacctgcagatgaaaaacttaaagagattttaaacagtggagctgacatcgaagaagtttcggagtctgttttttcggagatatcagatacaaagcacagccaggggatcgcggcggttgtaaggcagccgtcttatgagttaagcgacctgcttcccgggaagccacttatccttttacttgaaaatgtccaggacccgggaaatctcggaactatggtgcgcactgcgctcggagccggtgcgagcggaatcgttatgacaagggactgtgtggatattttttctccgaaggtcgtaagggccacgatgggagccatctaccggctgccatttttctttgtggacgacgcttcagaggcgatagagaaactgcgcgggagagtgcgctttttcgctgcgtcgctgggcggaaaaaagacctacgaccagtgcgatttttcacatggaacggcttttttgataggaaatgagggaaacggccttagaaaagagaccatatcggcctgcgattcggagatgcttatcccgatggaaggaggcctcgagtcacttaatgctgcgatggcagcaggcattctgctctacgaggcacacagacagagacatgcagatttggtttaaactggtaaaggacaaccacattttacgcgaagtgactatcactgatgacagtgatgacacgagaactcacaaggtgatgcgttccgtggatcaggcaatccacgagctggatatcggcgttccgtcgtggctgcccttaaacataaaggatttcaagcgtttcgcaaagacgcgttttacagccgattcatttatcgagggtctggagggagactatctcgagatggaagttatagaagaggattgaaaaatggaccaggttgaatattaccacatgatcgccggggagaaggaggtcgacagctggaccaggatcatgctgttgtatcgctcggcggtcgaagagatacgaaccaagatagatattttaaacgatgagttccagcagactcaccgctataacccgatagaatacgtaaagacacgtgtcaagtcgcctgagagtattgcaaagaagctcaagcgttacggacgtgaagacaacatcgagaatatggtctcatactgcaatgacattgcagggatcaggatcgtctgctcttttacatccgatatttacaagctggccgacatgatcggcaaacagtcggatatcactgtcctctcgataaaggactacataaatcacccgaaggccagcggctacaagagctaccacatgatagtcacgatcccgatctttttgtcagataacgtggtagacaccagagtcgagattcagatcaggaccatagctatggatttctgggcttctcttgagcacaagatatattacaaatttgagggtgatgcgccggaatacataagccatgacctccgcgagtgcgcccacatcgtctcgatgctcgatgcgaaaatgctctcgctgaacgaagccatcatgaaggccaaaaaagaacagagagatgagcagaaggtcgagcagaacgcccacgagcggctgaatatgctgataaaccaggcgaagagcggttcgtgaaatgtttttgaatattttttaaaagcggttgtccagacatagggcagccgcttttttttcgctaatacattttcagtaaattgttagtttgtactaaattcatggtacttgattttgtacaaaaaatcagttataatgccaattgtatacagcattagagaaaaaacaattcttttgtgtgttatttttaaaacacatctttacggggaagacaggaggaagagtgcattcgacaattgaaaaagcatatgcgaagattaaccttgcactccatatcgaagggaggaggccggacggctatcatcttctttcgatggtgatgcagacggtggacttatacgacagtatcgagataagacagcttaatgacacttctgatatttcgatggatatggattttggcggcagggatacagatgagaatataagctgtggaggtgacaatctctgtgtgaaagctgcgaggcttatctgcagtgaacttcccgaaagccacggctatcacatgcacctggtaaaaaatattccatcagctgccggaatggcgggcggaagttcggacgcggcagcagtgcttagaggcataaataagcttgagggaggttatttcccaaagaaaaagctcctcgagatggccgtaaaactcggagcagacgtgccgttctgcatagacggagggctttgtgtctgtaaaggcattggagagatcttaactccgatcgagtcaaagttcgacccgcttcttctcctcgcaaagccttatgacggtgtctcgacaccggcggcctacaaatactttgatgagaatcctgttacagctcccggacatttttcaaagcttgtggatggcctgagatccgacgatcatgggcttatcctgagtaatctgcacaatgaccttgaagacgcttcgaagcatttctgtccggtgataagccagatagaagatgtgatgatgcgtaacggagctctggccgcgaaggtgacgggcagcggtccgacggtgtatggcatttttgaaaatgaagatgacagagcaggggcttcaaaggaattgcaggcagcctctcttgctgcagacatcatttcaacaggcttcatcagaccagattatcagtgaattattttttaaggaaaggatattatatggaactcagactcgacatgaactcgtatctgcccctcagggacgttgtttttcagacgctgcgcgacgccattctaaagggcgagctggagcctggagagaggcttatggagatacatctcgccaataagcttggagtttcgaggactccaataagagaggccatcagaatgcttgagaaagagggactcgctgtaacgatccctagaaagggcgctcaggtcgcacagatgaccgaaaaggatctcctcgatgtattggagataagggacgctttagatgagctggctgtaacagatgcctgcaaccgcatggatgagcaggactttaaggatttagaaaaagccatgaacgactttgtcgtagtaacgaagtctgacgacgtccgtgcgattgttgaggcagacgagaacttccataatgtgatctaccgcgcaacgaagaacccgaagctctggcacatcatcaagaatttaaaagagcagatgtaccgctacagatatgagtatgtaaagcaggataaggattactccgacctgatcgaggaccatcagaagattgtcgagggtcttaagaggaaagatgtcgactacgtgaaatctgtaatgcacagccacctgcagaaccaggtcgattcggtgagccgtgtgatccgtgagcagaacagggcgggcgccaggaaaaaggcggagagcgataaatgacttctgacgtaaatgtacatttgaaatctgtgcagaaagccggtgacacgaccgacgtaaacgagtccgatttttccggccggctctctgtctcgcccgacggcagatttatgctgcgcttcgagtcttccgaagagggccgttctacgaagactgtgattaaatcgatggattcttcacatgtcactgttacacgctctggtcttgtcactacaaaaatggagttcgacgccgatgcgccgactccttttatttaccatactcctttcgggtcgtttgaatttatgctgaagactttcgacataagccggttcgtgggggttgagccgtcgcttgagctgtcgcttaactatgcgctgtttaatatgggggatagggtgtcggagaattcgattgagctaatggccaggtgatgcagcagccgcaggcacatggctcactcagtgcgcgttttgcggtttgtagtagccgggtaatgcagcagccgcaggcacacggctcactcagtgcgcgttttgctgttcagtcgcatgcgcttaattgcggtcatctgtccaatgtatggttttgatacgtttatggttttagcgggtggacacccgggccgcagctagcgtgctccttcactacgcaaaatgcgcattcgttcgccgtgttgctctgcggctgctgcattcagcgacttgcagtttgccatcccgctggcggcgaatgccgcctgttttcatttgaaaaagatctatttggtttgatttcaatagaagttaatgcggagccagaaatatcaagcgttgttctcgctgtttcaattgagcaggatgcggagctggaaatgtttaataacttcctcctaccggagatattttgggcagtttttcaatatggttggatttgaagctgaaaatcttaaaaagtaatatatgactttctatatagagctaaagtgtgtcaaaaaccataaatattcaggtgtgcgattttaatataggcttagacagagttggaaatcttcaatgcgctgtagaaaatccagaatctttggatgtatattgatagtttgaaatacaccatttaagatttttaggcggtatcgtgattatcttgaaaacggctgtaagccttttaagaatttgactttatcctagctctatattgagatctgaagaggacgattgtataaatttcaccctgccatgccctgtattgaaacgaggcggctatgcggagctggaagttaactgcaattgtataaatttcaccctgccatgccctgtattgaaacgaggcggctatgcggagctggaagttaactgcgattgtataaatttcaactcgccatgccatatattgaaatgcggcggttatgcggagctggaagttaactgcaattgtataaatttcatcccgccatgccatatattgaaacgcggaggttatgcggagctggaattaagctgtgattgtataatattcgcccagccgggccctgtattaaaaaagctgccagagcgggggcttctggcagtaaatcctctggaaaaaaacaggacagacgcggatggatggcgggcggatataagcgcatttcggggagcccggcgggctccccgaaatgcgctgtatgagcgagccatccgtagcggctgtcctggaaggcatattctggtgcagtcttattctggttataggttgtcctggtatgttattcagaggagatttttacttcttcttcctggatttagcgttctgcctgttttcttcctcctgctcgcgcatcttacgctgagcccaggcgcggatgcctttcttcttcttggaaggcggggtgatcttcttgccgtggacaccggttacggcgctgatgtagaggccggaaacctttgctttgacttcctgcttgacagggatcatgtcaaagatggtcgggtcgcatatgaaagtcatgaccttagggccgactttggcttttacgacaggaactttggcgcgcttagaataccacggcgtgttcgcgatgatgttttccggtagacctgcctcggtcatcttcatctttttcttgtcgataataagcatcgtaaaattctgggcggtctccgctatcttttcatcctgctcggcctggcgcttctgagcctttctgccgagaacggcgaggatgatgatcgtgccggtgaggatggccgcaatcactataagtacaataacaactggtgacattttataaacctccatattatcatctgtcctgtccagcgattggacagcattcacattttaccattaagcaccgtcgaatacaactgccggttgaagtttttattgcattatgatagaataccatccattatgaaaaaaagaattttagctcttgtcctggcaggcacgctgctggccgcaacaggatgcgcgaagagcaatggcaaaggcagcaccagaaataccgcaagcgctgaggcagccaattacaaggcctccgattatgtgacgcttggtaagtacaatggggtaacggtcacactgacgaagacttattcggacgatgacaaggcagtgaagagctatgaaaatactcttataaaaaatgccagcggcagttatgacaaggatccttctcagaagacagtaaagaaggactcgattgtaaatgtcgactacaagggaataaaggacggaaaagcctttgacggcggcacggattcggacgttacgatcaatgtggcaaagaattcagaagcggtcaagggaacaaactatattgacggattctctaaaggactcgtcggtgcgaaggttggaagcacagtgagttcaaaggtgactttcccttcgaactatcaggccagtggcctggctggaaagacagtcattttccaattcaaggtaaactacatctgtaagaaggttacagctgacaccgtttcgacagagtacttgaagaaaaatttcagcgttgctacaaagaaggcatttttcgactatgcgaagaagagcttacagaagcagaataaaaaggacaaagatacagagataagctcgctcgtttctgatgccgttgtaaagagttcaaagataaagagttacccgaagggccttatagattcgagaatggcaagcaacaaagccatgtacaaggcacagtatttctcagatggcatgacctgggacgatttttacaagcagctcaatgtcacggaagagcagttcaataagattatgaaaaatgccataaaagatgatctcaaaaacgagctgatcttctcggcagtagcggagaaggaaaaaatcaaatttgaccaggctggctacgacaagtatctgaaaaatctgatgacaatgaacagtgtcagtgatgaaagcactttctataaaaaatacggttcttcagctgcagagggaaagagctacctgcagaggatgtatgttgtaaataaggcgcttaaattctgtataaagaatgctgtagtaaagccgaaggcataaagtcttttattttacataaagctgtgatataattacttagcctgtgtgtgcaggcgtatcatgcagatttttcataaaaggaaggacgtttctatgaagcacattaagacattaaacgagaagagacttcagaacacagtagtttatggcggatgcggtgagtgccgtacatcatgccagtcagcatgcaagaccagctgcacagttggcaaccagcattgcgagaatccggcccgcagataatttttaagcgcaggcacatttgataaggcagctgtcctctggatggctgtcttatgcttgtctaagggaattagatgagcttttgatttttagatttagatgaggtttttactttgatccaccagtacaagaacaacgggtacgacatagtcctggatgtaaattccggagctattcatgaagtcgatgatcctacctatgatatgatcagtgaatacgaggggacccctaaggagacagtgatctcagatatctgccggaagtatccaaaggagacgaaggaagatatcgaggaagcctacgacgagatcacacagcttaaggacgagaaggcactttttacacctgacccttataaggacagagtcatcgattacacgaagcgtccgactgtcgtaaaggccatgtgcttaaacgtcgcccacgcctgcaatctgagctgtaagtactgctttgctgatgagggactttacttcggcaggaaagcagagcttatgagttttgaagtcggaaagaaggctttcgattttcttatagctcattcaggaaaccgcaggaatctcgaggtcgatttctttggcggagagcctacactgaactgggaagtcgtaaaacaacttgtagcttacggccgcgggcaggagaaaaaatacgacaaacatttcaggttcacttttacgacgaatggaatccttttaaatgacgagatcatggatttcgcaaacaaagagatggataacgtcgttatgtcgatcgacggccgcagggaagttcacgatcacatgaggccgttccacaatggcgatcctacatgggatgtcatcgttccgaagtatcagaagttctgcgccgaaagagaagctcttggaaaagagtactatgtcaggggcacatacacgagatacaatctcgattttgcaaaggatgtactggcgctggcagatcttggctttaaggagataagtatagagcctgttgtcgcaccgcccgaagctgactattcactgagagaagaggacataccaactctctgcgagcagtacgacattttagccagagagatgataaagagacacgggacggataaggacttcaacttctatcatttcatgatcgatctcgaaggcggcccatgcgtctacaagcgtctttccggatgcggctcgggaacagagtacgtaagcattactccggatgggagcatcttcccgtgccaccagtttgtcggcaagccggatttcaagctcggcgatgtagacagtggaatagtccgcgacgatatcgtgacggatttcaagggatgcaatgtctactcgcgtcctaagtgcagagactgttttgcaaagtactactgcagcggtggctgttccgcgaattcctacaatttcaccggacatatccgtgacgtctatgagattggctgtgccctcgagagaaagcgtatcgagtgtgctatcatgatcaaggccgcctgcgcggaaaaggatgcgaagagcgcatcgaaagagaacgaaaaaactgcttagtgttttttcaaaaaaattattggagtgtaacataaaatgaaaccaaagaagggaaaatcagtcgcatttttctgtgtctttctggcagtggtagtatttctcgggtggttttcatacaccgtaataaaggatactttccgccagggaaagaacagcttaaagctcggccttgatctggccggcggcgcttctatcacctatcagatccagggaaaggcaactaagacccagatcaacgatactatctacaagctgcagaaacgtatcgagaacgaccttggaaacgagtcgaatacaaccgaggccaatgtatatcaggttggaagcaaccgtattgcagtcgagatcccaggtgtaaaggatgcgaatgcagtccttgagcagttaggtacaccgggagacctctacttcatcaagcacagaaccaacagcaaagagaactatgtgattgaccagactactggcgaatacaagctcgccgatggagttacgatcaaaagcctccagaagaacggcggaatcgttttaaacggttcagaagtaaagacagctcaggcagtttacgagcagaaccagacttccggaggaagagacccggtagtctctatcaccctcacatcgaagggtgccaaggcctttgccacggctacgacagaagccgcaaagaacaataacgacactatcggtatctactacgatggaaagttcgtatcagttccgaaagtaaacagtgctatcaccgatggcaactgcgttatcgagggaatgagcggtattgaagaggcacaggatctggcttcttatatccgtatcggtggtctcgatatcaagcttaaggaagttcagtcacatatcgtaggagcccagcttggttccgatgcgttaaagacctccctcatcgcagctgttttaggtttcctctgcgttgttatatttatgattgcagcttataagttcccgggagcaatggcatcgcttgcacttctcctctatgcagaacttatcttaagcatccttcaggtattcgatatcactcttacgatttccggtatcgccggtatcatcctaagtatcggtatggcggtcgacgcgaacgtcattatcttctcccgtatgaaggaggagattgccgcaggaaagacagtaagagccgctattgattcaggattcaggaaagccctctcagccatcatcgatggaaacataacgacacttatcgtggcagtagtccttggagttgtcgggacaggtactataaagggattcgccatcaccttaggtcttggtacactgctctcgatgtttacagcacttttcgtaacgagaagccttgtaaatactttctacaacttcggagcccagaacccgaagatctatggaaagctctggaccttcaagaagatacctgtcatcgagaagaaggcagttttctttgctgtttcaataattgcgatcggttcaggtatcgttggaatgatcgcctacaaagcgactacaggaaaggccttaaactattcgcttgatttctcaggcggtacttcaaccactgtaaatttcaagaaggattatactattgcccagattgacaaggacatagttcctgtagtaaagagtgttacgaaagactctgatatccagagacagaagtcaaacagtggcaatcaggtcatctttaagaccagaaccctgaatttaagcgaaagagaaaacttacagtccaggctcgagaagaagttcggagtaaaggaatctgatatccagacagagaacatcagcggaactatttccggcgagatgagacgtacagctgttattgctgtcatcatttccgttatcctgatccttatctatatctggttcagattcagagacatcagattcgctacatcggccgtgctcgcacttgcacacgatgtgctcgttacgttaggtatatatgcactgttccgcctttcagtcggttcggcattcgtcgcatgtatattaacgatcattggttactcgataaacgatactatcgttgtattcgaccgtatccgtgagaactttcacaatacgagcagacgcaatcctgacaccttgaaggatatcgcagacacctctatcacagaggtagttacgaggtctctctcgacatcgtttacgacagcgcttacgatcatcatgctgcttatagtcggtgtttcggccatcagagagttcgcattccctctgcttatcggagtcataagtggtacttattcatctatcttcgttgctacaccgctctggtatgtcgcccgtgtccacattggaaagcagcaggacgatatcaaacagggtcctaatgcgcgcaggaaaaagaagaagccagttgtaagaccgaatgcagaaaaccacggtgccatagtataactgacgcatatattaagaacttcattataaaaacaggttgggtttacccgacctgttttttatgctataattctaaacgttgcgactttagttatttcccgaatggaggaactatgtacactatcgaagacatcagaaacgaagatccggagatcgcagaggctgtctgtgaagagtttgacagacagtcgagtcacattgagcttatcgcatcagagaactgggtaagcccggcagtcatgagcgctatgggttccatacttacgaacaagtatgcagagggttatccagggcacagatactatggcggctgcgagaaagtcgatatcattgaagatctcgccagagagagggctaagaagctcttcggcgcagagtacgccaacgttcagcctcattcaggtgcacaggcaaatatggcagttgagtatgcagtctgtgagccgggagacacgatcatgggcatggccttagatcagggcggacacctgactcatggctcgccagccaatttttccggaaactacttccacatagttccttacggggtaaatgatcagggatttatcgattacgacgaggtcgagaggctcgccaaggaaaataaacctaagatgatcatcgccggtgcatcagcttatgcgagaaagatcgacttcaggagatttggcgagatagctcacgaagtaggagctgtccttatggtagatatggctcacatagcaggccttgtcgctgcaggctatcacatgtcacctgtgccttatgcagatatcgttacgacgactacacacaagactctccgcggacctcgtggaggacttatcctcgctaccgaggaagcttcgaagaagtttaagctcaacaaggcagttttcccgggaattcagggcggccctctgatgcatgttatcgccgcaaaggctgtctgcctgaaggaagctatgcagcctgagttcaaggagtacattcatcaggtcgtactgaatgcgcaggcactcagcaagggccttatggacagaggagtcgacatagtatcaggcggcacagacaaccaccttatgctcgtagatctgataaagaatgagctcacgggtaaggaagtcgagtcatggctagatcaggcaaatatcaccgcaaacaagaacacagttccaaacgatcctaagagcccgtttgttacgagcgggatccgccttggaacaccggcagccacgacacgtggactgaaggaagatgattttgatcaggtagcagaggctattgccgatgtcataaatgaaaaggaagcaggcattgacaaggcaaaggatataataaaaggacttacagacaagtatcctctttctgcaaaatttttctgatttattatagagaggcaattatgatagacattaagtttttacgtgaaaatccggacgcagtcagggaaaacatcaagaagaagtttcaggacaagaagcttccgctcgtagacgaagtcataaagtacgacaagaaaagccgtgagacacagggcgaggcagatgagctccgcgcttcgagaaacaagctctcaaagcagatcggtgtcctgatgaaggaaggaaagagggacgaggcagccagggttaaggagcaggttactgcaaacgcagccagactcgctgaccttgagcagaaggagaaggagtattccaagaaggttcacgacgatatgatgcttatcccgaatatcatcgatccttcagttcctatcggccctgacgattcatgcaatcaggagatcgagaagttcggagagccaaaggttccggattatcctatcccataccacactgacatcatggagagcttcgacggcatcgatctcgatgcagccggaaaagtagctggaaacggtttctactatctgctcggcgatattgcaagacttcactcagctgtacttgcatatgccagagatttcatgataaataagggatttacttactgcattccgccatacatgatccatggcgatgtcgtaaacggcgttatgagctttgaagagatggacgccatgatgtacaagatcgagggagaagacttatacctgatcggtacttctgagcactctatgatcggccgttacaaggacacattaaataatgaggaagatcttccgtttacaatgacatcctattctccatgctttagaaaagagaagggagcacatggaatcgaagagcgtggagtttacagaatccaccagtttgagaagcaggagatggtcgtaatctgcaggcctgaggaagcctgggactggtacaacaagctctggagctacacagtagagctcttcagaagcatggatattcctgtccgtacacttgagtgctgctcgggagacctcgcagacttaaaggttaagagctgtgacgtcgaggcatggagcccgagacagaagaagtacttcgaagtcggaagctgctcgaacttaggcgacgcacaggccagaagacttggcatcaggataaagagagctgatggcacaaagtatttcgcgaataccttaaacaacaccgtagttgctccacctcgtatgctgatcgccttcctcgagaacaacctgaacgaagacggctctgtaagcatcccgaaggtccttcagccttacatgggtggtacagaaaaacttatcccgaagcacaagataagtaaatgatcacgatctgatctgatcgtagaaatccttgatataggggatcagctttgtgctgtgaactacatagcttccgtgatcttcaccgggcaggatcataagcctgctgtcggggatcgcggaggctgttttttttgtgtcggaggatctgaccaggtcgtgttcgccggccatgacaagtaccgggaccttaatatgagagagcgcgatcgtagagatggacggttctgtaagcatcagcttctcgagggcaccgctctgcgcgaagatctcgcttgaaactgtatcgatgtcttttttgatctcggaggaggctgatttttccctgtaagatttctttatatcacggcggcacgataagatcaatgcagacggggaggaatttgctccgcatgaaatgaccccggaaataagctcggaacgagtcatcgcaaggagcagggcagtgatcgcgccatcggagaagccgacgacgagaggcctgtctatagaaagttcccggataaaatgctcgacatcgcgtgccatatccttgtagtgaagctccgccgggcaggcggagagcccgtgcccgcggctgtccatccggtagatatcgaagctgtcggaaagcgaattcgaaagctcatcaaaaatatgcagatcctctccatttccgtgcaggaaaagaagaggcctgccgtctttatttccctcgtgagtataatttatgacctgaccgtccaggattataaccatgtgtgcctcccgtttgactaattatatctactagtttatcatatatccgatatgaaagacaaaaaaattattttctacagactcatgtgcttcgggctcggggcagcttcatatatatttatattcttcagctggatagtcggcctgatctctgcgatcgcctcgatcgtcttcggcttcctctacggaaaaaatgaaaagaggcgcgacggactcgtcactgcgggactgatcctctcgggagtctacgtcctcgtctacatcctcgtgattataatcggcgcggcatatttttcatctttgaaaataagtccattcgggaaatgaacggcagggaaaaatctgctgttctgtaaaatcggagtaatatgaataaaattgtgaaaattacaatatttttatcattttactttaacacgttaatgttataacaggaaagagagatgcggtttggtttccatattttaaagttttaataaatgtcaactgcagattgacttttcttcatgataatgtataatatccattgttgcggaaaaaccaactttcatttttgtaaaaagagattgtccgacagacgccgacaatcgactatattacacaaaggagtgcagataaaggggaaagttatctgcatttttttagtcattgaaagctttaacgcattaaagcgaatatatataaaaagtacaaggagaaaagaaaagtggcaaagtacattgtgaaaagacttatcatggcagtggtagcttttatcgctgtgagtgccatcacattcttcgttatgaacctgatcccgggcggaccgttcacatcggagaaggccatgactaaggaagtaatcgcgaccttaaccaagaggtacgggctcgataaacctatcggcgtccagtatctcaactacatggggaatttcctgcgcggagactggggtgtctcactcaagacgcagagagagatctggcctgaccttcagtcgagatttggagtttcagcccgtctcggactctcagccctggcaatcgcaactgttttcggagttatcttcggttcgatctcagcgctgacaagaaataaatggccggacaggcttcttgtggtacttaccactttgggaacggctattccttcgttcgttctggctacgctgcttatgcttttattctgcatgcagctgaacctgcttccaatctgggatgtacatcatccgaactacattctgccgatcatatcgcttgcggtatatccgatggcatatatcacacgactgacgaagacatcgatgcttgatgcattgaatcaggactacatcaccacagccaaggcgaagggtgtacctgagtcaaagatcatcttcgtacacgcactccgtaatgcgctgatcccggtagtcacatatttaggacctgaggtagcatacatcatcacaggatcgatggtagtagagagtatctttactatccctggaatgggtacgatgttcgtacagagtatcaacgatcgtgactatccgtatatcatggcagtaacgatctttcttgcaatgcttatgatcatcgcgaacctgatcacagatatcgtttacaagattatcgatccacgtattacatttgattaaaggagctaagagatggcagaagagaaattaaaaaagagagccttcctgagctctcagatcgacctcagcaaattcaacgctaaggactttgaaaaggcaacagacgaagagaagaggcagcaggatgtaatgggcgagtccactaccttctttaaggatggtatgagacgtctcagaaagaatcctctggctatggcaagtatcgtagtgcttatcataattattgcgatagcgatagttgcaccgcatatctgtccgtattcatactcttcgataatcacggtagacggacgccgtgacaagggcgctactgacctcgagcctatgcagtggtcagagcttgaagcacagtatatggaaaagaccggaaagaaactcttcccgcacattttcggaactgattcgatgggaagagattatttcatccgtgtcgtatatggtacaagagtttcactcctggtaggaatcgtggcagcagtcatggtccttatcatcggactgatctacggctctatcgcaggatatttcggaggaacagtcgaccttatcatgatgaggatagtcgacgtcatatattcacttccggacatgcttataattatcctcttatcagtcgtattgcaggagaggctgacaccacttatcaaaggtacgtcgcttgcgaaactcggagcgaatatgatctcgatgtttatcgtatttgccctgctctactgggtaggtatggcaagacttgtaagaggccagatcctccagataaagaacaacgagtatgtgcttgctgcaaagagcatcggaactcctaacggaaggatattaagaaagcacatcatcccgaactgcctgtctatcatcatcattacgacagctcttcagattccgagtgctatttttacagagagttacctctcattcatcggactcggcgtaagccttcctctgacatcacttggctcactggcaaatgatgcccgtgctgcgatgcagacttacccgctgagacttgtcatcccggctgtagtcatttcactgatcgtgctcgcattcaacctccttggcgatggtttaagagatgcgttcgatacgaagcttaactaaaggagatcgatatgagcgaagaagaaaaatatatcctccaggtaaaagatctccacacgagtttttttactgacaatggagaagtacaggccgttaacggcgtaaactttaaccttaaagccggcgagacgatgggaatcgttggagagtccggatcgggaaaatctgtcacagcctactctataatgcagattctggctgagacaggaagagtaactcagggcgaggtacttttcaatggcgagaacattttaaagtggcctgagaagaagctgcagaagttcagaggtgagaagatatctattatcttccaggaccctatgacttcccttaaccctgttttctctataggctggcagcttatcgaagctatcagacttcacacgaataagacaaagaaagaagcatgggaccgtgcggtcgagatgcttactttagtaggcgtaaacgagccggaagcccgtatgaagcagtatccgttcgagctgtcaggcggtatgagacagcgtatcatgatcgccatgagtctctgctgcgagccggatgtgcttatcgcagatgagcctacgacagcgctcgatgttactatccaggcgcagatcctcgagctgatgaaggaccttcagaaaaggctcggaatggctataatcatcgtaactcacgaccttggcgtcattgcatctatgtgcgatgagatcatggtcatgtacggtggaagagtatgcgagagaggaagcgcggacgatattttctacagacctgcacacgagtacacgaagggactcctccgttctatcccacgtgcagacaatatgaaggagaagctgattcctatcggcggaactcctatcaatatgttaaatcttccgcagggatgtgcattctgccctagatgtgccaacgcaatggagatctgtcttcgcgagaagccggatgaaatcaaggtcggagagggccacagagcagcatgctttatgaatgtcaaagaagcttttgaagagaaggaggaagcataaaatggcagaagagaaaaatctcgtcgaggtcagccacttaaagcagtattttcctgtttctcagggcttccacaagataccattaaaggctgtagacgatgtttcatttactataaaaccaggcgagaccttaggcctcgttggtgagtccggctgcggaaaaaccactgtaggacgttcacttcttcagctgtataagccgacggcaggacgtattgtatttgacggagatgtgcttttcgacagcggagagcagtatgacgccaatggtgaggttatctgcggcgaggatggaaagcctgtcatcaagaatccggtaaaggtaaatatgctgccttatcgaaagaggatgcagatggttttccaggatccgtattcatcactcgaccctcgtatgacagtcgaggatatcatcggtgagcctctggacgtacatcatctctacaagaataaaaaagagcgccgagagaagatcctcgatcttatggctaccgtaggactcaatgcagagcatgccatgcgttatgcacacgagttctcaggtggacagagacagcgtatcggtatcgcgagagcgcttgcagtaaaccctgatttcatcgtatgcgatgagcctgtatcggctctcgatgtgtcaattcaggcacaggttataaatatgttcgaggatcttcaggataagctcggactcgcatacttatttatagcgcatgatctgctggtagttcaccatatttcagatcgtatcgcagttatgtacctcggacatctgatggagatcgcggatgcagacgagttgaatgacaacccgatccacccatacactctgtcacttctttcggccgtacctattccggatccggagacagcacgtcacagccaccgtatcgttcttgagggcgatgttccttcacctctgaagatgcctacaggctgcccgttccgtacgagatgcagatatgcgacggagcagtgtgcagcagagcgcccgatcctcacagacagaggaaacggccacatggttgcctgcttcaacaaataaggagattcccgctggatttatttcagcggttctcaatatattatttatctacttttttaaaggaggaacttctttatgaagaaaaagttactttcattgctgctcgcagcagtcatgacagttggcatgaccgcctgtggaggagtaaaaggtagaagcacaagctcttcaagtggaagtgcaagcggctcaaagaagacagctgcagctactaccgagaaccatgacacagatgtgttaaacctcaacatcgcttcagagccacagtcagttgacccggcgctcagcatctctatcgatggtggtatcttaattgtaaactctttcgcaggactttacacttatgatcagaagcagaagcttgttcctgacattgcagacggcatgcctcaggtatcaagcgataagacagaatacactatcaagctcaagaagaccaagtggtcaaacggcgaggctcttacagctaaggatttcctgtattcatggaaccgtgtaatcgagaagaagacagcttcaggctatgcttacctcttcgatataattgctcgtaaagacggcaagctcgatgtctcagctccagatgactacacactgaagatcaagcttacaaacccatgcccatacttcaacgatctgcttgcattccctacattcttccctgtatatcagaaggaagtagagaagtctgttacaaagaaggtacctgctggtacatggtcacaggaagctggattcgtttcaaacggtgcttacatcttaaagtcatggaagcacaacgagtctatggtatatgagaagaaccctaacttccacgatgcttcaaaagtaaagatcaagtctcttcacttcatgctttcagcacaggatacgacaacatatgccgcatacaacaagggcgacctcgatttcatcgacacagtacctaacgacgagatcaagacagttaagaacagcaaggaattccatatcatggataaccttggaacatactatcttgcattcaacgtaaatgctgatctcttcaagaacatgacagaacagcaggccaaggatttcagacacgcaatcgcacttcttatcgacagacagtacatcatcgacactgtaggtcagacagagcaggttgcagctgattcttatatcccggctggtatgagcgacggtaacggcggcgagttcaagaacaagagttattacgatgcaaagaagactggccaggattcagtagaagaggctaagaagcttcttgagggatgcggatataagttctcaaagcagagcgatggcacatacaagtgcagccctgatatctcattccagtacattttaaacgatgattcaggtcataagaagatcgctcaggctgttcagcaggatcttcaggcacttggaatcaacatgcagatccagacagaggactggaaggttctcatcgcagatcgtcagaacggtaacttcaccttcgctcgtgagggatggttagcagactacaacgatcctatcaacatgcttgagatgttccagaccaagtcaggaaacaacgacccacagttcggcaaagatatgtctaagcacaagtcagcacctcagaactggaaggattatgataagctgatcgacaagatcagaacttcgacagatttctcatcacgtgttgatctgatgcatcaggcagaggatatgcttatggatacatgggcagtaatccctatctactactacaatgatatctatatgcagaagcagaacgtaaagggagtcttcggaacagtttatggctttaagtacttcatgtacgcaacaaagtcatgatccactgatcattcaccagagcatattttagattaaaaaaagagccggacgcttgtttataaaaaacaggcgcccggcttttttaatgccagagaagtattttatgcaataatagaggtaccacactgaaaagcacaaaatggcatatttcagctggtttttataccgaacgtttggatatatttcaagcaataaaaaatcccggaacccttaaaaaaggattccgggactctcaaacttagtgtacccgacaggattcgaacccgcgacaccttggtccgtagccaagtgctctatccagctgagctacggatacacatgtggcctcaatggcctcaacaaatataaattatagcataatctaaaagaaaatgcaactgccggcgaccgggatcgaaccggtacgatgtcaccaccacaggattttaagtcctgcgcgtctgccaattccgccacgccggctcccgccatctgctaagagcctggcaaacgacctgggaggggttcgaaccctcgacctccgccgtgacagggcggcgctctaaccaactgagccaccaggccattaactggatcctcggggactcgaacccaggaccgaccggttatgagccggttgctctaaccaactgagctaaggatccacaaaaaaatgactccgacgaggtttgaactcgtgttaccgccgtgaaagggcgatgtcttaaccacttgaccacggagccatatccgccaccatcaaatcggcgactaaaatataatatcacaatagtttttagaatgcaagtctttttttaaaatgagctgaattccaaaatgtttgataaacaacagtctttgaaggagttctgtgctactataatcctgcttgaaaaagtaaagctattatgctagactaacaagcgtaacaggaatggaacactgaatttattttaaggaggtttttcatggaattacaggagattattgacgttaaaggcagagagatcctcgactcgagaggaaatccgacagttgaagctgaagttacattggcagacggcacagtaggccacggtgcctcaccttcaggcgcttctacgggccagttcgaggctcatgagatgcgcgatggcggagaccgttacatgggtaagggcgtacagaatgctgtcgggcatgtaaataatgagataaaggatgctgtcacaggaatcgatgcctgcgacacatatgccgtagacaaggctatgcttctggcagatggcacagacaacaaatcgaatctcggcgcaaatgcaatccttgctgtatcgatcgctgcagcaagagcagcagccacatcacttcagattcctctttacagattcctcggcggttcacagggcaacaacctccctgtaccgatgatgaatattttaaacggcggagcccatgctgccaacaatattgacgctcaggaatttatgatcatgcctgtcggcgctccttcatttaaggaagcattaagatggtgcgcggaggtattccacaaccttcaggcacttcttaaaaaggatggtcacgctacagcagttggcgatgagggcggtttcgcaccgaacttaaagagcgatgaggaagctatccagtacatcgtaaacgctgtaaaggcagcaggatatgagccaggtaaggacttcaagatcgcaatggatgtcgcttcatctgagtggaagggcaggaagaagggccagtaccatcttccaaaggcaaataaggactatacgactgatgagcttatcgagcactgggcagctctcgttgacaagtaccctatcatttctatcgaggatccactcgatgaggaagactgggacggctgggctaagatcacgaagaagcttggtgacaaagtacagctcgtaggcgacgatcttttcgttacaaatgtaaagagactgcaaaaaggtattgaccttggagctggaaatgctatacttataaagttgaaccagatcggctcagtttcagagacactcgacgctataaagctcgctcatgacaacggatatgctgcgatagtttctcacaggtcaggtgagacagaggatactactatagcagacctcgcagtcgctatgaactctaagcagatcaagaccggagctccgagcagatcagagcgtgttgcaaagtacaaccagcttatccgcattgaggaagatcttggcgacgcagcggtttatcctggaccaaaggcgtttaacgttcagagataactaaaattctataatcagagtacacgagagtgcacgaaggggcacaccaccttgggtgtggataaccttcgtgtactctttttttttcgcgtattaaatgagcggtgctgaaataacatatcggtgccgacggacgcttgcgtccggagaggcatccgatatgttatttcaatagcgcgaacgcgcgaatgagcagccgcgaagcgggtgcgaattgcaccgctcatttactaatagcgcgaacgcgcgaatgagcagccgcgaagcgggtgcgaattgcaccgctcatttactaatagcgcgggtgccccgattgtgtactaaatggaggtgaggtgacaatgcagttaaacggagaacagaaagaggcggatggcagaacaatcacacagattattgaggaaatgggccttaaaaaagtgatggtcgcagtggagttaaacgaaaatattctcccgaaggatcagtatgacacatatgtgccaaaggaaaatgatgtagttgaaatagtccagtttatgggcggaggaagtttatgagcaatagcaacaatgacacattcaaattgggaaacagggaatttacttcgagatttatcctgggttctggaaagtactcagttgatctgataaaggcagcagtggaagatgcaggagcgcagattgtgacctgctccgtaaggcgcgcgaatacgcagaagcacgaggatatcctcgaatacatgcctaaaaatattacgcttctgccgaatacttcgggtgcgagaaatgctgaggaggccgttcgtatcgcgcatctcgcaagggaactcggctgcggcgattttgtaaaaattgagataatgggagatacaaagtaccttctgcctgataacgtagagactgtaaaggccacagaaactcttgcaaaagagggatttactgtactgccttacatgtatccggacctctatgcagcaagagcacttagggatgcgggtgcagcagctgtaatgccgcttgcttcgccgatcggctcgaacagggggatttcaacgaaggaattcattcagatacttatagatgagattgacctgccgatcatcgtggacgctggaatcggcaagccgtcgcaggctgcagaagctatggagatgggcgcagccgcagttatgtgcaacaccgcaattgctacttctgaaaatatcccgcttatggccaacgcttttgcagaggctataagcgccggacgaaaggcatatcttgccgggaccggacgtgtccttgagaggggcgctgaatcaagcgatccgctgcttggattcttgagataaaaatctgcctggattcttaaagcaatcatatttttggaggaaaaaatgggaaatcagaagaatcagttttttgtagacggaaaacagttgagcgccgctgccctcaagagaaaacatgagctggagagcgacccgtcgagcagaacagactgcatgaagtacatgccgggaatggaccagatcgacccgtcgatccgcaatgaagtcatcagccagatgaacgcctacgactacaacaaatacaccgatatggatgtcaggagagcacttcacaaggagactatagatgtcgaggatttcaaggcactcctttcgccggcagcttttccacatctgaatgagatggctgagagagcccgtcacgagacaggccttcattttggaaacaccgtctatattttcacgccgctctatatcgcgaactactgtgaaaattactgtatctactgcggattcaactgctacaacgacatttcgagaaagcagcttgataccgaagaaataaagcacgagatggaagttatcgcgaagaccggaatcgaggagattctgatccttaccggtgagagcaagaagagaagctcgatcgagtatatcggagaggcctgcagacttgccaagaattattttaagaatgtaagtcttgaggtctaccctgcaaatatcaaggactacaaatactggcacgagtgcggcgcagactacgtcacagtcttccaggagacctacgatgtgaagaagtacgagacactccacctgctgggacacaagagaattttcccttacagatttgaagcacaggagagagcaatcttgggcggcatgaggggcgtgggattttcagcgcttctcggactttctgatttcagaaaggatgccttcgccacaggctaccacgtttactgccttcagagaaaatatccgtgggtcgagtactcgctttcctgcccgcgtctgcgccctataataaataacgagaagatcaatccgcaggatgtaggcgaggctcagcttacacagatcctctgcgcttacagactgtttctgccttatgccgggatcgttgtaagctcccgtgagaccaaacgcttcagaaatggcattgtaaaagtggccgcaacgaaggtctcagccggagtttcaaccggaatcggcgaccacgaggccaaatacactcacactgctgaagttgacactggagacgagcagttcgagatcgcggatacgagatcattcgacaacatgtactcggacctttcaggcgagggaatgcagccggtaacgaatgattacctctatgtcggctgataattttcaaagaagggagaagcgaaatgactcttcaggaatacaatggaaaggaaatgcagatttcgggatttaaaaaaacgtatggagatgcacagccgcagatgaacattatccgcgcgatcaccaacgcaaggatatcccggggactctcccagaaggagctgtcagagaagacaggcattgatcagtcggagatcagcaggcttgaaaatggtaacaggaacccgacgatcaaactgctccagaggattgcagatggaatggacatgaccctggatatttcatttcggccaaagagcgtgatgtaattacctgaattctgacagagtgtttcgaaacaaacttgaattgccgcagacttaagcaaagtcaggcggcaattttttagtatattgaaaaagtaaatatactggaaatataaaagaacaaagagtaagataataaagtctaaagagaggcactgccggagatgattttattacaatacgaggtgatccaatgaaagtactctgcatcacagaccacgaacttctcccaatcatgaatatcccggacatagcttacagagaatggaaaaagccgtttcttcgtgccataagggctatggctgcggaacgcccggaggcggtagtgatccgtgagaaactgcttacagggattgattattcggacctttttcaaagcattgaaaagcaggagaagccgcttggcacaaagcttatctggcacgaccatttcgaggcacttaagctttatctgaagtatcatcagaagcgggaatggccggacggcatatgtttttcatataaagaggcagggggactgtcgattacggacctgcgcagcattgagctgcctttcggctttactgttcacaacgtcaatgaacttttggatgcaaagaaaaataaagcgacatttattcttgcaagcaatatttttccgacgagctgcaagccgggagcagagccaaagggaccgggctttttgcgcgatgtctgcagagagttcgatggagaagtctatgcgctgggcggaattgacccgtcaaatgcgatgtcctgcatcgaagccggggcagatggtgttgcggtaaggtcactttgcatggcgaaaaaccttaagccatttcatgaactgataaatatgtgaaaacagactgcatgaattgattcagatgtggcggacgaagtcacagaataagaatatgaggaagttatgaagcattataagaattacatctttgatctgtatggtacgctggttgatatcgagacgaacgagaagagcccgtctctctggaagaagatggctgagctatactctgtatacggggccgattacaggcctgcggagcttcgcagggcttataccagtattgtaaaagaagaggagtcgatccttggaaaagaggaggatactgcctacccggagataaagctcgagaaggtttttgtgcggctttacaaagaggcagatcacactcatgagtcgatttactcattaaatgacgatcagcttccggctttttcacaatttatagcaaatgcattcagagtgatttcgagaaagcggcttgcggcttacccgaacaccgaaaaagtcttgaaaaccttaaaggagcgcgggtgcggggtgtatctgctttcgaatgcgcagtatgtctttacgatgccggagatcgaaaagacagggcttttgagttattttgacgggatgtttatctcgtcggagcatcgggtgagaaagcccgagcctgaatttatgcgggaacttttagacgaatacggactcgacaaagatcagtgcgtcatggtcggaaatgactacgattcggacatagggatagcggcttctgtcgggatggacagcatttttattaatacatttgagctctcaaaagacgagaaaaataaacggctcctcgctatgaggagccgggttggctgcacagattatgagccggtgcttactgtagatgatatcggcgggatagtttgagaaactcttaacttcagtcgattttttacgaatgcatgatatcacgggttgcagcgcttgcatgggctgtagccttggtttatcaaatcttttcttctctcttttacagtctttttgttgcgcgctgacattcgttttatcgaggaacaggacggcttgtgaaatttcttcgtgtttgtattcaaaacgtaagtgtgagtgccgctcctgctctggctgctgcggcttgtaacggtctttttcctggtagacggcgttctgccgttgtatgcggggccgcggcttgagccgtcgctgtactttatcgtaacgccgggctggacattgtagcagaagacgcagaatttaatgccgcgtcccctgtcttctatgctctgcgcctccattaaaacgccccttgctaccttgtcatttcccttgaaaacaggtgtcacgcggtaaagcacgtggctcttccggtgagagtggaggtactgtgcgactttcgtctcaaatggctccattccttcaacattcatatagcgtgttccggtgatcagatttctcctgttggcattttcgcctgtaagctgatatccgatcaggtggcagcggttataaaggtagttcccgtctatgccggcgtattttacagtatgccagccggtgggctttaccatgccgatggctccgcgtttcgcagtcggcatcaggtttgtgccgatgcaggagaccgccaaagtgcatctgccgcgggagtcgagctttccgtacttctcataggatttgcggcccttcagctcatttttgctgaaatagggcttgttcttgtggattttcacatatggactctttttgttccactttgggacgcctgcgtacttaaatcccctcggaacaggattggcttcagccgtgacagaagtctttatgccatcctgtgtacatcccgaaacaagaggcgagacgataaggagagcagctaaggctatgcctgctggaaatgtgataaatttcttgaaaaaattctttttcatctttttatcctccttctcttactatagataaatttgtcgcaaatttcaactgatagtgctaaaatagcagctatgaaaagaaaagattttgtgcagggatcgaaggattcccttgctatagtaattggatatttttccgtgagtttcacgtttggaattgtggccgcgcaggcgggtatcacgccggctgttgcgacgtttatgagccttacgaatgtgacaagtgccggacagtttgcggggcttaaccttatattcgcacaaagctcctactttgaaatgatcctcacacagctgatcataaacctgcgctacggactgatgtcactttcgctctcccagcatctcgatcagaacgcgaatacgctaaagaggcttgcgatagcttttgcaaataccgatgagatctttgcggtctcggtcagccggccgggaaaagtctcgtcttcctacatggccggccttgagatctggccggtcataagctgggcagcaggcacatttttcggtgctttcgcgaataatctgcttccggctgccgtctcatctgcccttgggatcgcgctctacggcatgtttgtagcgatagttatgccggttgcaagagagaggaagagcgtcgccggtgcggcagtctttgcagcggttctttcactcgcattccactatctgccggttttaaaaaatgtctcaagcggcttttcgataataatctgcactgtagcagcgagtgctgttgcagcccttttcttcccgatacctgaagacgacggaggtgacgcctgatgaagatttttatctatattttgctgatggcagtgacgacataccttattcggatgctgccgctggtgctctttcaaaagccgataaagagccggtttgtaaagagttttctttactatgtgccttacacctgccttactgtaatgacggtcccggcgatatttttctgtacgaaaagtgtcgttagcgcggcgataggatttgtcgtcgcactgatactcggctggaataaaaaaagccttccggtcgtcgccgccgctgcctgcgcagcagtgttcataaccgaaaggcttatataaaaggacttccttagtcctttacgatgcctgagaggtattcagtgagtgctgacatgtcgacctgagtgactacggtcttcttgtcagctgatgcgactttagcggaatcctggactttgccgtatatcgaccagccgacccagaaagccagcgcagcgcaggcgatcacgccaacgatagaagcgatgagtctgtttctcttctgctttcttactgtctctttcctgttccgcttttcctctttatgttcttcaacttttgcctgactcatgtattgatctccttagtcaaatctcaaaaaatcgtgccttttttgaaggcatccaaagtattatacaaaaatgcagagcaaaattcaagagagagcgagtggcgtgaatttttagaaaaagaggcttttttttgtaaaatgttgaaaattaatttttttgtaaaaaaagcttgactttaggtaacaattcctgtatagtatctattatcgtcgcgaggagcgaacgacagagacagatgcgatggtggcgtagttggtaacgcgcgaccttgccaaggtcgagaccgcgggttcgagtcccgtccatcgctcttttatgagaagccctgaggggcttctttttttatgctttttttgctctttttttctcaggtgatatttgttacaatagtaggaaaatattcagatggagaaaagaaagaaagagattaaatgagcagggcagacgagatttttaaaaaaatgtgccgcgatatcattgaccacggtaccgacacgagaggccaggcagtacgtccgcactggccggacggaactaaggcctatacgataaagcagtttggcgtcacaaaccgctacgatctgcgggaagagtttccggccgtgacgctgagacgaaccgcgataaagagcgctacggacgagatcctctggatctggcagaagaagtcaaataacatccatgatcttcattcccatatctgggatgagtgggccgatccggatggaagtatcggaaaagcctacggctatcagctgagaaagaaataccgctggaaagatattacagaagatggacttgtgcaggtctacggagaggattttaagccgcttgagatttcagatccatctgctgccgcggatagtgactacagagctcatgtctggaaggatgcaggtggcggtttctggatggatcaggtcgacaaagtcctctatgatctaaaggttcacccgttttcgcgcagaattatgactaatctctacgatttttcagaccttaatgagatgaacctctacccatgcgcctacagctgcacttttaatgtcacagaggaaaatggcgcaagggtccttaacatgatcttaaaccagcgctcgcaggatacacttacagcgaacaactggaatgtctgccagtacgcggtgcttctgtcgatgatcgcgagagactgcgatatgataccgggcgtgcttcttcatgtgatagctgatgcacatatttacgacaggcacgtgccgcttatagaggagcttattaaaaggccttcacatccggcgccgaagttctggctgaaccctgagaaaaaggatttttacagctttacccgtgacgacgtaaggcttgacgactatgtgacaggagagcagataaaggatattccggtggctatctgacagatagtttcggattcgaagcttttgtacagtgggaagaacttccatttttttaaaggagaatacatgaaggcaatagcagcagtagataaaaactggggcataggctatcagggcaggctccttacgagcatcccgaacgatatgcagctctttaaaaacgagacgaccggaaatgtcgtcgtgatggggcgaaagactcttgaaagttttccgggaaggcggccgctccctcacaggacaaacatagtgctcactacgtttccggattacaagagcgggaatgcgatcattgtcccgaatctgaatgaattgtttgagaccttaaaggactacgattcggataaaatatacgttatcggcggagaatccatatacagacagctcctgccgtactgcgacaaggctcttatcacaaagatcgacatggagtacgacgccgatgccttttttccaaacctcgacaaagaggataattggaaaatgaccggagagagcgaagagcagacgtattttgatctgtgctacacgtttacacagtacactaatgggaaagtaaagacatggacatcacaggaagaagactgatagttaaggccctcgcagaagagggtgtaaagaccatctttgcctatcctggcgggatgatcacagatatatgtgacgagttatataaacaggaagacaagttcaggctcgtgctgccgcgccacgaacaggctgtaatccacgaggccgaaggctacgcgagacagagcggagaagtcggagtggcgctggtcacgagtggccccggcgccacaaacacgatcaccggtatcgccgatgcccactacgattcgattccgctcgtcgtgatcacgggacaggttccacaaaatctgatcggaaacgacgccttccaggaagtcgatatcgtagggatgaccagaagtgtcgtaaagtacggcgttacagtccgcgacagaaaggacctgggacgcattttaaaaatggcattctatatcgccaagagtgggaagcctggcccggttcttatcgatattccaaaggacatccagcagaagagcgggccggatgagtaccctgaccatgtggatatcagaggctacaagccaaacacctctgtccatatagggcagctgaaacgagcctacaagacgcttaagaacgcaaaaaagccgctcattctcgcaggaggcggcatccatatttcgggtgctgaggagcttctcaccgaatttgccagaaagatgagagtcccggtcgtaacgactgtgatgggcaagggctctattcctgaggatgatccgctctacgttggaaattccggcatgcacggcaggtatgcagcgaacattgcggagatggagtgcgatgtcctcttttcgattggtacacgcttcaacgatcgcatcacaggtgatttaaatgaatttgcgccgaaggcaaagatagtccatctcgatatagacacggcttcgatctcaagaaatgtagtcgtagatgttccggtggtctcagacgcttcacttgcactttcacatttgttatcgtgggctgagcctatgaagacagatgcatggatagcccagatagccgaatggcagaaagagcatccgctccagtgcaaagtctctaagggtataaatccacagaccgtgatggaagatatctcggatatatttggtgaagccacctatgtggcagatgtcggacagcaccagatgtgggcaacacagtttttaaagctaaaggtcaattcaaagctgataacctccggaggcttgggcacgatgggatttggatttccggcagcgataggagccaaagaggccgaccacgacaggcttgtcgtatgccttacgggtgacggcggttttcagatgaatatggcggagatggcgacatcaatctgcgccgatatcccggttacgatctgcctttttaacaacagataccttggtatggtaagacagcagcagcaatatttctatggaaagaggtatgagcttacttaccttggcaggagagcggctgataatgagcaccccgacaggcttgaaaatgcggatgaactgtatgttccggattatatgaagcttgccggtgcgtacggcatcgatggagtccgtgtcagaacggaagatgagatcgcagcagcccttgaaaaggctaaagagtaccagcttgacaacaagtcatttatcatagaatttctgatcgcaccggaggacgtcgtgcttcctatggtcaagggcggtatggcaaattcggatatgattctcaaatgatcgaaggggaaacaggacatgacagaaatgaaaaacagatggatcgcactatatgtagaaaaccaggtcggtgtcttggcaaaggtctcgggacttttttccggaaagagctataaccttcagagccttaccgtcggcacgacagagcatgaggatgtctcgaggatgactataagcgtaaatgccgatgacatcacgttcgagcagataaaaaagcagctgaatacgatggtcgaggtcataaaggtaatagacctgaccgacgcccctctccacagcaaagagatcctctatgccaaaatacacgacatagatgcagcaggaaaggaagaggcttttcgaatcgcccaggtctttaagatccgcgtcatcgatatcggcgaggactcctgcctcttagagagcgctcttacagagagaagaaataacgaactgactaagcttttgaagaagacgttccaccggatcgagatcgtccgcggcggtccggtcgctatagaaagcatcagtacgtcctgcagatgacctgcagagccaaaaagagatttaaaacttaacaattttgtattcatgtaactaaaatgaaaaagttcttgaataagccgttcgcatgtggtaaagtagttattgtattagagagccgatgcggcggctatatttttttagaaaagattgttaaatttttaacagactttttacattagtatgtaaagtgtaaggaatccgcattttccttaaataatatgcatgtggcgcttaggcgccggaaggagacgtgacatggcaggaagaatagttctggcaggagcatgccgtacagcaatcggaaagatgggcggagagctctccaccgtatcagcagttgacatgggtgccactgttgtaaaggaagctttaaagcgtgcaaatgtaccggcagatcaggttgatgaggtaaagttcggctgcgttatccaggcaggtcttggacagaacgttgccagacaggtatcaataaaggcaggacttccagtagaggttccggcaatcactcttaacgcagtttgcggatcaggtctgaagtgcgttaacgaggctgcaaacatgatcatggctggtcaggcagacatcgtagttgcaggtggaacagagtctatgtcacgtgcaccgttcgcacttgagaaggcacgttttggatatcgtatgaacaacggtgtcctcgtagatacaatgatcaaggatgccctttgggatgcattcaaccagtaccacatgatggttactgcagagaacgttgcaaagcagtggcacctgacacgtcaggagctcgatgagttctcagccaattcacagcagaagtgtgagaaggccatgaaggaaggcaagttcaaggatgagatcgttcctatcacgattcacgatcgtaagaagggcgacatcatcgttgacacagacgagggcccacgtcctggtactacagttgagacactttctaagcttaagtgctgctctggtgttgagggtggtcttgttacagctggtaacgcttcaggaatcaacgatggtgcagcagcagtcgttcttatgacagaggagaaggctaaggagctcggcgttaagcctatggcttacttcgttggcggcgctatgggcggcgtagatccgaagatcatgggtgttggacctgttgcagctgttaagaacgttatgaagagaactggtctttcagttgacgatatggatcttatcgaggcaaacgaggcattcgcagctcagtcatgcgcagttgccaaggagcttcacttcgatatgtcaaaggtaaatgtaaacggtggtgctatcgcacttggacacccggtaggtgcttcaggatgccgtatccttgttacacttcttcatgagatggagaagagagatgctaagaagggtctcgctacactctgcatcggcggcggcatgggctgcgctacaatcgtagagagagactgaccgaaagcacagagatgagagcgagccgataggcgaagctcgagtcctgtgcgaggtcgttcttcgagattggcaagcacgagtcgaagacgaagtgcgagcctagcgagaagaacttccttgcacgaaagcacagagatgagagcgagccgataggcgaagctcgagtcctgtgcgaggtcgttctctaatcttagtgagcgcaagccaaaggcgccgcgcgaacttagcgaagagaacttccttattatttagcttgtaaccaggcttgtctgagcattacacaagcctggcattcaataaaatttttacaggaggataacaaatgaaggttgcagtaatcggtgctggaacaatgggctcaggaatcgcccagacatttgcacagtgtgatgaagtggagacagtttatctctgcgacattaaagaggagttcgcagagggcggacttggcaaagttaagaagaatcttgacaagcttgtaagcaagggcaagatggatcaggctaaagcagattcaatcattgcaaagttcaagactggtcttaacactatcgcagttgatcctgatctcgtagtagaggctgctcttgaggttatggacatcaagaagaactgcttcaaggatcttgaagagaatatcgttaagaatcctaactgcattttcgcatcaaatacatcatccctttctatcacagagattggtgctggtctgaagactccagttatcggaatgcacttcttcaatccggctcctgttatgaagcttatcgaggttatcaagggtgcaaacacacctgacgagacagttgagaaggttgaggagatcgcaagaaagcttggaaagacacctgtacgtgttcaggagtcagctggtttcgttgcaaaccgtatccttatcccaatgatcaacgaaggaattttcgtatattcagagggcgttgcagacatcgagggcgttgataacgctatgaagcttggatgcaatcacccgatgggaccacttgagctcggcgattacatcggacttgatatcgttcttgctatcatgaacgttctctacacagagacagcagattccaagtatcgtccggctccacttcttaagaagatggttcgtgcaggacatctcggagttaagagcggcagaggtttctacgactattcacagggctttaagaataaggtacctgtagacaagaagaactgaccgaaagctttgagatgagaacaagcgtagcgtagttcgaatccaaagcgaggtcgttattcacgattagcgaaagcaagccgaaggcgcagcttgagcttagcgtgaataacttccttgttaggcacgctgttcaaatattaatattggaggaaaattagatccatggattttattatagataaaaagcatgagatggctcgttccctcttcgctgattttgctcagaaagaggtaaagccactcgcacaggaaatcgatgagacagaggagttcccaagagctaccgttgagaagatggcaaagtacggcttcatgggaatcgctgttccaaaggagtatggcggacagggatgcgatcctctgacatacgttatgtgtgttgaggagctcgcaaaggtctgcggtactacagccgttatcgtttcagcacattcttcactctgctgcgatcctatcatgaactatggtacagaagagcagaagcagaagtacttagtacctcttgcaaagggcgagaagctcggagctttcgctctcacagagccaggagctggtacagatgcacagggagctcagactaaggctgttctcgatgagagcacaaacgagtgggtacttaacggatccaagtgcttcatcacaaacggtaaagaggctgatatctacgtaatcatcgctgtaacagatatcacaacagataagaagggccgtcctaagaagaacttctcagcattcatcgttgagaagggaactcctggattcacattcggaaccaaggagaagaagatgggtatccgcgcttcatctacatacgagcttattttccaggattgccgtatcccggctgagaaccttctcggtgtaagaggcaagggcttccaggaagctatgcacaccctcgatggcggacgtatcggaatcgcagctcaggctcttggacttggtgagggcgctatcgaccgcacgatcgagttcgttaaagagagaaagcagttcggtcgttcgatcgcagctttccagaacactcagttccagcttgctgatatggctacacgtatgcaggcagctcagtacctcgtatatgcagcagctgaggctaagaagaacaagcctagattctcagtagaagctgcagaggctaagcttttcgcagcagaagcagctatggctgttactacaaaggctgtacagcttcatggtggctatggttacactcgtgagtacgatgtagagcgtatgatgcgtgatgcaaagatcacagagatctacgaaggcacatcagaagttcagagaatggttatttcaggaaacttattaaaataattttccggttatttttcaaaaatatcctgaaatatttgattacataaaggagcaaagtaaaatacatgaaaattgtagtatgtattaaacaggttccggataccaagggcggagttgtatttaacccggacggaactcttaaccgtgcagcaatgcttacgatcatgaaccctgatgataaggctggtcttgaggctgcacttcgtatcaaggaagctcatcctggcacaactgttacagttcttacaatgggtcttccaaaggctgaggatgttctcttagaggctatggctatgggagctgatgacggtgttcttgttactgaccgtgtactcggtggcgctgatacctgggctacttccacaaccatcgcaggcgctctcagaaatattgactatgatcttatcatcacaggccgtcaggctatcgatggtgatacagctcaggttggacctcagatcgctgagcatcttggaatcccggttatttcctatgccgaggatatcaaggttgacgaggcagcaaagactgttgaagtaaagagacagtacgacgacagatatcacatcttaaaggctaatatgccatgccttgttactgcacttgcagagctttctaaagagcctatgtacatgacaccaggcggaatcttcgatgctgttgaccagaaggcagacagaatcacagtctggggccgtaaggacttaaaggatgttgacgataaggaccttggtcttaaaggttcaccgacaaagatcgctaaggcttctgataaggttcgtaagggagcaggagaaaaggttagccttgaccctcaggcttctgtagaatacatcatgggcaagctcaacgagaagcatttaatctgaccgaaagaatggagatgagaacgggcgcagcgaagttcgaatcccattcgaggccgttctttgagattagtgagaacaagcgaaaatgcagttcgagcttagcgaaaagaacttcattaaataaacaagaaagcaggtaaaaaatggctttagaagattataaaggagtatttacctatgctcagcaggtagacggagagctttcttctatctctcttgagcttattggtaaaggaaaagaattagcagacgcattaggagagcaggtaactgcagtccttatcggatccaagatcgaaggtcttgctgacagacttggtgagtacggtgctgaccgtgtaatcattgttgacgatccattacttgagacatatcgtacagagcagtacgcacaggctcttgcaggagttatcaatgagtacaagccagagatcatgctcgtaggcgctacagcaatcggacgtgaccttggtcctacagtttcagctcgtgtagctacaggtcttactgcagactgcacaaagctcgatatcggcgacttcccacttcagccacaggctggtgttgagcagcttcacaatcagctgcttatgactcgtcctgcattcggtggtaacactatcgctactatcgcctgcccgaacaaccgtcctcagatggctacagttcgtcctggtgttatgcagaagcttgagccggttgctggcagaaagccggagatcatcaaggcagacatcaagatcacagagaacagcaagtctgtaactgttgagaaggtagttaaggatgtagctaaggttgcaaacatcatggacgcaaagatccttgtatctggcggacgtggagttggctcacctgagaacttcaagctccttgatgaccttgcagcagcacttggaaagggagctatggtttcctgctcacgtgccgttgtagattcaggctggaagccaaaggaccttcaggtaggacagactggtaagactgttcgtcctaacatctacttcgctatcggcatttcaggagccatccagcacgtagccggcatggaggattcagatgttatcatcgccatcaacaaggacgagggtgcaccgatcttcgacgtagcagattacggcttagttggtgacttaaacaagatcgttccactccttacaaaggctataaaggagcagaaggctaaggaagcagaggcttaatttaaagccgctgttattgaaacactggcaggtccggattatttccggatctgctttttttataaaaaatgtgacatttttactgtgttgtggtaatattttaagcagcttaacattctgaaaatgtatgtaaaagtaatatttttataaaaaccttaatactcaggaggcaaaatgagcaaagaaaagagccaggaagagatcgacgcggaagttgcgcagttcaaaaaggacctcgggataaaggaaaacaaacaggctgagcctgattttcacgaggatctgaacaaatactcttctataaagcatgtaattggcgttataagcggcaagggcggcgttggaaagagcttcgtcaccggacagctcgcatcgatgatggtgcgcgccggatacaaggtcggaattctcgatgcggatatcacagggccttcgattccaaagatgtacggtgtacacggacctgcatacggggatgacagaggatcttatcctatcgaggcatctgatggcacgaagatcatgtcgataaacctgctccttgacgatgaggaggctccggtcatctggagaggaccagtcattgctaatgcagtaaagcagttctggacggacattgtctggggagatctggactatctttttgtcgatatgccgccaggcacaggagacgtgccgctcacagtcttccagtcgcttccggtggacggcgttatcatcgttacaagcccgcaggatcttgtaagccttatcgtaaagaaggcctacaacatggcatcgatgatgaatgttccggtctttggaattgtcgagaactacagttacatgaagtgcccgcactgcggagagaagatttctgtatttggagagagccagatagattcagtggcgcagtcgcttggccttccggtacttggacgtctcccgatcgatccggagtacgccagaaaggaagacgagggaaagtgctatgagatacaggcaccatttgagccgatcacacagagaatgcttgaagcacttggctaaaaattattaaggcagccctttggggctgctttttttgtcaaaaaaataattgtaattttctcgcaaagctggtattatcagattatatattaaatctttatttaactctaaaagaaaggagcagcttatgtacgaacaggtaaaactgagttacggttttgatgagttagagccggctatcgacacgcttactatggagacacattatggcaagcaccacgccacttacacaaagactttgaacgatctggctgataaggcgggggttgccgggatgccgattgaggaacttctttcggatctttcagtcgtaagcgacgattcgctgaggaatgcgataaagaataacggtggcggattctacaaccataacctttatttttcagaactgtccccaaagccagctgagccatccggcgctcttcttgcgaaaataaacgaaacctttggaagtgtagacgaactcaaggcgcagcttaagatggctgctttaggtcagttcggttccggctgggcatggcttaatgctgacaaagttgggaatttaagcattacaaagagcccgaaccaggacaacccattcagtgaaggcctcgatgtaaagcctatactcgcactcgatgtctgggagcatgcttactatctgaagtacaagaacttgagagctgattatatcgacgctttctttaaagtgcttgattgggatgttgtcgcagagaattatgaacaggcgatgaaataaaagcctgatgtgagttcttttcatattttattcaggagaccgtggcttatgccacggttttttgtttataattttttgtttataattttaatatacaaaattattacgtattattaaaatatttaaattctgaccagattataaactatttttaataaatctttaatcggcgcttaattgaattgtgccctgactgtgagtatcattttatacaaagcacaactgctaattcagtggtgtggacagacgcgtcttatacatttcggttacaaactattttccaggcattgaaagggggacttataatgcaagaacaagaaaatcattgtagcgataagatacaatgtaattaaaggttcaagtaggctgaacgcctaagaaacaggcacttctcggaagtaggagcttccggggagtgcctgtttttatgctcatctgagctcgatggcagtggtttgatacgaaattcgctcggtaaggttcaccctgttacttaatgctgtaccgttgttactatttattttctttatgaagtagtataataaaatatctttaatatttacgaggtcaattatttatgaagaagacaagtaagatttgttgccataatagcatttgctttattaacgataacttttacaccagtcatacatatgaatcagctgttgtagctgaggctgctacgaaggtcggaaagatcacaggcctttctaattggaaggaggttgaactgtatggtgatggtgacggtgttgactaccgtataacctggaagaaggtcaagggagtcacagggtatcaggtaaaagaatatgaaaaagaggatccatcagagaaatggtggagtcagactgttaatacaaagaggacaagatagatgtgcagttttcttcttgtatgcattccaggcaaaggtaagagcctataagactgttaatggcaaaacatattatggtccatggagcaaaaatagtcaaaaaaaactgtctactaagatgttaatcaaaaggagaaaaatgaaacgtgtattgcatcactgcttattgcagcaatggtaacaactcagattgttgggatatctgttccgacctttgccgaagagatatcacagacagaacatgcacaagagtctcagatcagaatgttgagcttaaggatagtgttataaggcataaaaaggtcttgaagtcacctgcaaagtatataaaaaatactatggctgtaaagaagagaaagttcacatatgctcttattgatatggataagagcggaataccatgccttgtgatgaaacaggcggacttgatgaagctggatatagtactataaatgatattgatatattcaagtattcaaaacaaagaataaggctgttcatataaaaggaaggcttaacgaaggcatgggttccgcaggaggctacagaggcgagcagataaggaaaaaaatggtgtaggtatatcggtaaacagagtacaatgcgggtaatggagactttacagtgactgtatccacagtaaagggttcaaagttgtatcaaaggtggttgacagaggaagtcttgcggacgacgatgttgcgggaggaccagaaacagaaaaaataaagtggataaggtgaagtctttaaataccttgaacaatatcaatataaagattaaaaagagagggctttctgcgaggtactacaccttgcaggaagccttttttatttccgggagagccttcggaggtctgccggaatgactatcggggagagggggtgcatactattcaacgattactttttgactttgacatggatattgtcagtcttggtatctccaaactgcaacttgaagtccagggtctgacctgtgacggcttgctgatgctgacatatccatgtcaaagtcaaaaagtaatcgttgaatagtatgcaccccctctccccgatagtcattccggcagacctcgaaggtctcccggaaaaaaaaaaggcttcctgcaaggtgtagtacctcgcagagaagcctctcttttaatcttttatattgatattgttcaaggtatttaaagactttaccttatgccactttatttttctgttttggtcctcccgcaacatcgtcgtcgcaagacttcctctgtcaaccacctttgatacaagctttgaacccttaatgtggatacagtactgtaaagtctccattacccgcattgtactctgttaccgatatacctacaccattttttaccttatctgctccgcctctgtagcctcctgcggaacccatgccttcgttaagccttccttttatatgaacagccttatctttgtttttgaatacttgaatatatcacaatttatagtactatatccagctcatcaagtccgcctgtttattcacaaggcatggtattccgctcttatccatatcaataagagcatatgtgaactttctcttctttacagccatagtatctttattactttgcaggtgacttcaagacctttttatatcctttataaaactatccttagatcaacattctgatctgagacatcttgtgcatgttctgtcgtgatatctcttcggcaaaggtcggaacagaatcccaacaatctgagttgttaccattgctgcaataagcagtgatgcaaatacacgttcattttttctccttttgattaacatcttagtagacagtttttttgactattttgctctaggaccataatatgttttgccattaacagtctataggctcttacctttgcctggaatgcatacagagaagaaaactgcacatcatatcttgtccttttgtattaacagtctgactccaccatttctctgatggatcctctttttcatattcttttacctgataccctgtgactcccttgaccttcttccaggttatacggtagtcaacaccgtcaccatcaccatacagttcaacctccttccaattagaaaggcctgtgatctttccgaccttcgtagcagcctcagctacaacaggctgattcatagtatgaaggtgtaaaagttatcgttaataaagcaaatgctatatggcaaacaaaatcttacttgtcttttcataataattgaactcgtaaatattaaagatatttttatataatacttctataaagaaaaataaatagtaacaacggtacagcattaagtaacaagggtgaaccttaccgaggaatttcgtatcaaaccactgccatcgagctcagatgagcataaaaacaggactccccggaagctcctacttccgagaagtgcctgtttcttaggcgttcagcctacttgaacctttaattacattgtatcttatccgctacaatgatttcttgcattataagtccccctttcaatgcctggaaaatagtttgtaaccgaaatgtataagacgcgtctgtccacaccactgaattgcagttgtgctttgtataaaatgatactcacagtcagggcacaattcaattaagcgccgattaaagatttattaaaaatagtttataatctggtcagaatttaaatattttaataatacgtaataattttgtatattaaaattataaaaaaaattataaacaaaaaaaccgtggcataagccacggtctctcgaataaaatatgaaaagaactccatacggcttttaatcgcctgttcataattctctgcgacaacatccaatcaagcactttaaagaaagcgtgatataatcagctctcaagttcttgtacttcagatagtaagcatgctcccagacatcgagtgcgagtataggctttacatcgaggccttcactgaatgggttgtcctggttcgggctctttgtaatgcttaaattcccaactttgtcagcattaagccatgccagccgaaccgaactgacaaagcagccatcttaagctgcgccttgagttcgtctacacttccaaaggtttcgtttattttcgcaagaagagcgccggatggctcagctggctttggggacagttctgaaaaataaaggttatggttgtagaaaccgccaccgttattctatcgcattcctcagcgaatcgtcgcttacgactgaaagatccgaaagaagttcctcaatcggcatcccggcaaccccgccttatcagccagatcgttcaaagtctttgtgtaagtggcgtggtgcttgccataatgtgtctccatagtaagcgtgtcgatagccggctctaactcatcaaaaccgtaactcagttttacctgttttacataagctgctcctttcttttagagttaaataaagatttaatatataatctgataataccagctttgcgagaaaattacaattatttttttgacaaaaaaagcagccccaaagggctgcttaataatttttagccaagtgcttcaagcattctctgtgtgatcggctcaaatggtgcctgtatctcatagcactttccctcgtcttcctttctggcgtactccggatcgatcgggagacgtccaagtaccggaaggccaagcgactgcgccactgaatctatcggctctctccaaatacagaaatcttctctccgcagtgcgggcacttcatgtaactgtagttctcgaccattccaaagaccggaacattcatcatcgatgcatgttgtaggccttctttacgataaggacagatcctgcgggcttgtaacgatgataacgccgtccaccggaagcgactggaagactgtgagcggcacgtctcctgtgcctgggggcatatcgacaaaaagatagtccagatctccccagacaatgtccgtccagaactgctttactgcattagcaagactggtcctctccagatgacggagcctcctcatcgtcaaggagcaggtttatcgacatgatcttcgtgccatcagatgcctcgataggataagatcctctgtcatccccgtatgcaggtccgtgtacaagtacatctttggaatcgaaggccctgtgatatccgcatcgagaattcgacttgtatccggcgcgaccacctcatcgatgcgagctgtccggtgacgaagctctttccaacgccgcccttgccgcttataacgccaattacatgctttaagaagaggatttgttcagatcctcgtgaaaatcaggctcagcctgtttgttttctttatcccgaggtcctttttgaactgcgcaacttccgcgtcgatctcttcctggctcttttctttgctcattttgcctctgagtattaaggtttttataaaaatattacttttacatacattttcagaatgttaagctgcttaaaatattaccacaacacagtaaaaatgtcacattttttataaaaaagcagatccggaaaataaccggacctccagtgtttcaataacagcggctttaaattaagctctgcttccttagccttctgccctttatagcctttgtaaag

SEQ ID NO: 10 - DNA, 87302 bp, Unknown
  Metagenome-assembled genome
gcgcaaaaaaatcacccgaacaacgacaaggttgccgtggaatcgatgtgagaagccgtacacctatttcaaagcttgaaaatatcctcgatgagctcgaaggcgatggcaaaaaagtccagatactttcctggatgctgatgacgacacacttgtgaagcgattcaaagaggagagaggacgccgccgcttgccgatggtggacggactatagacgcgatccacagagaacgggacgagatggcctttttaaaaaaacgggccgattatatagtcgatacatcgcatcttcttgtcagggatctgcgcgctgaacttacaaaaattttcgaagagggcaccaactacaagaacctgaatatcacgatactctcatttggcttcaaatacggtattccgacagagtgcgatctggtcttcgatgtcagatttctcccgaatcctactatgtcgacagtctaaggcacaagaccggaaacgaccaggagatcgtcgattatgtcatgaattcagacgtgtcgcataagtttatagacaaactcacggacctgatcacttttcttatacctgaatacataaaagagggaaagaacgagcttgtgatctgcattggatgtaccggcggcagacaccgctcggtcactgtagccagagagctttaccacgcactggcaaagcacgatggcgactacggatccgcattgaacacagagatatagacaaggataatatgtttttcatccgatgtaaaggatgagcttcgaagtttatcccaaagccaggcactgccagatcgcagaggcagcggctgtgacatctgtcatagcgaaggctggcactggcgaatatgccgtcaggctggaaactgaaaataaaaacttataaaaaagtactttactttattattgcaaacgattaatataaaaaagatgtctccgatgagctggactctgtggacggcaggaaactacgggaacttttgaaaataaatggcgatgactttacgacacgaatcctgtgatcttagaacaggattgctgcaggaggtcattttgcgggggatttttctttgtctgggtctgtaagcgatcgaacaagtctaccattcgagatcgtctgccacacaatgcggcaggcagagctcgtgcagggacttatatcggattatgactgtgtcctcatatagtagagagaaaagggcacttcgtgtagattgaaagaggctcgcagattataaatatgcttggcatcataggtgcaccgaaggctttcatggattttgaaaattcaggatcttaaaagagatgcgtgaaaacgtcaaccggcaggtgaactgtgagactcaaacatccgcaagtctgtttcagccgcagtcagacaaattgaagacattcgctttcttcaggagagcggacattttgcggagctggggccggcttgcaggaggccgcaaaactgggcttgagaacccggagatgccactttacgaactggggcagaaatgctcactccggtgggaagagcggcataaccacaggctcagaaaaatcggacagttggcttatgatattaaacatcaggaggacaccacatgaaaaaaaatgtcaccatcaaaatgcgtgagacaatggaggcaactcctattgctcattggtgcagctggctaatcagttccagagccaggtgtatattgagaaggacactaagaaggtaaacgcgaagagcatcatggggatgatgagcctcgtgcttacaagaggtactgaagtgacaatagatgctcagggcgacgacgagggaaggcagtctagccattgaggattttctcaccaaataagaccggggtatttttcatggggaaaaaacttctgtttatctacaatccacattcaggacgcggcatggtcaaggtacacctgtccgatcattgagaccatggtgcgagccggatatgaggttgtagtttatcctacgcagcatccgaaagatgcagagcagaaggcaaaagaatacggtggttcattgacaggatcgtagtcagtggaggagacggtacgctggacgaggtcgtctcaggtctgatgtctctcgagaacagatgcgctgtaggctatattccggcaggcagcacgaacgattacgcagcgtcactcggactcgagtcggatgctcaaggcttccgatacggcagtcaatggaactccgacaaaagtcgatgtcggcagtttcgcggacaggtatttcgtgtatgtggcggctttcggcatttttacagagacgagctacatacgagccagcagctgaagaacgtttgggacatgcggcctatgttctttcggcattcaaacagctcaaagacataccatcgtacaggatgcaggtcgaatacgacgggaacgtgctctacgatgaatttatctatgggatggtcacaaatactgtctctgtaggaggcatgaagggctgatctcaggcgaggttgacttaagtgacggactttttgaagtgactctcgtaaggacaccgaagaatcctatcgatctgagccagttgtgtcttctttacgggggtggatacggatacagacatggtgacttcttttcagacaagcagggtgaatttactgctgctgaggagataccgtggactttggacggagaatatggcggcagactgaagagtagatattaaggtgctgaatggtgccataagtatcgtcagctgaaaataaggttgaacgaatccggctaatggggtataatgctttttggtgtttaaaaaccaatacatgaaacggaggatacgtacatgttagttaatgcagcagagatgctcaaagaggccaagaaaggccactatgcagtaggacatttcaacatcaataacctcgagtggacgaagtcaatccttcttaccgctgaggagctcaagagccctgttattctcgggtttccgagggcgcaggcaagtatatggctggatttgatacagttgcagctatggttaaggctatggataagagccttggaatcacagttcctgtagctcttcatcttgatcatggtacatacgaaggctgctacaagtgtattaaggcaggcttcacttctatcattgacgatggttcaatgatgacatcgagacgatgttaatcatacaaggagctcgttgctatagctcatcatcttggcctgtctatcgaggctgaggtcggcggaatcgggcgaggaagacggcgtcgtatctatgggcgagtgcgctgatccggaggagtgcgagagaatcgcaaacctggagttgatatgctcgcagcaggctcggcaacattcacggtgtttacccagagaactggccgggactcgtttcgacgttcttgacgctatccagcagaagacaggagtatgcctctggttcttccacggcggcacaggaattcctgacgacatggtaaagaaggccatcactctcggtgtttcaaaggttaacgttaacactgagtgccagctcgtatttgctgaggctacacgcagtacatcgaggcaggcaaggataaggaaggcaaggcttcgatcctcgtaagcttctcgcacctggtgctgaggcatcaagggcaaggtaaaggaaaagatggagctcttcggttctgttggaaaggcctgaataataatcagtttacaccggcgcgctggacttcggtccaccgcgctttttgtgggacaaaagggacggttctttttgtcccgccaggtggtttatttggcgggaaataggtataataggttataactgagagaaaatgtttctcagaattatatctttaaggaggaaaagacgaatgaaaaatgtcaaaaggttacttgccatcgcgatggcaacagctactgtagtcacagcagcacctggggcggtttttgctcttgcagcagattctgcaacaacttctgctgcagctactacgccttcggcgacgagcacgactaaggttacatacactgtcgatgatgaagaagtcacagctgatactgatgccaagaagaacccggcattaaagcttaatacagtgaccgatgctggaaagactgctgcgataactgtatctggtaccacagaaaaagtttatgttataccagaggatacttcggttgtaaaagctgacgtaaaggatcagactgttacagtcacagcacagaaggcaggcaagacaagcatcaaagttacagtaggcaaggaggagttcactgttccagtagagattgctgatactgtatctgataatgtcaagacacagattgatggtgaggattctgatactgtaacacttgaccaggatacttcaacagctgtaaatgccaggaagacagcaaagatcgccggaacatcagaacttggacttgctgtaaattatgacctttacacttcaaaggatgacaagggtcttgtcagcggcaacaaaaatgatgtcgtttcacttgcttctgatggcacacttacagccggaaagcaggacggaacggtttatgttaaggtctatacaaatgacaataacggcaaacagatgaagggggcttctgcctgggttactgttactgttgcaaaacttccagaggccaacatcacatttaagcagaaatcgataacacttgatgtaaaggacaataagactgcagacctgacaaaggtagttacattaccagaaggtacaaaggctgagtacgagatcactgctaataacgacacagagaataagaatgctgcagtagttaaagacaatactcttacagctaagcaggtgggtaatgccactctcaaggtaacagtcaagggagacgacaaggttcgctatactgtaaagaaattaccagtcaaggtattagatgagataccggctccggcaaaggtggcttcagatcttaaaacagctaaggaaatcgtaactgtaaaagtaggaaagacagttgatatcaaggctacaacaaaatcgactaagattacatacacatcaaaagataagaagattgctaccgttgacaagaaaggcaaggtcaaaggcgtaaaggcgggctacgtagtagtaaatattaaggctgacgcaacagatacgatggaagcgggtgcagctaaggtatttgtagtagtcgagagcgctcctaagaagcctgcaaagaaagtcacagttgcgaaagtttcaagtgttaagattacaggccgtaagaagaattcgaagtcattaaaggtttcatggaagaaacttagtggcacaggatacacatacgaggtccagaatagaactgttacagtaacgaaggtaaagaccggaaaaggcaagaaggcaaagatcaagacagttaccaaatacggtaagtgggcatctaagaaagtaacaagtgccagcgctactatcagtatttccaagacaagcaggtatcagattcgtgtcagagccgcaaagagcggtaagaacggagcctggtcaagtacagttacatcgatcagacctaataagtgattttttgaattgctgatatttgctcattaggtggggcggtcctttcgaaggagggggccgctccttttttgttaaaatctgacagttttaagagaccggcccatatgaaacatctacttgcattttaggctctaagcatataaaatattaaggataatggctgattgaaagggcattttatattttgccagaagcctggatcaaaggataaaggagacataaaatgaagcttgcaaagacatatgatcctaaggaaatcgaggatcggctctacaaaaaatgggaggacaacggctacttccatgcgaaggttgataagaggaagaagccttttacgatcgtgatgccgcctccgaatatcaccggaaagcttcacatgggacatgctctcgacaatacgatgcaggatatcctgatcagattcaagagaatgcagggctacgaggctctctggcagcctggcacagaccatgcggccattgccactgaggtcaaggttacgaatgcgctcaaggaaaagggcatagataagagaaagatcggcagagaggcatttcttgactactgctggaagtggagagaggagtacggaaggactatcatcacccagctgaagaagctcggaagctcagctgactgggaacgtgagagattcacgatggatgagggatgctctaaggccgttgaggaagttttcgtaaagctctatcagaagggctatatctacaagggttcgaggatcatcaactggtgtcctaagtgccagacatctctttcggatgccgaggttgagcatgtggaccaggatggatttttctggcatatcaattacccggtaaagggtgagcctggcagatttgttgagatcgccactacccgtcctgagacgcttataggagatacagcagtagctgttaaccctgacgacgagagatacaaggatatcgtcggtaagacgcttcttctgcctcttacggacagagagattcctgttatcgctgatgcttatgttgacaaggagttcggaaccggctgcgttaagatcacaccggctcacgaccctaacgattttgaagtcggaaagagacacaacctcgaagagatcaatattttaaatgatgacggcactatgaatgacaagtgcggcaggtacgcaggcatggaccgctatgaggccagaaaggccatggtagctgatctcgataagctgggcctccttgtaaaagtcgttccgcatacacacgccgtaggaactcatgacagatgccatacgacagtagagccgatggtaaagccacagtggttcgtacgcatgaaggagatgggagaggccgctctcgaggctggcagaaagggcgacgtcaagttcgttcctgacaactatatcaagacatacgagcactggctcacaggaatcaaggactggtgcatcagccgtcagctctggtggggacacaggatcccggcttactattgtgacgactgcggggagatggtcgtacagaagggcggtgcgccaaaggtctgcccgaagtgtggcggaaagcattttacacaggatccagatacactcgatacctggttctcatctgcactctggccattctcgacacttggctggcctgagaagactccggagtacgagtatttttacccgacggatgtactcgttacaggctacgatatcatcttcttctgggttataaggatggtattctcagccttagagcagactggaaaggctccgttccaccatgtactgatccacggacttgtcagagatgaacagggcagaaagatgtcgaagtcgctcggcaacggaatcgatcctctcgatgtcatcgacaagtacggcgcagatgcattaagacttactcttatgactggaaatgcccctggaaacgacatgagattctactgggacagagtcgagaattcgaggaacttcgcgaataaggtttggaacgcatcgagatttatccagatgaatctcgatggcttcaatcttcacgacccggagaacaaggacttccgcacagaggacaaggctataatttcgctggtgaacacccttgtaaaggatgtcactgacaacatggaaaaatacgagctcggcgttgcagtcggcaaggttttcgattttatctgggacgagttctgcgactggtacattgagatggttaagccaaggatttacgccagggatacggatccgaagtcagctaacgcagcacttttcacactgaagaatgtgctctcgatttcactgaagcttttgcatccatatatgccgtttatcacagaggaaatctactgttctcttaatccttgtgaagatacgatcatgacgtcaggctggccgctctaccagaaggcagcacacgatgagaaagcagaggagatctactctagagtcaaggaactggtaaagggcatgcgcgctgtcagaaaggatatgaacgtacctaattcgaagaaggcaacgctttatatcgtatctgagaagaaggctgtccgcgatattttcgaggagaacacatctctgtaccagacgctttgctcagcaaatgccgtcaaagttcagaaggacaacaagggaatcgacgagaagagcgtctcatttgtgatcacagatgcgacctgctttgttccactcgcagagcttgtagatatggacaaggagcgcgagagacttcagaaggagcagaagcgtctggagggcgagctcaagagatcgaacggaatgctttcgaatcagaaattcctgtcgaaggctccagccgcaaaggttgaagaggagaaggctaagctcgccaagtatcagcagatgatggcagatgttaagaagagactttcagagctctgattataggaaaatatgattgattttgacgaagaattaaagaatttcaaaccaagcatggagacaagcgaggctgaggatgccatccgcgacaaggacttgactgacatgatcgatattttgaaggagatcacagccagccagtcgacagtcatcaggcagagcgcggcagtggcagctgcagccaagcaaaacaggaagtgaccggatggagaagtgctttaactgcggaaatccgattggtgaggacgagaggacctgcaggttctgcggtgcgaaccagagagcctacaggatgatcatggcctcgtcagagaaggcctacaatgatggtctggccaaggccagagaccacgacatctccggcgctatagagagcctcaaccgttcggtccgcttcaacaaaagaaacaccaaggccagagatctgctcggtctcgtatatctgagatacggtgagccggtgcttgcactccgggaatgggtcatcgcgaagaactttgatccggacgatgagcttgcgaacagatatctggacagtgccagcagcaaccctggtgcatttgagaaaattgacacagctgcgaaaaaattcaacaccgcatataaatatgcgagagccaaggcatttgaccttgctgctctggaacttaaaaatgtcgtcagagaaaatcctgatatggtaaaggccagacagcttctggcactgatctatatgcaggaaggtgagtattccaaggcttattcagagcttaaggcagcgaaagaggacgatgagaacaatcctctgacagtcagatatctgaaagaagtccgctcccacctggtttctggcaagaaaaaaaagaagaaaaagaccgaccggcgttcgaccgtatctattaatgatggacatgatgtcgtaatgatgccgaggcagtcattcattgaagctttagacaactccaagagcggcctgttcaatatccttataggtattgctataggaatcctggcgttcgttttcctcgtctcaccgactatgaagcagagagaaaacgaagagacaaggaaagcgcttataaccgcgaattcgacgaccgcttcctctaagagtgatgcggctgacttgaagaagcagataacaagccttcagaataagcttgacaagtacgagggaaagtcagatgtcaagggctcatacgagaacctgataaaggctcagcaacaggctaccggagataaagcagacctcgatgctgccagaaagaccttgaaagaggcaaataaaaagcttctcggcacgagtggaaaagatctgtataagtcgcttacggcacagattgaccagcagactctgactacgaagtacgacgaaggtaaaaacgcattcaggcagagagactacgacaaagcgatagatgctttaaagactgttgtaaagattgacgatacttatgataacggcgaggctgtgtacgagctggcccagtcatatgagtataagggtgataccaagaatgccctgaagtactatcagaaggtagcgaaagattatgcgcagttctaccgtggcagaagttccgcgagaaaggtacagcagctgcagcaggctcagcagaaccagcaggctcagacaaacggctgatgccgacatctttattaataacatttcagacataaaaataccgggacatcgagttgtcccggtattttttgtcctaattattttgagagaactttcttcaggtttttcatctctgccttacctgcgctcttgttcaggaactgcgctgagaacagtgaaaatccctcacagccggctttcttcagctctttatactgacttgcaatatttgacttgctcttagaccagccgtagtctgtccatttgctgctttgatttggcttctcgcctgatctgtaaagagctaatgcgacgtatttcatcctgccgttcttattgagtgaagattttctgaactgcttgagccgattcgagaacatcttcgtgtgactgctgccccaattgttggaccagtagatctgtggcatcaggtagtcgatatatccgtttttcgaaagccaggtgtcgatatcagcacccagggcacgatcattttcgagatttccctgaggagctatgccgaaggtggcttttttatttgaagcttttacagctttgtagactttctttatcaggttgtttacattctggcgtttctttgaggcttttagccaatggtctgcggaaaaagctgaacgggtgataattcccgaggtgtttttataacctaatactgcagtatagaagtagtcgtcgaaaacaataccgtcgacattgtaagtcataacctcttttacagcatttacaactcgactctgagacttgccattagcaggatcaaggtaataatcgttgcttcccgtagagcatctgtatgggttcatccatgcaacaatcttgatttttttggcatgcgcttcttttatcataacctgcatcggatcaaatttcagagttgaggcggcttttttggaagcgtttttatagcctaactttgtagcctttggtgaaatatatttcatggcgtggaatgttttacttttccatgcggcatcgtcataggcacggacctgcatataaagcgtattgagtttatagctctgcatttttttaagaagtttgtcagcattttttttgaatgtagctttgctgtcagttttcagaccgagagaaggatagtcgtagacgcttacccagagaccgcgtacttcagtatattttttcttacttgtttttttagctttagttgttttctttgaagtagatttcggaactgttttagacttaatgttatcagcaggctttacatcagaagtgttgttctggaaggtttttgcctcgccggaagcacctttcctggacgaagagttgttctgcgtgtttttcttttgagcagaatttctactggtagtttgggtcgtagtagtattttttgcagtggcttttttcttggcagatttcttttgggtagtctttttagctgactttatcctggaagatgtcttcttcgccgattttttagaagatttcttactggtggattttttcttcatggaagacttttttttggaagacttcttcttagcagatttttttttggaagacttttttttggaagacttcttcttagcagacttttttttggaagacttcttcttggaagactttttcctggaagagttcttcctggtagttttcgcttgagcagcttctgcctgagagactgtattgcaaggctctgctatcgtaagagctggtactccggcaaaaacgatagcaaaggccataatgacggcaattgttttggctttaatctttttgaacattattcctcctgcgttttatagttattaatttacattatcacgatgcaagaagcggggtgatgtagtcgtttatcagactgtagccatagttgttagctgtagcccaaccatagttctttgcgattttgtctcctgcttcaccggtcgtgtaatgattgtctttaatgccgagccactcgacatatggagcctttccaacgagactcgaatcggcgcgtgggtctgggattttgactttacttgttccttccggccagccgtctattgtagaaacggaagtcgtcgaagaaacgtttccgtcggtcgcagcataaaatgcgaggtgagtagcctgagcacggataccgactcttacagcatttttttcagcttctttggcagaactgtatccgagggcactgtaataaacttttgcgtattttacgaagtccatgccactttctccgccatctaaagcacctattccaccgaagttgcactgggcggcttttacacttccgccaaactgcaggaaacctgtctccttgcagatctgtgcaaaaagcacttcggctttgatgcctgctctgtctgcttcttcacagacaatctgactgaactgatctatagttgctgcgccatactgtttatagacatcagcagggtaagacttattcatgcctgatgtcttggaattgtagtaacggaccatctgctgtgcattggtagaagaagttccttttattgtataggcagtagtgccgcttgcggcagagctttcaggtccgtaatagatgcttccgtttacatttaaaaatgcacggattgtgtaagtatatgttgattgcggactgaggccattgattgtaacctggtttacatcatcaccgtcgactaattccacctgattgccggcagcatctattatctgataacctgacacatcttttacaggataccagtgaaggataagagaagtttctgatgccggcgttacatagtcgtttttatccttatcgtaatcggtagtatcttctgaactctttactgctgtatatgcgcttctccacttgatgctggctttgctgagcttttcaatcgcatcagcagaagccgggttagtcggtgttcctgaattagcaggtgtagtaaacttcagaacatttgagtagctgctccagagtgtcttcttcgaagagtttacggacttacgatagaacctgaacttgaactgatacaaagtattaggagctaagtcagtctctgtgtaactattctctttaattccgtcgttaactctggtgaagtggccgtcgccggtcttcttgtacagacggtaggttacatccggatcagtcgatttttcccaggtgaatgctatagattttccatcggcagacattgcgccggaaagtgtgcctgcaccatctgaatctgtggtaaccttgacaggatttttctggtaggtgcaccagatgttagtcttcttctttcctttctggaagtatgctctgactctgtagccgtaggtcatatttcctgagacggtctcgtcggtgtagcttgatacgttcttcttagtcgtagtaatagtcttgtagcttccgccgttggtgtttctgtatatgcggtaaccatgagcacctttgatctttttccaggatacttttacacgcttaaagccgttgtcgacagccttgatctttgttacagtgtatttcttcggagtagtaacgccaacgcctttcttgttatagacgtcggttcttccactgctgttgctggaaactacagtatagtagtatctggtgttgtatgaacctgtgacatccttgtatgaggtcttcgtcgtccttccaatctctttaaaagtgcccttggcacctgtctttctgaatatgatgtactgggaagcccttgctgaacgcttccacttgaccgtaacgctgttgtcgcttcctgaggccttaacagaggtaatagttgcacgggcaggacgggacacctttttcttcttcagtttaagagctttcgcgatgccgtcagcatctgccttagccatcttgttgatcttctttgtggaattgagatatttctttacatcggatggacaggttataaaagctccttcgacgattatgcccgggatatgatgcagctttgaagttcggataacagagtaatagtctgccatgcttccatccggataacgggtgtttttagaagacctggtatgtatctgcctgtcacaaagccccagacttttgagctttttctgaatattctgtgcgagtgatttaccgagactaaatgctttgtagtcataatgattgttcggataatatacctcgcagccgttcggggccttcccagaggcggcattcagatgaaccgaaacgaaagcatcagcaccgactgaggcagcataagctgttctgtcggtaagagaaacataggtgttattttttctggaaagatatactctgacacgagcgtatttctggagatatgtctttacagactttgcaatttttaaagtaaggtctttctcatggtagccgctgccgtatgcaccgggatcgccgccgccgtgccctgcgtcgataactacgaccttatccttctggtcgacgagtagtggatcgtatgcggatccggcagtgtctttggcttccgcttctattttattagtatttaataaatatgcagagccaccaattgaagtgagagccaatgcggctgcaagaaaaaatgctgtaatctgttttttcataataaatatttaaccgtcctttaaaaacttattaaatactgtaacataaaaatgcatctgttacaaatcgaattcgtaaaaaataaggaaaaaggaacatttttgacaaaatttttatttttatgtgatataatggcatagtgtatgtgttattcacagtttaaaagtattgtgtgattttagaagaatttttttagcacgaaggaggaaccaggatgaagtttcggaaaaatctgcttgttctgccagttatcgcggcaatgctgctgacgggctgtggcgcaggtaaaggaaaaaattctgcttcggcaaatgcgctcgattttagtactgcttcaggagacgcaggtaaagatctcgtagtgtctgtaggtaccgaagacgataaggaggttttaagtcagatcgagtctgattttaagaaagataatccgaattttccgtatacagtcaaggctcgggttatcagtgaatctgaggcggcaaataaagtgctcagtgatacagcatcggcacctgatgtctttacgtttgcagacgatcagcttaattcacttacagcatcggggatactttcgcctgtcacagattcatcggtcaagagtgataatcttgaggcagctgtcaaggcagcctctatagatggcaaggtctatgcgtacccgatgaccgcagataacgggtatttcctctactacaataaaaaatatttcaaagatgcagatttgaagacactggatggtatcctgaaagtcgcagcttcgaagaataagaaggtcacgatggatatcgccaatggctggtatctgtatgcattctttggaaatacaggtatgaagctgacacttgctgacgacggacttacgaatgtctgcgactggaattccacaaaaaataagataaaaggtatagatgttatctcggctgtcacttccattgcaaaaaacaagggcttcaaggccggaggtgatgatgctcttaaggctggtgccaaggatgattctgttatcgcaggagtcagcggagtatggctctcagccgacctgcagaagatctggggagataatctgggtgcagtaaagatgcctacatatacagtagacggacagcaggtacagatggcctcctacgctggttacaagatggtcggtgtcaacagtttctcaccgaaggccagctgggccaacaaattcgcagcatatatgacgaatcagaagagccagacactcagatttgaaaagagaggccagggcccgtcaaatacaaaagcatcggagagtgatgcggtaaaggcatcaccggctattcaggcacttctggcacagtccaaatactcatcgcttcagaggcttggacagaagttctgggatgcaatgaacaatttcggacctcagattacaagtggtaataatattacacagaagcagcttaacagttttgtaaaacaggttaccggagcagtgacagagtaaggagggtgcaggatgtctaaaaagaaaacaaaaattgtaaataatacgaagcctatccgtacgagtgtcagaggtcttgtcctcgtagcgctgggtgtacttggagctattgctatcatttcaaatattatcagtaatatcagtctccgcagcatgaattccagtacgacagtaattgttgatgagtctatggcgagcatcgatgaactgtcggatattttcacagacacgcagactatctaccagaagtctctgtcacacatagtggctacagatttttcgaccaaggtaaaaatggtggaagatatcctgtctgaggaagcttcgctagagaaactgctgaataaggcgtatgcctctgccaaatcggattcgacaaaatccgcggtaaagactatcgcaacgcagtatgttgatctgaagagatcagtaaataaactcacggcagcttcggctcagcagaacaaagcgaaagcctactatctcgcaaacaacgatgtcgcaaaggcagctgacgctatctcatctacgataacttctacaaaaaaacagctcgagagcgaggcatcttccagaaagaacacattaaacagtgtttaccatactaatactggccttaacctgttcttcatctttggctcaatctttgcagttgtcatagatttcttccttgtaatgaagtacatcgcaaaccctctgaacaagacagagagacagcttcatcatatcatcaggggcatagaagagggtcatggagacctgacacagcgtgtttctgtcgagagaatggatgagattggaaagctcggctacagtatcaacaaattcatccagaagctgcaggatattctcgcttctataacgaagaactcggacgatatggaatcggtagtttcagaggtacttggttctgtcagaacttcaaacggctctgcatcagatttgtcggcagttaccgaagagctctcggctacaatgcaggaagttgaaagcaatgcgtctgttatctctggaaatgccaaggatgtttccgacagagtaaatgagatcgccagcaaatctgatgagatcggtgattacttgaaacagatgaaggatcaggctgacgagatggaggccaaggcccgcagcaatatgaacgatacggacgaaaaagttacggagatcatcgatgtgctgggtcaggctattgaagacgcgaagagtgtcgacgaagtcaataagctgtcaggagatatcctctcgattgcgagccagacaaaccttctctcactgaacgcttctatcgaagccgcaagagctggagaagcaggacgaggatttgcggttgtagctgaggagatttcacatctgtctgactcgagccgtgaggctgcttcgaacatccagaagataaacgaagttatcaccgaagccgttcataacctcgcagaacattctcaggatcttgtaaattacatgaaggattctatcctacctgagttccgcgattttgtagacgatggcggaaggtacaagaataatgccacatatatcgagcagatgatggtagacttcgctgcatctacagcagaacttaagaggacagcaaatgagatcgccgattctatcggatctatttcaacatctataagtgaaggtgcacagggtgtcactggtgcggcaaacagcactcaggatcttgtaaacgatatggactcgatcacacagaggatggacgagaaccagaagatagcaaagaatttaaaggacgagacttcagtatttacaaacgtatgaagaaaaaagtagtttcagcagttctggcggcggctcttgccgccgcctgcttttctgcctgcggaaaaaaatcatcttacaaagccattaaagaggacaatactgtcgtaacgataggtatattgtcgtcttcagggaacgaagatatggagaaaggttttaatgatgctctggcagatacttttggagaaaagcatgtcaaagtgataacatcgacatgttcttcgcaggatgacagcaaatctgtcacaagtctgacaaacaagggagcgcagctgatcatgaccgaaggctggaaagccttaaaggcagcttacagtgaaacacagcaggatgagaacaataaaaaacttccgattgtaagcactggagtaaataacatttcagctgcattaggtatcagctatgcggacgaagagaataagaataccggtgtaaatgtaaccggggtgatgccttctccgacgatcagctcccagctctcggaaatcattgaaaccacagacagtatccaccgcgtcggaataatgtattccccggaaaatacagacgctgtaaaaggcaacagggagcttgagcagtatctcgaagaagcaggcattggttaccgcgaattcatgctgccgacatctgcttacaaagatgatatgaagcacgccgaaaaagccagcgccataaagcagagcgatgacgttgatcctacagtcccacagatctctgataattttggcaaattactccatcctgattataacgatggcaaacttgcggactgggagaaaaagaccaggaagtcattgaaggacgctaagacgtcaaagatcatatcaactgcggtaaaagagtgcgacgcactgtacatctctgcaggcctttcaggctctgacatcaaaaaaatcgtgaaaaccgcgaagaacggggactgcgtcacctatggaagtgaccaaaaatcaggaaaagagtcacttataacgatatggccggatccgtatgacggtggttacaaggcaggggagatggcctaccagattcttgtaaataagcagaatccgggcgatatccagatcactgaccagtctgaaaaatcgttccacaagctatacaataaaatgtatgctgaggttttgggaatcaccttccctaagtctttcagcgagtactcttcgtttatgaagtcgtttgtccccggccaggacaccgagagggtggaagagaaggaaaacagttgacctccgcattttttgcacatttaacaaatttaagattgaggaaattttatgatcaaatttacagaggattatctgactggaataccggaaatagaccgcgagcataagaagcttttcgtgatgatagaacaggcaaacagcgagattaagtcgggtgcagatatcaggacgaccggaatgcagctcttaaatgggcttaaggactacgctgcgacgcattttgctcacgaagaggcatatatggaaagtatcgacgatccggaactgccgcgccagcgcagagctcacaaagcctttgttaaaagactcgaaaatacaaacttcgtaggaatggcagatgacacgatgagagaggccgttctcgacctgttaaactacatgtctcactggcttatgcaccatattctgggctcggatactctgattggaaagacgaagtcgccttttgcttttaccgatgaatataagacgggaatcgaactgatcgattcagagcacaaaaaactctttgacatcatgggacgtgtaaatgcgctgattcacaatgaagatctctatgacaggttcgatgagatcgtcgagctgatcggtgagcttcgggactacaccaagttccatttttccgatgaggaaaaatatatggcagagcacaattatcccggacttgatgcccagagaaaggcacaccagggctttgtcgactacctcgagaagatagatctcgaagaggtggacgaggaccaggaggcataccttacggaccttttggcttatcttctgaaatggctcagtggccacatccttggaatggacaagaaaatcggggaatttattttacagtaaaatatacccgagtgctggccggaagcagagcgcagattacccgacgcgctctgcttctttatccaccgggaaatttggcactatatgtgaaaggagaaactatgggttgggttgttgttttgattgtgatcgcagccgttgtggctgcattttttattctggcgataaaacttgcgacttatattatgacgattaataaaaagcatggcaagacgctggagcgggcctggaagatcgagtcgggtcacatggatctgtcgttttacaataagattgaaaaagaggattatacgataaagggcgttggtggttatattttacatgtgcagtttcttaagaacccgaagccgactgcgaaatacatgatcctgactcatggtcacaacgacaacagaatcgggtcgcttaaatatgtgccgatgtacatggaacttggcttcaactgcgtgatctacgatatgagatgccacggccttaacaagaggacttatttcacatacggaattttggagagcaaggatctgatgatcctgataaaagacacgagagtgcgccatcctgacatgacccagctcggcctgcacggcgagtcacttgggtctgcaaccacggtaacaacaatgaaatacaggccgaaagtcgactttgctgtctgtgactgtggttttgccgacctctggaatgtgcttaaagtcagtgccagggagtatcatctgccgcaatttttcctgtatatagcagaagccggcgtcaggatgaagtatcactattcgttcaaacagatgaatcctatagattcgcttggtgacaatgaaatcccgatgctattcattcatggcacggctgattcgtatatcgtaccatcgaattcacagcgaatggctgacaggacgaaggggtacagcgaggttcactttgtccagaacgcaaagcacgcgatgtcgtattatacggacccagtgaattataagaaatatgtcgctgattttttgaagaaaatcgaatgaatgctgccaaaagcgactaacgcaggtcataacagaagagataatgtcgtttcataggaagagagttattatgatttggatttttgtaattattgcggtactcgctgcagtctttttcattctggcgctggggcttgcttcttttgtcatgactgtaaaaagacagacactggacgaggctttcaagtggcagtcagaccactatgacacgtctttttacgagaagattgataagactgattatactgtcgagggctgcaatggatacaggctgtttgtcgaatttttaaaaaatcccaggccgacaacaaaatacataattattacccatggtcacaccgacaacagattcgggtcgcttaaatatgtcccgatgtatctggaactcggtttcaactgcgtcatttatgacctcagggcacatggtgtaaatgacgagactaatacgacttacggcatccttgaggcaaaagatcttgaccttctgatcaaagataccagaaagcgctatcctgatatcactcagctcggtctgcacggtgagtcgctgggctccgctactacagtgacctgcatgaaatacaggccacaggtcgattttgcagttgcagactgcggatttgcagaccttcgaaatgtgctggttcagagcgtgaagcttatccacctgccgaaattttttgtaaatattgctgatgtgggaatccgcattcgctaccactattcaattgatgagatgcgtccaatcgatgcgctgaaggacaacgaaatcccgatactcttcattcatggagaagcggataattttatcctgccatccaattcaaagcgtatggcagaagcgacaaagggatacagcgagtgccatatgatcccgaaagcagaacatgccggatccatactgatgaacccggcatgttataagaaatatgtctctgattttttaaaaaatgtatgagatggatcaacctgccataaaggtgtttgtgaagatcgtcatctgagtgttgactttagctgcctttttggcatctttaagactcagccaatatgtcttaccattttgcactaatccgatgtaggcactgcttcctttaaagctgatttttccgagttttaatttcgcacctttattaaatgccatagttctggacctggcggaaaggctcttctgagctttaattgaagcggcaagttttacggagctgcctttcctgacgaatttattattcagagctgcaattttataatcgctcaggctgcctgcacgattgaatttattgtttttccaggtgtatttgatattataggtgcatacgccgagtccgtaaacatcctcctgaatggttgctgcaacagtttttccggatgtcttgatattctgcgtataagaatcatatcccggcagacatttgtttaagtttacaacacaattcagctttcccttcctgtactggtaaattccattgtaatcggcttcgtgattatcccacggagtatacagtgcaaggaatccgttctttttggatatttttatcagccacgacctgacatcataataattggttttcttattaaaaacggtctttccgttgaccttgactttgagactggtgaaagtctctggatcttttttatccctggtctttacaaaacttacggtgtcggccctgccgtctccggtcagatcgatcttcttagtacccttcgcgaatgcactcacagaaaaaatcgaagcagccataaccgcagcaagtgaaaacgaagcaattttacaaaaaccttttctcatataacagacctccttaaaatgggtcaagagggacggttctttttgtcccagttatctcttgtttgaggttctccacatgcggagcttctcggcgtcttttatcagctggtcgcggaaatccgggtgagcgatcgagatcagcgcctcggctctctcccaggctgaaagtcccttgaggtttaccttgccgtactcggttactacatacatggtctgcggacgggtatcggtgacgatggatccttcggcgagggtaggacggatacggctgtgaactacacccttcttatcagtaaaggtagaagacatgcagatgaagctcttgccgccatttgacaggtaagcaccctgaacgaaatcctgctgaccgcctgcaccggagatctggcgggtaccggctgactcgccgtttacctgaccatagagatcgatgtcgatagcgttgttgatcgacatgaaattatcaatctgagaaatgactctgacatcgtttgtatagtcaacaggagcactcatgcactccgggttgtcgtcgaggtaatcgtagagcttttttgtgccggcaccgaaagcgtaaacctggcgatagcggtcgatatttttcttcgagccgttgatcttgccagccatagcgagatctacaaaagcgtctacgtacatctcggtgtgaacagaaagatccttgagatctgactcagcgataagagaaccgacagcgtttggcatgccgccaataccgagctggagacaggcaccgttaggaatctcatcaacgataagctgagcgactttcttatcgacatcggaagccgggccgccggcaggcatttcgccaagtggaggattgtcaccctcgacgatggcacttaccttagagatgtgaatctcagactcatggccgccaagacagcgaggcatatttttattgacctcgacgatgatctcctcagcgttctcgcagacagcgccgagatgggaggcagatggaccgaatgaaaaataaccgtgcttgtccatcggtgctacctggatcataacgactctcgaaggagtggcgttgttgatcctatagtagcttggaagctcagaatacttgataggtgcgaagtaagcgttagtcgttgtaagcatttttctctcgacgccactcatatgccatgaattatatgaaaaatgcttctcagcgtccggaacctgcatgatataaggaacatggaaaaggattccgcctctgacatttacatcgacaagctcatcggctctcttcgccagagctttgtcgagggcctccggagtgccgacgcaccagccgtaatcaacccagtcaccgcttctgacgcactttacagcctcatctgcagtggtcagcttctgtttatactcttcttcgaaactcatattacctccttctaaaactgcatttaattaaaaaatagctctctatattctaccactacaaggaaaaatttgctatactattaagaacgactgtaaatttattattttagaggaaatatatgaagagaaagaaatttttagcaacactaatggcatctgtaatgataggctcacttgcttccgcgacaggtgtaaacgcctatgccacccagaacaggtcagccaatttttcaaagatatatgtattaaagtcaaaaaaggctcaggacatagtgactgtggcattggcacaggaaggcaggacaaaggcggacctcggatattcggaagcctggtgtgcggatttcataagtgattgcgcatacctcgtcggtgcatatgatgtgataccagcgaatggcagtgtatatgcattaaaatccagtctgacagctgcaggaggatatgaagtcgacaatcctcaggcgggagatattgtattttaccattgcaatagtgaacacagatgggtgcactgcggcataatgataaacagcactcagtcgatagaggggaatctaagtggaaaggtcaaaacggcgaatggcaattacaaggattccaatggacactctctttcaaatgggacagttacccggatatttatccgcccgggctatttttcaagcaaggcaccgatcccgagcaacacttcagataattcgtctgcaaataacaaaaatgtgatcccggtaacaccgaccaataagaaacagaataccagcaaacatgcaagtggtacggcgtcagatggaaaagaatcgaatccgtccagcaataaggacaagagtaagacaaatactgacaataagtcgaagaacaagacatctgactccgcttccaaaaagaaaaagtacgtcggaacttacaaggtaaatacgaaatcgggtgccctgactatgagaaagtcagcgtctaagaagggagagatcctgactcaggtacctaagggcaccaaactgaaagtagagagcattaagggaaaaggaaaaaatgcctgggcacgtgtcacttataagggactgaccggctatctttccatgcagtttatgaaaaaggtgactgcaaagagcgccagcacaaagaagacaactgcaaagaatacctcttcgaagaagaaaacatatgtcggtacttacaaggtaaatacaaagtcgcgctctcttactttgagaaagtccgcagataaaaagagcgatatcctgatgcaggtaccaaagggtacaaagcttaaagcggagaaaataactggcaaaaagaacaacaaatgggtccttgtcacttataaaggacaaaaaggttacctttccatgcagtttatgaaaaaggtgaccactaagaaagcaggcacaaagaaaactgcagcaaagactactaccaaaaagaagacgacagtcaaaaagaagaccgatgcaaagaaaactactgcaaaaaagaccactgaaaagaaagcagcttcgaaaaagaaaagcagcaaaacatacaaggtaaatacaaagtcgggttcacttgcgttgagaagcttggctggtaaaaagggagcgtttgtgatctcagtaccgaagggcactaaggttaaggtcacaaaggtgaccggaaagaagaaggaccagtgggcccgtgtcacatataagggacatactggctatctttctatgcagtttcttaagaaaacagcctgatcatgaaactgcatcttagaatacacagaatattattatttgtactttggatcgtagtgcttgttctgctctacggtcattttagagtccggtttttaatcgtggcgctgatactcgcgctggcaggcggggtatcagatatctggattttgtataggatggctgtaaatactgaagtgatgctcgagcccggagcggaattatcagaaaatccaaatgattttccggtttacttacacatcacaaatgattcccggatcccgtctgcggagcttttgattgtgatctcctgggaaaatgaatcagatggcagcaggcaggagaaggagatcacatacccgctttactcgtatgaggattttcgcgagaagctgccagctgcttttacggattctggaacttacagactcacacttgaaaaaatgcagctcagagattttctgggtttttcagaccttataattccgctcgattccgagcttcagatacatgtttgaggaaagggtatataaaaatgctgaaggtttttcttgtagaggacgaggcagtcatcaggaacagcattgtaaaaagcgttgactgggaaaatgaaggctttgaactggcaggaagtgcgggtgacggagagctcgcctggccgcagatcagggaaacaagacctgacattgttgttacagatatcagaatgccgtttatggacggactcgagctttcaaagcttgtgaaaaaagaatttccgcatgcgaagatccttatactttcagggttcaatgaatttgattacgcaaaagaagcgattcagatcggagtatctgattatctgctgaagccgatatccgcagacaagctcgtagagtcacttcacaaggtcggagacgagatcatcgaggagagaaaatcccacgatatgatcatgaactacaccagaaggctcgaagaggaggataacaaaaaggctgagaaccagactccggtagatgtggaggaagtcaatccgaaagcgcttaacaagacgactttctttgattttctgatcaggggaaacagagacgacatttcgggatttatagataaatatctggatgaactcggacgcaataaccttcgttctgtgctcttcagacagtatgttatatctgatctctatctgacgtgcaacgcatatctggatgatctcggagcaccaaaggaagagaaaatcgcaattctcggatctatggaggatgctggaaaagcggtcgcggccgacaagacgggacttcgggaaaaacttgaagatctcctgtgctcgataatagattacagaaacctgaacagggaagcccagctgtcctctcagatacttaaagcctcttcatatattagagaacactatggagaggacgatatttcactgaatcaggttgcagatgtggcaggaatgtcaccttcccatttttctgccgtattcaagcaggagactggcgaaggattttctgagtatctgacagaggtcaggatggaagctgccaagagacttcttgcgacaacggatttcaagatgactgaaattgcagagcaggcaggctaccacgattcccactatttttcatccacatttaaaaagacgcagggaatgactccgaaggactaccgcgcgatggtgaaaggaaactgatgaagaggagaaaaagcatccggaccaggataattgtatctatatggtgtattgtagtgcctatgaccatacttttttcaatggccataggctatttttacatgtcttttcacagatataacaagatcgtaaataatataacccaggcgaatgaatacaatatgaccttcaaggaaaatatggattcggtcatatatcatatcgttgtcggaagcatcagatacaatgaaccaaaggaacatgcaaacctcgggatgcgcgacccgtatattcagatcgacagggcaaggcggcagttccagcagctgaaggagaggactacggacagggagaagcttacgacactcagggaagtcctcggacttttaaataccctcgagcagagagtcgacgacattgtaaataatgtcaaagagggcggccattacgataagaatatgcagatgttcaatatggatatttccatactgacaggcctgatacaggattccatccagcgctacatctatgagagcgcaatagagatgggaaaggtgcagagggagatcaacgggaggatcatgttctttatcaggatcatgatcgtgatctttgcggtccttcttatcataagtattgtaatttcaaaatatacgactgacaggatcataaagcctatcgataatatgtgcagagttacggaaagctatgcagtcggagatttttcaaagaaactcgaggtgaaaaacaacaacgagctcgatgtgcttgcgaacagctttaacaacatgggcgatgacatcgagaacctgataaagactgtcggcgaggagcagaaggagaagcagtcgctcgagatgaagctccttactgctgagataaatccacatttcctgtataacactctcgatacgatagtctggctcacagaggccaaagaaaacgatgaagctgttaaagtcctctcgtatctttctgatttcttcagagtctcactgtcaaacggcagagacgtgataacggttggagaggaggaaacccatataaacagctacctcgcaattcaggagatccgtttttcagatatgatggactatgagatctcaatagacgatgaaataaaggactgccagatggtaaaaatgacccttcagcctctggttgagaatgcgatctaccatggaatcagaggccggagaaaaaagggaattatccgggtgactggaaaagatcagggcagctacatggtatttactgtagaagataccgggaggggaatgacggcagaagaacttgacgacttcaggcagagacttttgaccgggaagataatgcagagcgctgaagggcatggctttggtgtcgccaatgtggtgaccaggctgcacctctactatggatcagatatggatatcacggtaaagtctgttgtgggcaggggaacgatcataaaaattgtacttccaaagtcggttcagtaaaattttacactttttttgaaaaattttatacttttttaactcaaacaggaaaaattcaataaaatttcgcaccaaattcataatttagtctgtttaaaaacggcttatttctctctataatactaaacataaagaaattcttctaaatctaaaccaggtcatcctgattgagggggatgacctcataaaagctaataaggagggctgtttttatgaagaagaagttgtttagtctgttacttacagcaacaatggctgtaggtgctcttgctggatgtggacaggccacaagcggtggaaagagcacaagttcaagctcaagctcgagctcaagcgcaagctcatctgcatcaaagggcggcagcggaaagtcggttacgatcggattctcacaggtaggagctgagtcagattggcgtacagccagcacgaagtctatgaagggaaccctttcatcaaagaatggttacacaatgatctttgatgatgctcagcagaagcaggagaaccagatcaaggctcttagaaacttcattcagcaggatgttgattacatcgcactcgatcctgttactgagtcaggctgggatacagttcttaaggaagctaaggacgcaggaatccctgttatcatcgtagaccgtatggttaaggtttcagatgacagcctctacacagcatgggttggttcagacttcaaggcagaaggtaacaaagcctgcgagtggctgaagcagtatgctgataagaagggcattaagcagtcagacatcaacatcgtagatattcagggtactatcggagcttcagctcagatcggacgtacagaaggacttaacgacgcagttaaggcaaacggctggaaccttgtagctcagcagacaggtgagttcacacaggctaaaggacaggaggttatggagtctatccttaagtctggcaagaagatcaacgttgtttactgcgagaacgataacgaggcattcggtgctatcgatgctcttgaggcagctggtaagaaagtcggctcagacatcaagaacggcgagatcatggtaatgtcattcgactcaacgaacgcaggtcttacagatgttaagaacggcaagattgctcttgatacagagtgcaacccgctctatggaccacgtgttgatgagatgatcaagaagcttgaagcaggccagaaggtacctcatcttcagtacatcgatgaggctatgttcgctaaggataacacaatccctactgtaacagctaagaacgccaagggtgaggacactaagtatgatgtaacggttgttacagatgatgtcatcaaaggcagatcttactaatcctgataccaaaataacacagtgatttaaagagtgaatttgggtggcatgaggaaatattgggaaaccagttacactcatgccactttttttgcaaaaaaatagagaaaggagacgaaatggaagacgttatcttagagatgaaaaacatctcgaaaaccttccctggagtcaaagccctttccaatgtggatttcgctctccgcaaaggtgagatacatgcgctgatgggagaaaatggagcaggaaaatctacactgataaaggtgctgaccggcgtgtatgacctcgaaggcgggtcgattacgatggccggaaaaaatatcgtaaatcacagcccggaggatgcccagaaaaacggcatcagtacagtttaccaggaagtcaacctctgccctaacctcacagtaggtgagaacctcttcatcggcagagagcctagaaaaggcctgttcatcgattggaacgctgtcaacaaacgctcaaagaaactgctcgatgatttaaatatcgaggctaatccaaagaaactgctcggcgactgctcgatagcagtgcagcagatgatagccatcgcaagagcagtcgatcagaactgtaaagtcctgatcctcgacgagccgacatcttctctcgatgacgatgaggttgcaaagctcttcacactgatgagaaaactcagagataacggcgtaggtattatcttcgttacacatttccttgagcaggtatatgaagtctgcgacaggatcactgtgttaagaaacggtgaactagtaggatcatatgaagccagcgaacttccgagagttcagctcgttgcaaagatgatgggcaagaacttcgatgatctggcagatattaagagcggacacgagaacaaagtcgatatgaactcgacccctgttatcgatgccaggggaatcggccacactggaacgatccatccgttcgaccttgctgtacataagggcgaggttatcggacttacaggactcctcggagccggacgttcagagatggtaagagccatctacggagcagataaggctgattcaggtcagctctatgtgaacggcaagaaagtaaagatcaacaaaccactcgatgctatgatgctcggcatgggctacctgcctgaggacagaaagaaagatggtatcatcgctgacctttcagtcagagaaaatatcatcattgctctccaggccaaaaagggtatgttccatctgatgagcaggaaagaaatggacgaagcggctgacaaatttatcgacctccttcagataaaaacagccagccgcgagactccaatcaagagtctctccggtggaaaccagcagaaggttatcatagctagatggcttcttacaaatcctgactatctgatcctcgatgagcctacaaggggtatcgatgtaggaaccaagacagaaatccagaaacttgttcttgatcttgcggatcagggcaaagctatcacattcatctcatctgagatcgaggagatgctccgcacctgctcacgtatggcagtcctccgcgatggctataaggtcggagagctttcaggagatcagttgaaccaggcagatatcatgaagactatcgccggtagcgaaaatggaggctcagaaaatgcaaagtaatcagtcaaagtggagccgtatcacacacgctccgctcttcatgccaatcgtgtgccttatcgcagtactcgtactcaacgtaatacagacaccgacatttttcaagatttcaatcaacaacggagttctctatggatatcttattgatatcatcaaccgtggttcagaactcgtaatccttgcagtaggtatgacacttgttactgcagcatcaggtggacaggatatttccgtcggcgccgtaatggccgttgcagctgctatctgctgccagctcctgacaggcggtcagaagacatcctcaacacttgcaatgccaattatagttgcagcaattatcggaatccttgttgcaggtctctgcggtgcgttcaacggatttttggttgcgaacctgcatatccagccgatggtcgccacacttatcctctttacggcaggacgtggtatcgcacagcttgttacaaaaggacagattacatacgagcgtgctccttcatacaaggttcttggcggatacatcggaaaatgcccggtacctactcctattttcgtagcgatcatcactgtaatcgtaatgcagctgatactgaagaagacagctttgggactttacgttgagagtgttggtatcaatggctcggcatcgagacttgtaggtcttaactcaacgatgctgaagttcatcacatacgtgatctgcggtctcctcgcaggacttgcaggaatcgttgcttcatcacgtatttactcagcagatgccaataacatcggtctgaacctcgaaatggatgccatcttagccgtagcacttggtggcaacaaccttggcggcggtaaatttaacatgatgggttccattatcggagcttatacgatccaggctcttacgacatcactttacgccatgaatgtatcagccgatcagcttcctgtttacaaggctatcgtcgttgtaataatcgtcgtaatccagagccctgtattcagagacaagattgctaatgcatcgaagaagagaaaggcggtggcttaaaatgaagaaagcaaaactttcaaagacaggtttcctgcttctcatcacgatcgtgatgtttgcagtaatgtacatcgctggaatgatcattttccaggataagggatttgcaaagccacagatgttcttaaatctctttatctcgaatgccggacttatagttatagcctgtggacttacgatcgtaatgattacaggaggaatcgatatctccgttggttctgtaacagctctcgtttgtatgagtgccgcagatgtaatggaaaacaagggaatgagcgcagtatttgcccttttccttgcactgataattggtcttgcattcggtgttgtccagggttatctcgtaacatatttaaagattcagcctttcatcataacgcttgcaggcatgttcttcggccgtggtcttacggcagtcatcagtacaaagatgatctccatcaagaacaagatgttccttgcctgggccaatgaaaaaatgtacctgcctttcggttacacgaaccgacacggggtcctggtacacgcttacatctacccaacggtagtcatagcactggtcgtagttgttctgatccagatcatgctcaagttttctaaattcggccgtgcgctcttcgcaatcggtggaaatgagcagagtgccgtactcatgggactcaatgtcaaatccacaaaaatgaaggcatatgtcctcgatggtttccttgcaggacttggcggattcctcttctgcttaaacagctgcgcaggattcgtagagcaggccaaaggtcttgagatggatgctatttcagcagccgttatcggtggcacacttctctcaggaggtgtcggaacagtagtcggaactctgtttggtgttcttataacaggaactattcagtctcttatcacaacacagggtactctctcaagctggtgggtcagaatcgttctttctatcatgctctgcttcttcatcgtactccaggctattatcggtggagccggtctgaagaagaaggacaagggtaaagaaaagacagcaaaagcaactacgtaacattaaaataaaatttgccgggggcagtttacactgcctcctttttaaagttttcagttgataccatttgaaaaatggtgtatcttatattatagggaaaaagcagttaaatttttctaggaaagggtggctattaacacaatgaaaaagatttattttatcccgggcagtcaggatctctatggtgaggagtgcctcagacaggttgcagctgattgtaaagaaatggtagatttccttaacgagaagctctctgacactattcagtttgagctccttcctacagttgagacttctgagatctgcgtagaggatatgaagaaggcagtctgtgatgatgactgtgttggtgtatgcgtatggatgcacacgttttcaccagccaagatgtggatcaagggacttcagatcttaaataagcctcttcttcaccttcatacacaggctaacgagaagcttccatatgagaccatcgatatggacttcatgaatctgaaccaggccgcacacggcgacagagagttcggattcattcttgcaagactcaacatccctcatcaggttgttgcaggttactataagcacgatgatttcatcgctaaggttaagcagttcgcacaggttgccaaggctatcgacttctcatatcatatgagagttgctacattcggaaacaacatgcgtgacgtttcagttacagatggtaacagactctcatgcgagatcaaatatggctgggagatcaagtactggggcatcggcgagatcgctgatcttgccaaggagatcactgacaaagagatcgatgacaagatggctgagtacaagtccaagtatgagatggctacagaccgtgaggatgttgtaagagagcaggccagatatgaggttgctttcgaaaagttcctcaaggagaacggctgcagcgcatttacagacagtttccaggatcttcacggactgaatcagcttccgggaattgccgctcagaacatgatggcaaagggcgttggatttggacctgagggcgactataagatcgcagcattccaggctgtccttgagaagatggcagaaggccgtgagggtggcacaggattcatggaggattacacctatgacctgactccgggcgaggaagtagagcttgcaagccatatgcttgaagttccggctcagctcgctgcaagcaagccacgtattgaggttcatcctcttggaatcggcggaaagtcagatcctgcaagacttgtatttgactgtgttcagggcgatggtatccaggttacacttattgaccttggtgatcacttcagaatcgtatgcgcagatgtagagcttatcaaggagccacatccgatgccgaaccttcctgtagcacacataatgtacagacataagccaaacttcgagatcggcacagctgcatggtgctatgcaggcggagctcatcactcagttatctctacagctctgaaccgttcagatatccagctgtttgctaagctcacaggtacagagcttatcactattggtgatgacacaacagaagctgaccttgccagattttacatgaaataatatgacaatcaggatattagtaggatagaaaggaatctcatgctcgaagaattaaagaagaaagtctggcaggctaatcttcagctgccggctcatcaccttgtgacattcacctggggaaatgtcagtgcactcgatagagagaccggatattttgttatcaagccaagcggtgtaccatatgacgagttaaagcctgaggacatggtagtcgtagacttagacggaaataaggttgaaggtgatctgaatccttcatccgacacaccgactcacgcagtgctctacagcagattcccggagcttggcggtatcgtacatacacattcgacatttgctacatcatgggcacagtccggccgtgacattccgtgctacggcactactcacgcagactacatctatggacctattccatgtgtcagaaacctgaccaaggaagaaatcgatgaggcctatgagaagaacacaggtgtcctgatcgcagattacttcaaggagagcggccgcgatgttatggctgtacctggagcactctgcaagaaccacggtgtattcacctggggaaaggatgcagacgatgcagtgtacaatgcagtagtatttgaggaagttgcgaagatggcctatgttacagagcagatcaatccccgcgtgacaccggctccacaggaacttcaggacaagcattactacagaaagcatggcgctaatgcctactatggccaagagggacatcgcgatggaaaataaagaaaagatcgaaaaaggagccacagctttaggaattgagttcggctctacaaatatcaaggcagtcctcacagacgacaagggcgcagttctcgcaaagggaagccaccgctgggagaacagcctgatagatggtatctggacatattcttacgaggagatcgatgcaggactcagatcctgctacactgctctccgcaaggctgtcgagaaggactatggcgtaacacttaccacagtcggggcacttggcatttcagccatgatgcacggtatcatcccgctcgacaaggacggtaagccattatcagaattccagacctggagaaattccaatacacaggcagcagctgacgagctgactaaactgttcaattttaacataccactccgttggacgagtgcacatctgtaccagtatattttagacgatgagccgttccttccacagcttgattttgtgacgactctcgacagctatattacctggaagcttacaggtgtaaagtgcaccggaatcggagacgcttccggaattttcccgatcgattctgagactaaggactacgatcagaagatggtagatgcctttgacaagcttatcgctggaaagggctatccctggaagctccgcgacgtacttccgaaggtacttgttgcaggacagaaggttggagagcttacagccgagggcgctgctcttctcgatgaatctggtaatctgaagccgggaattcctgtagctccatcagagggcgacgcaggaacaggtatggttgctacgaatgctgtagctccaagaaccggaaatgtttctgccggcacttctacctttgctatggtcgttactgagggacctctcaaggctctccacagagagatcgacatggttactacacctgacggtgctccgtgcgctatgagccatgcaaataacggtacatcagatataaatgcatggcacgatatttttgcacagttcgttgaagctctcggagaagatcctgacaaatacgatctgtacacgctgctctgcagggaatcacttaagggtgatgcagactgcggcggacttctgaatttcggttactattcaggtgagggcgttacaaagctcaatgagggcagaccactttatgtcagaatgcctgattccaagtttacgctgcagaacctgatgcgtgcaaatatttactcgtcacttgcagctgtaaagctcggaatggatatcctccagaaagacgagaagataaagatcgaccgtatcactggacacggtggattatttggtacaccgggcgtggcccagaagtaccttgctgctgctataaacactcctgttactgtcctctcgacagctacagaaggtggtccgtggggaatggcgatcctcgctctctatactataaagggtgaaggaaagtctcttccggagtaccttgacaaggagatcttttcacagatgaagggcgagaccatgagcccggatgctgaaacggtcgccggatacgaggagtttataaaacactataaatcaggacttgctattgaaaagtccgctattgaaaatgccaactggtaaaggagattcaacaaaatggaaaagactattccagaaaaaggtccgattactgatgatttgatcgaccgcatgaaccgctggtggcgcgctgccaactatctgtcagcatgccagctctatctgcttgacaatcctcttctgaagaagcctcttactatggacatgatcaagaagaagatcgttggacactggggcacagttcctggtcagaactttattttcacacatttaaaccgtgctataaagagatatgaccttgacctgatccttctgtcaggcccgggacatggcggaaacttcttcatcgcaaatgattatctcgatggaagctattctgaaatctatcctaatatttctcaggatgaggaaggaatgcagaagctcttcaagcagttctcattcccgggtggagttccttcacactgcgcacctgagacaccaggatctatccacgagggcggcgagcttggatattcactggctcatggatgcggagctgttttcgacaacccggatcttatcgcagccgttatcgtaggtgatggtgaggcagagacaggtcctctcgctacatcatggcacattaacaaatttatcaatcctgtaggcgacggtgccgttcttcctatcatgaacctgaacggatacaagatcgctaaccctactgtctttggcaggatgagccaccaggagctcgttgatttcttccatggctgtggatgggagccgtactttgtagagggcgacgatccaatccctatgcacaagaagatggctgagacgatggatatcgtaatcgagaagattaaagctatccaggagcacgcccgtaagactggagacaccacaagacctgtatggcctatgatcgttcttcgttcccctaagggctggactggtccgaaggttgttgacggacagcgtatcgagggcaacttccttgctcatcaggtacctatcatgatggacaagcctgagcaccttcagatcctttcagactggctccacagctataagccggaagagctcttcgatgaggacggacaccttctgccggatatcgcttctctcgctccggagggagatcacagaattggtatgaaccctcatgccaacggcggtaagcttctccacgatctccgtatgccggacttccgtgactatgcatttgatattggtcaccacggtgagaaggacagcatggatactatgaacctcggtgcatttatccgtgatatcttcaagctgaatgagaaagagaagaacttcaggattttctcacctgatgagaataactcaaacagattctacgacgtattcgatgttacaaatcgtgactggaactcaactcttcacgatgatgatgactgtcttgctccggatggaagagtcatggactcaatgctttcagagcatatgtgcgagggctggctcgagggataccttctgacaggccgtcacggattcttcgatacttacgaggcattctcacgtatcatcgattctatggcatcacagcacgctaaatggctcaaggtttgcaaccagcttccttggagagagagcatcgcttctcttaacctgatgatgtgctctacagtatggcagcaggatcacaacggatttacacaccaggatcctggatttatggatcatatggcaaataagaaagcagacgttgtccgcatctatctgccaccagatactaactgccttctctcaacaatggatcactgcctgcgttcgagagactatgtaaacgtaatcgttgcttcgaagcatccgagaccacagtggctgtcaatgcctgaggctgtaaagcactgcactcagggtattggcatctgggactgggcatcaaacgatcagggtcaggatcctgacatcgtatttgcctgtgctggtgagacacctacactcgaggctcttgctgcagtttctatcctcagagaagagcttccagatcttaagatccgtttcatcaatgtagtcgatctgttcaagcttcagccgaacaacgagcatccgcacggactcacagatgaagagtacgatatgctcttcacaaaggataagccggtagtatttaacttccatggctatgccaaacttatccatgagcttacataccgcagacacaacaaccgtcttatgcatgtacgcggctacaaagaggaaggtactatcactacaccatttgatgtacgtgttcagaaccatgttgaccgtttccaccttgtacaggctgcactcaagtatctgcctgagcttggaaaccgtggcgcatatctctatcagaagatgagcgacaagcttgttgagcataagcagtacatccacgagtatggcgttgatatgcctgagatcacaaattggaaatggaaggataatcagtaataactgatattccggacagaagtttccagctataaaaggaggtttatagaatgaagttttttatcgacacagcgaatgttgatgaaatccgtgaagcaaatgaaatgggagttctcgcaggagttactaccaatccgtcactgatcgctaaagagggacgtgattataagacagtcctcaaggagattactggaatagttgatggagccatctcaggcgaggttaaggctacaacaactgatgctgagggaatgatcaaggaaggccgcgagatcgcagctatccacaagaacatggtagtaaagatccctatgacagcagagggactcaaggctatccacgctcttgatgctgatggaatcaagaccaactgcactcttgtcttcacagcgaaccaggcacttctcgctgccagagccggagctacatacgtttctccgttccttggcagattagatgatatctctgagccgggatacaagctgatcgaggagatttcagctatgttcaagaactatgacgatatcgatacacagatcatctgcgcatcgatcagaaatccgcttcaggttgagcagtgcgctcttgccggagcagacatcgccacaattccgttcaaggtgatcaagcagatgatccatcatccgctcaccgatgagggaatcgtaaagttccagaacgactacagagcagtattcggggactgagctaacaggaaataaatgtgggacaacggggacggttctttctgtcccacatataatactgtgggacagaaagaaccgtccccgttgtcccagccaggaatctacagacgtccggagtggaaacactccgggcgtttttttgtaaagtagtggaaagttgctacagtatttgttataatctattagtaaaaaaagcaccataaacccgaaggaggacattttatggctgagaatacatttacagtagcagaaggtgttacagtcacagatgaagtcatgacgaccattgcagggcttgctgccagcgatgtagaaggaattgcatatatcggaaacggacttacgagagagaacatcaccaaggccggagccagaaatctctcgaagggtatccatattatcagggaagaagacggaagcatcacagttcgccttgctgtagttatcaaatacggttatgaagtaccgaaggtcagccgcgacatacaggagaaggtgaagagcagcgttgccagcatgactggtatcacggtcagagaagttgatgtccgtatcgcctctgtagaaatgaacacgacagaggagaacgaatgaataagtacagactcagagacgagacgtttaagagactttttatgtctcagttttattctgatgagagctatgcagaagtagtgaaagctaacgatgagcttgagactctggttccggaggctgagataagcccatacatagagccggagcttggaaatggcctgagtgaagacgatatgaagcagttaaatgacagagtcgattcgatcagagcacacattcctgaactggatcagattctagatgcgaacatcacaggctggaagctgaaccgtatcgctaaggtggaccttactattttaaggcttgcatgctacgaactttattacgacgactcgattccaccgaaggtctcggtgaacgaagctgtagagcttgcgaagaagtacggcagtgaaaagtcgggctcatttgtaaatggcgtattaagccatgtcatcagatcattggacgccagatcttcagaggacagaacatctgaaaatggctcaaatgaatagaagaatatataccgtttcagtgataaatcactatgtggcggggcttttggaagacgatatgatgcttcgaaaagttgcagtcactggcgaggtttcgaacctgacctatcactcgagcggtcatgtttattttacattaaaagacgagaaagccgccatcagcgccgtgatgtttcgacggttcaaggccgccggacttaaatttccgatgaaggctggagataaggtcgtagttaccggaagcatcggcgtttatgagaagggcggtacataccagatctatgcagaaagaattgagccggcgggcgagggagagcttgcggcgagggttgaggcgcttcggcgcgaactgctcgagatgggtatgtttgatgagtcttataagaagccgataccgaagtattgcttcaggatcggcgtagttacggcacctacgggagccgttatccacgatattatgcaggtaacggcgcgcaggaatccacatgtgcagatactcctggcaccggctcaggtacagggcgagacagcggccgattcagtggcggcggctttaaggcgaatagatgcagccggctgtgacgtgatcatttgtggacgagggggaggatctttagaggacctgatggcttttaacacgagaacagtggcagaagccattttttcgtgtcagacaccagtcatatctgcagtaggacatgagacagatacgacgattgcagactatgtggcggacctgagggctccgactccatccgcggcggcggagcttgcggcattttcatgggatgtattcttatccgagatgaagaagcggaagggccagcttacgaattcgctgaacggacacgtcctttctgagaaaaacaggcttcttgcgctgcagaggagaatatttctggcttctccgaaagagagatcgaaccgcgcgatgatggctctagtaaagctctctgacaggattcagaagtcgatgacagacaggtgctcggatacgaaggagaagctgcgtgatcatgcagaactcatgaagtcagctatgaacgtaaagactcaggctgcagacaggaagctcgctcttattgcgccgcgactcacgcaggacatgaaccgcaggctttcagatacaaagcatgcgctttcacttatggcgcagaagattgaactgtctaatcctgtgaaaaaaatagcagatggctttggatacgtgagcacagagagtggcagagtcacgagcgtggatcagataaaaacagaccaggatttttcagtcagactgaaagacggaactatagaagcaaaggcacagaaggtgacaaaaattggctgagaacaaagaaagacaattgagtatagaggagtctcttcaggaactcgacgggatagcagcacagatggaagacccgaaagtgagcctcgaggaatcattcggactctacgagaagggcatgaagctgatcaaatctgcgacaaagcgtatagaggatgtccagagaaaagttgaaaagctcgaggccgatggttctgtgagcgattttgaagaggggagcgacacagatggatttttcatctagaaagcaggaggcagatgagatcattttgagctttctgcctgaagtaaaaggatacgacaagactcttctcgaagctatggactacagcgtgagagctggcggaaagagactaagacctatacttatacttgcgaccgggagaatgtatggagcttcgaaggaagaactcgcaccgtttatggcagctatggagtttatacatacctactcactggtgcatgacgatctgccggctatggacgatgatctgctacgccgcggaaacccaaccacacatgcgaaatacggtgcaggaatggggacgctcgcaggtgacggactcttgagtgaagcgtttgccattatgtcgcgctgtgtcacaaagagcataataagtgaccggaagaagggaatccgtgcggccagagccatggagatcttagccgaaaaggccgggatcgatggaatggtaggcggccagagtctcgacgtggaaagcgataaatccggacgggatattacgcctgaagagatggaatacatctacgagaacaagacatctgcacttctcgagggagctatgatggcaggagccatgattggagaggcatcagatgccgatatagagcttatcgaaaaggcaggaagtgcgcttggcagggcttttcagatcagggatgatatcctcgatatggtcggagacgagaagacactggggaagtctacagggcaggacgccagaaacggcaagagtacctatgcctcagtgcacggaattgaggagagtgagaaggctgtaaaggagctcacaggcgaggcctcagatcatatcagagcgctttcaggagtgaaagaccagaaggagagagaatttgtgctcgaattattcggcactcttacagagagaaacaaataatggttctagagaagataaacgcccctggcaatgtaaaaaaactgtctaaggatgagctcccgcttctcgcgcgggaattgagacagttcatagtcaaaaatgtagctgaaaacgggggacatctcgcaagcaatcttggtgatatagagcttactatagctcttcacaggattctgaacttcccggaggacaaactgatctgggacgttggacatcagtcctacgcccacaagattctgaccgggagacgtgcgggattttctacactgcgccagaagggcggaatcacaggattttccaatccgaaagagagcgactgcgacgcctttgtctcgggacacagctcgacttctatatcggtggcacttggctttgcggaggccagggaactgacagggggtcatgagaatgttgtcgccgtaatcggcgatggcgctatgactggcggaatggcatacgaggctctgaacaacgcttcaatgcttaaatccaatttaaccataattttaaatgacaaccagatgtcgatctcgccaaatgtaggtgggatgagcgagcatctggccagagtccgcaccagtcagggctacactggcttgaagagtggaatggaagagtcgctgagacgggtaccgggaggcgaatcttttatcagattcctgcgtggagcgaaaaatggcataaagcagttcgtcgttccaggcatgatatttgaaaatctgggaattatgtacttaggacctgtggatggccacgacatcgagtcgatgacacgggttataagcagcgcgcttaagtacaagggaccggtgcttgtacatgtccttacaaagaagggcagaggctacaggccggctgaaaaaaatccttcacttttccatggtgtagggccttttgatataaagaccgggaagcttaaaaaacaaaccgagtatccgacttacacagaagtgttttccagggcactcgtccgcaaagcctgggacaatgacagaatcgcagctgtaacggcagcgatggatctgggctgtggcctgagcgaattcaaggagcagttcccggagaggtttttcgacgtgggtattgctgaagctcacgcggtgactttttcatctgctcttgcagcaggtggcatgataccggtgttctcggtctactcctcttttttacagagaggatttgaccagctcgttcacgatgtaggcatcgaacagagccacgtgatctttgcagttgacagggcagggcttgtcggccgagatggcatgacacaccagggaatctttgatatctcttatctgacgatgataccgggaatgactgttatggcgccgatggacgcgcaggaactttccgatatgctcgactttgcaattgataagatgaatactccggtggcaatccgctatccgagaggcgaagcctttttctatgaaaataaaaagacacagatagagtacggtaagtgcgaggttttaagcgaaccgaaagagtctgaagtactgctttttgcacttggaagtatggtggaatgtgcgatcagcgtcgcacatatacttaaaaaatcagaaatatctacgagcattgtgaacgccagatttgcctctccaatagataaagattttttaactaatgcggcgaaaaaatacgatattatagtttcgctcgaggagaatgtgaggtctggaggcttcggtgagcacgtgctttcagtcctctctgacgcaggatttgagggcaggtttatcaacgtctcgatccctgacgaatttgtgccgcagggaagcgtagaggagctgatctgcgatgttggaatcgacgcggattccgtagctcaccgcatagagagcgcacttgaagggaggaagtcatgaaaaaaagactggatgtcctccttgtagaacgcggtctcgcaccttcgcgtgagaaggcaaagtcatatatcatggaaggcaaggtcttcgtcgaaaaccagagggaagacaagcccgggatgaacttcgatgtggactctgacattgagatccatggcaaaaaactcgcctatgtaagccgcggcggtctgaaattagagaaggccataaagacttttcctatagatctggatggagatatctgcatggatatcggcgcatctaccggcggctttactgactgcatgctgcaaaacggcgcagcgaaggtctacagtgtcgatgtcggctacggacagtttgcctacagcctgcggcaggacccgcgggtggttgtaatggaaaagaccaacgtccgctacctgaagccggaagatataggcgaacagctcgattttgcctcctgcgatgtgtcgtttatttcactttcgaagattctgccggccatttttccaattttaaaagatgatggttcgatggtgtgccttataaagccacagttcgaggcaggcagggaaaatgtcggaaagcgcggagtcgttagaaatccaaaggttcacagggatgtcattgcagaggtgttcggttttactgaggcgcttggtttccgggtgcaggggcttacgttctcaccgatcaagggaccgaatgggaacatcgagtatttgatgtatattctaaaaaatgccggagaatcgaagcagatagacatagcacaggttgtagcagaggctcacgaggcacttgacaggcgatgaaagatttttttatactgacaaaagaagaagccgaaaacacaatgaacggctttatttccgagattagcggttttattgaagataacggcggagcagtgaagaccagcgtgctgaacaggcagaggacttcggaaccgctgcctgtgccggagaatacagagtgtattttaacggttggcggagatggcacaatgataagggcggccatgaggacgatcaactccagacttccgattctggggatcaacaaagggcacctcggctatctctgcgatctcgatgagtcgaattacagggaggctttaagcaggcttttcgcggatgactacgagatagaggacaggatgcttttgtcaggcagggtgctttcggctgacggcgtaccagagagtggatttaatcacgcattaaatgacattgtgctgacatcgcggaatggtcttcaggtcgttcatatagatatctatgtaaatggtgagaagctctcgtcgtttaatggagatggcgtgatctttgctacgcctacaggttcgaccgcctacaatctttcggccggcggtccgatcgtcgatccaaagacaaagcttatcctgatgtctcctctgaatgcccatgttgtaggccagagaagcattgtaatggatcctgcatcgaaagtccgggctacagtcacccgacggaaccaggaggagctgtcagctgcggtggcatttgacggcagtacatcgatcccgctctatgacggagagagcatcgaggtcgtaagatcagatgagacagtccgctttataaagttgtcacagataaatttcttggaccgaattcgcgagaagcttcaggcagactaggcgtattgcctgaaggcggattgattcgccagtggtctgagtcagatctaacggaggaattttttgaaaaataaaagacagaaaaaaatacttgaacttattgtcagagatgagatcggtactcaggaagaactgatgcaaaagctcagggaatcgggatttgacgtgactcaggctacagtttcgagggatatccgggagatgaagctcacgaagatcgagacccacggaaagctgcactacgttgcattccgggagactgatgacgacatgaaggagaagtacgagagggttttcagagacggattcatttcgatggacaacgctcagaacatccttgtgataaaaactgtctcaggtatggcgatggctgtggccgctgccatcgactcgatgcattttaacgagatcgtgggttcgatcgctggcgacgatactatcatgtgtgctgttcgaagtctcgacgacactgtaaatcttatggggaaactgagaaacatcatagaagcataatcaactgcaaaagaaaggggataacgtatgcttgaaagtttaagagtggaaaatcttgctcttatcgaaaaagaggagatcgaatttgcggaagggctcaatgtgctgactggagagaccggggccggaaagtccataatacttggggctttggaccttgcgcttggtggaaaggcggacaggaggatggtccgcgatcccgagagagatgcctatgtcgaggccgttttttcgctggacgaatcggaggaggagcggcttagagcagctgattttgagccggaagacgggcagcttattttttcaagaaagataaaaggggcgaagagtcaggccaggctcaatggggagactgttcctgcagcgcggctaaaaaaagccggtgagctgcttcttgacatctacgggcagaacgagcatcagtcgctctctgacccgaaaaaacatcttccgcttctggatgaattcgtaaaaaaagacctgaatccggtgctcgaaaaattggcaccagtctataaaaaatacacctcgatcaggaagaaactaagtgaggccgatatcgacgagtcccagcgtaagagggatatctcttactacagccatgtctcggaggagattgaagacgccggcttaaaacctggcgaggacgaggagctcgaggctaagaacaaaaaaatggcgggttccgaaaaggtcgcgcagaatctttctgacgttcagaatcttctcttcggtgaagaggatgtgctttcactgataggagagtcccagagaaatcttgcttcgatcgcagattacgacgattctgtggcagaccttgggaagactttaggcgatgcatatgacattctcgaaaatttttcacatgagctgattggcgcagcagagaatctgacgtttgacccggcagagttcgaccaggtaacgagaaggctcgacctgataaatgacctgaagcagaaatacggccgcacgatagaggatattttcaagactaaagaggaagcggacgagaaacttgagcagttaaatgaccacgagaactatgtcgccggcctcaaaaaagagctcgcagatgcttcaaatgatttgaatgatctctgcgaaaaagctgaaaacatcagaaaaaatggcgctaaagttcttgaagaaaaggtcaaagaatcattaaaaaaccttaactttctgaaagcggattttgaggttgagatttcgagaacttcttactcggcgggaggattcaatgccgggcagtttttgatctcgacaaaccctggtgaatctttaaagccgctttctcaggttgcctccggtggtgagatgagccgcatcatgctcgccctaaagactgtcctggcttccgcggacgatatcaagacgatgatcttcgatgagatagacactggaatcagtggacgtacggcttcggcagtagcccgcgagcttaagaaggtttctgccggcaggcaggtaattctgatcactcacctgccgcagatcgctgcgctctctgacagacatttcctgatcgagaaatcggcgactaacgactcgacggtgtcaagcataaggcctctgaatgaggacgagattacggatgagcttgcgaggatgatcggaggagatgtcataaccgatgctgtaagagagagtgcgagggagctcagggagaaggcggagtgatgctgatggacgggcactaaattgtcagagcggccaggatggggctgcggggctcagtgcgcgtttttctgttcgtcgcgcgcgcctaattgcggccctcttgccaatgtatggttcacatacgtttatggtccaagcgggtggcaacccgggccgcagccagcgcgcttcctcactacgaaaaacgctgaattcgcccgctgccctctcctgtccgctctggcatattactgcgcgtccaggtatagtgcccaaacattcaggctccgcggagcacaagattatcaacatagatttattttctactgatatgggacataggccctcgaaaatattttaatatagatctgtgaggaagtcatttgctccaaacggatttcggaattctcaacatatgcaaggaagtacatggtttgcctatctgtggacactctgccatcccttccacaatattttactattttacgacaacctgaccatagaagtatttaattcttcgcgctagaattatatcagttcaagagaatattatgatttggtggtcaaaaggttgaccccgacatcatcatatcgtggaggtgcaaatgatgctttcaaagtacataaaggaactggtaaattacggaattgacagtgggcttacgccggagtgcgagcgcatttatacgacgaatatgctgcttagggaaatgcacgaggagagctatgacgactctgttgagacgacggacgagccactggaggatattttaaatggtcttctggatgaggctgtaaagagaggcctgatcggggactcggttacggagagggacctctttgacacggctcttatgaactgccttacgccgagaccggcagaggtacagagagtattctgggaaaaatacagagtatctccaaaggaagcaactgactggttttacgatttttcaaagaagacaaattatatcagaacatacagggtgaaaaaggatctcagatggaagacttctactccatacggcgatcttgatatcacaataaatctctcgaagcctgagaaggacccgaaggccattgcggcagccagaaatgcaaagcagtcatcatatcctaaatgccagctctgcattgaaaatgagggctatgccggaagactcaatcatccggccagagaaaatcaccgtattattccgcttacgataaatggcagcagatggggattccaatattctccatatgtttatttcaacgagcactgcatcgttttcaacggacagcatactcctatgaaaattgacaggaacgcttttaacaagctctttgatttcatcgagcagttcccgcattatttcttaggatcaaatgcagatctcccgatcgtcggaggctcgatactgacacacgatcatttccagggcggacactatactttcgctatggaaaaggcggattttacggatatgtttacagttccgggatatgaggatgtgacaagcggaatcatcaaatggcctctttcagtcatcagacttcgctgcacgaaccgggagaggatcatcgatcttgcagaccatatttttaaggcatggcgcggatatacggatcagacggcatttatatttgcggagacagacggtgagccgcacaacacgattacacctatcgccagaaagcacggtgatgttttcgagctcgacctcgcactgagaaacaacatcacgacgaaggagcatccgcttggggtttttcatccgcacgagaatctgcaccacattaaaaaagagaacatcggacttatcgaggtaatggggctcgcggttcttccttcaaggctgaaaaaggagatttttgaggacctcgcagacgcacttgtttcaggggaagacatcagatcgaacccggagctttctaagcacgccgactgggttgacgaaataaagcccaagtatccacagggatttacgaaggaaaatatcgatggaatcttaagagaggaagtcggacaggtattcagacaggtcctcgaggatgcaggagtcttcaagctcacaccagaaggccatgaggcattcatgagatttatcaagaccctgtaattatcagggtccgcagctggacgcgacgagcagaaaccgcactgatttcgccgccatgagtgtctgctctggcgtcttttcaactatttctcgtccagcagtgtaaattcgttcttatggtatttgatcagcccatccttcgccatcctcgagagctcggcgctcatagcgctgcgctcgactgagaggtagtcggcaagctgctggcggtcgaacgggatcgtaaagtggttagagtcgttctgttttgctatgtcagaaaggtaggagagcagcttctcgcgggtcgtgcgctttgacatgtggctgatcttacggttcatatagcggtttcgacgggtggcgatcttgaagagattctggatcagctgattgtggaaagtgcaggcctgctggcattcggtcagcatcctgtgcatattcataaagagaatcctgcagtcggtcagggagacgacgtcgtttggcatcggctcggaatcagacgcggcgtacgcttcgccaaagatctcaccggggctgataagcctcatgactgcggtgtttccccagtagtcgacagattcgacctgaagcttaccttccatcagaactccgatagagtcggtcttttcaccggccggaagcacaatgctgtctttcgggaaggtgcggatctcaccgcggacgcatcccatcagagcctgaatctgctgctcgctgatcttattaaaaatgcgggcatgtttcagctcgcttaaatccttttcttccatttttcacctatacaaaaaacgggtgggcgagtttgtcctgcccggtttctttttcatttgtagaataaaaacgcatccagacgccggaatccataatatttcttacgatagaggtgtcacgcttcagcggcagccgctcgaatgatttcttcgcttcatcaatgaggctctggagagtggcgcgcataaaagagcagtaattctccgggtcacggtcctttttaagaatcagaggattgtaggaaccggaacgaatgtcatctgacctgttggaatatgcagtgatcagatatataaatttaccgaggaaaaaaccgatatcgtacaggtccttctgatattcgtcctcgcgcattatgaaagcctgtccaaagacctcgccaaaacagcccgatacgagctgggtatttggctcgtttcttctcccgtatccgatcatctgctttgcggacttacggcaggaggcagcctgtctcgggtatttttcaacgatagaatcgagcagggctttcatcgaatgaatatatctcttctcattggcatttggagtgttgatgctgcattgaacagcaaaagaactcataagtatgtccatctcggcgacgtatctggcagtatcgcttacaaaggcgaggcgcttcgaaaacgggtgctggcgacagctgtgcatctctgctgcagggacgtcgtcatacaggctcgagaggataatgtacattaatgtcaaatcgtcgtttaacaggacaggaccctttgtaccggcaacttccttcagcgaatggcagagcccgcagtgataagccttgtatcgttttttatctttttcagacataccaattacagtatcagcaatgacaatatctgacataaaaacagctccgaattacttaaaaaaacttcactacatatattatagtagtatggcaaatttattgccattaaacctttattaaacgtataacactatccaaaatcaaaaaaaaggtttatactatttatcggaaattttgttctgacaaaataaggaggaaaaatgcgccactgtatgagtccgctggacttctcggttgacgagctcgaccagctgatgggtctggcagccgacattgaggagaatccagataaatattcgcatgcctgcgatggaaaaaggcttgcaacctgtttttatgagccgtccacaaggacaaggctctcatttgaatcagcgatgcttcgccttggaggacagacacttggatttgcctcggctgattcgtcttcagcatccaaaggagagagcgtctcggatactttaaggatcatttccggatatgcggatatatgcgcgataagacacccgaaagagggcgccccgctagtcgcttcgcttcattcgggaatcccggttataaatgcaggtgatggcggacacgcacacccgacacagactctggccgacctctacacgattaagtcgcttaagggcaggctggatcatttcactatcggactctgcggagatttgaagttcggccgcactgtacactcactgatctcagctctcgtcagatacgagggcgtacatttcgttttgatctcacccgaagaactaaagcttccgtcctatatcagggaggatgtccttgaaaaaaatggcgctacctacgaggagacagagagcctcgaggatgctatgccaaagctcgatgtgctctatatgacgagagtccagagagagcgttttttcaatgaggacgactatgtcagattgaaggaccgctatatcttagacaatgataagatgaaactcggaagagaagacatgatagttatgcacccgcttccaagagtaaatgagatttcggtagaagtcgatgacgacccgagggcacagtactttacacaggcgaagaaggctgtatttataaggatggcactgatactcactctgctggggattcaggtcgataagaacatccctcagcctaccaacaatccgtccagtgaaaaaggaggagagaaatgctaaatatcagcggaattcacgagggttatgtattagaccatatcaaggccggaacgagcatgaagatataccatctgctgaaactcgatgagctgaaggatgcgacagtggctattatcatgaatgcgaagagcaagaagatgggacacaaggatataataaagatcgagtgtccgctcggaagtattgacctcgacacgataggatatatcgaccacaatatcacagttgacgtgatcaaaaatgacagcatcatcgcaaaggagaagctcgcacttccaaaggtccttaaaaatgtgatcaaatgcaagaatccgcgctgcatcacatcgattgagcagggacttgaccaggtcttcatcctgaccgatgcgaaaaaagaaatatacagatgcaggtactgtgaagaggcctacacagagaaggaaacaatctaatgaaaactattaaagatttgatcaaaggtaccagtatcacgctcgaaagcggctctccggagactgagataacgagcctcgtttacgattctagaaaagtaaagaagggaagtctctatgtcgccgtagtcggagcgaatgtcgatggacacgacttcatagatcaggttgtagaagccggtgcagcaggcgttgtagtagagaaggatgtcacagtcccttcagatgtcgctgtcttaaagtcatctgataaccgcgaggccctggctctgctctctgccgcctggttcgatcatcctgccgacaagctgaaagtcatcggaatcaccggaacaaagggaaagacgaccacgacttatatgataaagtcgatccttgagaacgccggcaggaaagtaggacttatcggaactatcgaagctatcattggcgacaggcacattccggcaagcaacacgacaccggagagctatattgtacaggactatctctcacagatggtggagatcggctgcgatgcggcagtaatggaggtgagctctcaggccctgatgcttcacagggtgggcggcatgacctttgaaatcggaatttttaccaacatttcgccggatcatatcggaccgaacgagcacagggattttgctgactatatgcactgcaagagccttctgttccagcagtgccgccacggtatttttaatgcggatgatgagaatctcgagggaatcctgaagggacatacctgcactgtaaatacatacggcatcgaaaagccggctgattttgaggctaaggacataaggcttgttcaggagccgggatatctcggagtcaattataaagtcaccggaaaagaaaacttcgatgtgacgatcgatgtaccgggacgtttttcagtttacaattcgctctgtgccattgccgtctgccactttttcaatgtaagtgtcgaggcgatgcagaaagcattaaaggccgccagggtaaagggccgtatcgagatggtaaaagtttcggacgattttgcactgatgatagattacgctcacaacgctatggcgcttgagagccttctgacatcgatcagggaataccatccgaagcgcatcgtgacagtctttggctgtggcggaaaccgctctaagctcagaagatttgagatgggcgaggtttccggacgcctgtcggattttacgataatcacatcggataatccgaggttcgaagagcctgctgccatcatgaaggatatcgagaccggaatcaaaaagaccgacggaaagtatataatgatcgaggaccgcaaggaagcgataaaatacgctatcgacaatgggcagaagggcgatgttataatccttgcaggcaagggccatgaggactatcaggagatcaggggtaaaaaatacccgatggacgagagagtcctgatcgccgatatactggcaggccggtaaatttattttcaggagtagtatgttcgcacaggtatatgtcaatctcggtgtgacaaagctggatcacccatttacttacggcattccaaaggagctcgaggacgcggtaaagccgggcagcagagttgtcgtgccgatgcacggcaggaagctccgcggctttgtgataactgtagaagatgaatgcacaatagataaagacaaagtaaaagacatagtctctgctgaagctccgaagtcaggcgagggtgagatgtttgccctcgccggttttattcgtgagagatacggcggaactctgggacaggcgctctcagtcgtatttccatcgaccgcaaatgccgctgtaaagacatataaagtcgtgagaaggacaggggatattgacagtgccctgacagagcttctgtcaaaaaagaggcattcgaaatacgctgaaaagctcttttcaatacttcaaaaaaatgaaatatttctctgggacgatctgagacaggactacgatattccgtccgatgtgataagaaaggctgaaaaacagggactggtatctgtcgagaagcgcactcacctgagaaacccgttcgaaaatatgaaagggcttacacaagaaaggccgcagatctccctgaatgaagaccagagagctgtcctcgacgattttttgaaaaataagcctaaagtaagccttatacacggagtgacgggaagcggcaagacacttctctacattgcgatgattgagcaggtcctgaaagaaaaaaagcaggcgatagtccttatacctgagatagcgcttacattgcaaaatatcctgagattttacaggttttttggagataaggtctcatatgtgaattcgaggatgaatgcctcacttaaaaacgagcagctggagagagcaagagcaggtgaagtttctgttatgataggcccccggagcgcactttttactccgtttaaaaatctggggcttattatagtagatgaggagcacgagacaagctatgtcagcgggaagccgccgaggtaccacgcggtggaagctgcagtggagcgggggcggctctgcggtgcgcaggtcgtgcttggcagcgctacaccttctgtaagctctacacccatgccataaacagcgaatacactctttatacatggaaaagagagcaaatgacgctgcgatgcctgcggtttcgtagtcgatatgagagctgaactgaaggtggcaataggactattttaagccggaagctctatgatggcataaaggaccgcctccagaaaaatgaacaggtcatgctttatcaacagaagaggcgtggccgggaccgtatcttgcagagaatgcggagcggtgataaaatgtgagcattgcgatgttccaatggtatgcacagggacggcttcctgcactgccactactgtggcgcgaagaggccgatggtgcgcgagtgcccatcctgccattcgggcttatcggcacgatgcgcgcaggaactgagaagatcgagacagaagtgcagaggctttttccgaaaagccggatccttcggatggacgccgatacgacgaagacaccagacggataccgccagatcatatccgcattcaggaaggacgcagatattcttatcggaacgcagatgataggaagggacacgatttcccgggcgtcacactgatgggagtcctgatggctgacctctctctgaatgcagccgactacagggcgagtgagaggactttgatctgatacttcaggcgtgcggcagatcgggacgtggagaaaatcgggaagaggctgtgatccagacctaccagcccgaaaattttgctatagtttcagctgcgaaaaatgactaccggaatttttacaggcaggagagtgcgtacagaagacttctgcattttccgccgttttcgcatcttctgtcagtggagatcacatcgagaactgaggaagggtgcatctctatgggagcattcatcactggaaggctgaagaatgcttttccggacctctttgtggcagggccgacgccatcgccgatatcgaagatcaaggatatcttccgctacgaagtcgtgataaaggatacctcatacgaggcacttataaaagccagaaagcttatggatgaagcaattgcagaggcagacgctcctaaaaacgccgacctctggtatgattttgactagaaaaggaaggagaaatttatggcattaagagagatcagacagcagggggaccccgtacttgagaaggtttgcaaaccagttacgaagatgactccgagacttagggcacttgtcgatgatatgcttgagactatgtacaatgcaaacggtgttggactcgcagctccacaggttggagtgttgaggagaattgtggtcattgacgttggagagggcccttacgtacttataaatccagagatcactgagaaggacggagaacagaccggacaggagggatgcctttcagttccgggtgtctatggcattgtaagccgtccggagcatgtgaagttcaaggcttttgacaaggatatgaagccttatgaggccgaggccgagggactttttgcgagagctgtctgccatgagacagaccacctcgatggccttatgtacacgagactcgtaaaggacggtcttcacagttacgatgaagatgacaccgacgaaggagattctgagtaatgagagtgatattcatggggacgccggacttcgcagtcccgatactggacggccttgcggcagcaggccatcgcattgtgcttgttgtgacgcagcctgacaaggcccgcggcagaggcagaaaagtcacctactctcctgtaaaggagtgggcagttgagcacaatgtcccgacatatcagcctgaacgcatcagaaatccagagtcgatcgaagctgtaaacaatatcccggcagaagtcggagtggtagcggctttcggacagattctgccgaaggagatcctggaccatccgaaatacggctgcgtgaatgtccacgcctcacttcttccgaaatacaggggtgcggctccaatccagtggtcgatcttaaatggcgacgagtacaccggagtcaccacaatgcagatgggaccgggcctcgacgacggagacatcctgcttcaggagaaagtgaagatcgcagacgacgataccggtggcagcctttttgacaagctcgcagatgttggcgcctctcttctggttaaaactcttgaaggacttgaaaatggtgagattaccccgattccacagaacgatgccgaatcaacccatgtcggaatgatcagaaaggacatggggaagctcgatttttcaatcgatgcgtctgttctcgagcgccatgtcaggggactttatccgtggcctggcacatacacatattttgaaggcaaaagcctcaaagtgtacagggcttcggtaatcggcgaggcagagcttacacccgatgaaaaaaatgccgcgatcggcaccatcgtgcgtatctcgacggaaggagacggaagcatcgctgtccgctgctcttccggcgtgctctcgatttcagctctgcagctcgaaggcaaaaaacgcatgagtgctgcagcttttttgaatgggcatccgatagagaccggtatgagactgggctgagaaaaccggaattattaatgttaccttaacaaaactccaacaacagacagataacaggtgccatgatttcttagccggctccggaagaattgctttctggcagtccttacggagtcttttgttttgtgaaattgcctgaattatcagaaaatgggacaaaaagaaccgtccctactgtcccgggtttagaaaaaataccaaaaatttgataaaaatactttaaaaattcgtcattttatattaaactagaaagggtgattgtgaaatgtgctcaaaaaacgatgtgagtttttgtacaactttcacagaatacttttttcttggaggattcggggctatatgatcacaaatcagataatacagaagactattgaggggatgaatgcgataactaaggtgaacttcgtgatcaccgatcctgagggcattgcgctggctacgactgtcagtgacgtgtcggattttgggaagcctgcggctgagtttgcgaagtcgccggcggagagccaggtcataggcggacggcagttttttaaggtttacgatgagaagaacctggagtttgtacttatatgtatgtcggacgatgaggaaaagactcagatgatgggaaaggtcactgcactgcagcttcaggagcttacggtggcttataaggagcgctacgacagggacaactttatcaagaatctcctgctggacaatcttcttctcgtagatatttacaaccgcgcgaagaagctccatatcgaaccaaacgcactgcgcattgtcatggtggtcaagctcgagggaaataaacgcggagacgagctcgagaaagtcagaaatttattttcggcgcacagctcggactttgtgacggcagtcgatgaggacagcattattatcgtaaagcacctcaataaagacgattacgaagaagtcaaggagacggccaactccattctcgagcttctgggagaaagagaaggcaggagcataaggatttcctatggtacagtggtccatgacttgaaggatgtctcgcgttcttataaggaagctacgatggcactcgatgtcgggaaggtatttttctcggacgagcaggttatagcttattcggtgctcggtatcggacgacttatttaccagctgccgattcctctctgcaagatgtttatcggagagattttcggggacaagagcccggatgatttcgacgaagagacacttactacgatagataaatttttcgataacagcctgaatgtttcggagacttcgaggcagctctatattcacaggaacactctcgtttatcgtctggacaagatccagaagagcacgggactcgatcttagaaaatttgatgacgccattactttcaaaatcgccatgatggtggtagaatacatgaagtatatggaggaacaggatttttgattgaattatcacatgttagcaaaacatatgaggcaggagtgaaggcacacgcgcttaaagatgtgagcctgcgaatcgaaagcggggaattcgttttcatagtcggagattccggcgcaggaaaatcgacgctgatcaagctccttttaaaggagcttacacctacagagggcagcatcgtggttgcaggccgagacctgaacaagatgcgccaccgtgagatccctgaataccgcaggaagattggctgtgtattccaggactacaggcttttaaaggacagaaacgtctatgagaatgtggcctttgcgatgcgcgtaacggatgcatccaaaaaacagataaagcgccgcgtcccgcagatgctctcgagagtcgggctggcgagcaagtaccgttcactgccgggtcatctgtcaggcggagagcagcagagagtggccatagcaagagctctggtgaaccatccgaagatacttcttgcagatgagccgactggaaatctcgacggacacaacacctgggagatcatgaagcttttgaatgagatcaaccaggacggaaccaccgtcgtcgttgttacacatgatatggagatagtccgcgctatgaacaaacgcgtgatcacgatatataagggggccgtagtttcagatgaggaggaactttcatcatgaggctttcatcccttggatataatatccgccagggctttaagaatatctggcggaacaaaatgttctcgatcgcttctattgccacgatggcggcatgcatttttctgttcggacttttttacgcagtcacggtaaatttcggaggaatgcttaaaaatgccgagaagggcgtgtctgttacagtatattttgacaacaatgcgacgcaggacgagatagatgatatcggcacggctataagcaaaaggcctgaagtccggtcgtacaaatttgtctcggccgatgaagcctggagcgagttccagaagagctattttggaaaacacaaagatgcggcggattcatttgctgatgacaatccacttaaggacatggccaattacgagatatatctgaaagatgtctcaaagcagtcagccctcgtatcctttcttgagaagcaggccggagtcagggaagtccatcagtctgcggctacagccaggacacttacagatttcaactctctggtacagctgatttcgatgagcatagtcatcatacttattgcggttgcgatctttttgataaataacacagttacggtcggcatctctgtccgcagggaggagatcggcatcatgaagcttatcggtgcgaaggactcgttcgtcagggcgcctttcatagtagaaggtgtgaccataggacttatcggctcagtaatcccgctcgtgatcctctatgtcatgtacgggcgcatcatcagatacgtcgcgaacaggtttaatgcgctttcgaatatgtttgcatttgcacctgtgaacagtatttttaaagtacttattccggtttcactggtacttggagtcggtatcggatacatcggaagccgtctcacattaaagaaacatttacacgtatgaaaaataaatcatcatttaaaaaaggtgtttttgcaggcgttataggatgccttgtcgttattgcggtcgtgatccttacaggaggtttcgttgtaagcaggctttacgatgtcggattcatgggcataggagatgtcgccaaggccagcagtatttcaaagtttatcgacaaatattactataaggatgtctccgataccaaaaagaaggacggcatctacaagggacttatgaactcgatggacgacccgtattccaagtacatgacggcttcggagtacaaggatgagcttgaggacaattctggacaatatgtcgggatcggcgtctctgtctcaaaggacaataaaaatcgtgtcgtcgtgcagcaggtttttgagggctcttcggccgccaaagccggtattgtaaaaggcgatgtgatagtttcagccgatggcgcctttgcttcgaatctgagcctgacccagtttacgaaaaaaatccgcggcaggtccgggacagatgtgacgatcgtctacacacacgatggcgccactcacactgtaaagctgcgccgtgccgcagttgaaagcccatctgtatatggaaaaatgcttgacgaaacgtctggcataggttatatagaaataactgaattcaattcaaaaacacagaaagagtttgaaaaaaagctctcagaactaaagaatcagggtatgaaggccgtgatctacgacctgcgcacgaatccgggaggacttgttgactcggtaacgaagatacttgacgatcttctgcctgaaggcacgaccgtctatatgatggacaagtacggccacaagaccacatattcctcagatgacaagaagcaggaaaagatccctacagtggtacttatctcgggagagacagcctctgctgcagaaattttttcaggagcagtcagggacttcaagtacggtacgctgatcggcaccaagacttttggaaagggaatagtgcagcaggagttcgaattaaacgatggttcagctcttaagatgacagtcgagacctactacacgccgagcggcgagtgcatccacaagaagggcataaagccggatatcgaactcaaatacaagtattcaggggaccctgcgaaagtcaccagtatggatacttatgatttttctcaggacaatcaggtgcagaaaggcatctcagttttaaaaggaaagttggaaaactaatgctggaatttgatcagatgaagagcgagctgaaaagctatgacgacacactgcgtgaagtcttcgattcactcgatatagaaggaaagaaaaataagatccaggagatggagcgcgagatggaagctcctgatttctggaacgatgcagagacggcgacgaagaagagccaggagctcaagagcctgaaggacgatgtggctgtagccgacagtcttcagcagaaatatgacgacatcgagacgtttatcgagatggatgccgaggaggacgaagacgacccggctatgcttgaggacgcaaaggaagagttcgaacagttcaagactgatctcgagaatcttcgccttaagacacttctctctggaaaatatgaccacaacaacgccatagttaccctccatgcgggagcaggcggcacagaggccatggactggacatctatgctctacagaatgtattcgaagtgggcagacaagcacggctttggtatagagcttctcgacgaggtggaaggcgatgaggcaggacttcagtcagtcacttttcaggtgaacggtgagaacgcctatggatacctgagatctgagaagggagtacacagactggtccgcatctctcctttcaatgcgaacggcaagagacagacctctttttcaaatgcagatgtaatgcctgaactgaaagacgcaccgaacattgtgataagggatgaggatatcagaatcgatacctaccgttcaagtggcgccggcggacagcatatcaataagacttcatccgccattcgaattacacatttcccgaccggaatcgttgttacctgtcagaacgagcgaagccagcacatgaataaagacaaggctatggagatgctccgtgcaaaacttgaggttttgcgtgaggaggagcaggagcagaaggaagctgacatcagaggagatgtaagctcgataagctggggcaaccagatccgctcctatgtcttccagccatacacgatggtaaaggatctccgtactggcgaggagacttcgaacgtccagggcgttatggacggagacctcgatccgtttatgaacgcttacctgaagtgggtatctcttggaaagccgaagcgcggtgtgacggacgcagagtaaataatacagctgcatatttcggatcacccgaaagttacttaatttaatacatgagatttattaacatgtccttgactgaaatgcaacattatgttagagtattccagtcaaggacatttgtttttctgtgaaagacagtccgcgggccgcggaagatgtggccagagaatttttacatgagggacaaaatggcagaggaagcatactatgttctgaaggaaaaggcagttccggaagtcctcttaagagtcgagaaggcgaagcttttgctggagtccgggaagtgccagtccgcatcggaagcggctgaaaaggcagggatttcgagatcgagtttttacaagtataaggacgaaatcttcagataccatgagaatgagaagggcagaacggttacgatggtcgtaaagcttatcgacgagccgggccggctgtcgaagatacttacgagtctggcggatataggatcgaatatcctgtccatccatcagtcgataccggttaacggtatagcagcgatcacgctgtctatggacctgccgaaggatatggacgccgcagaggccactgagagggtcgaacagataaatggagtctcttatgcgagaatactcgcagaggagcagttctagtgagaaaggaaaaagaatgaaagcagcgataatgggttatggaaccattggaagcggagttgctgagacactcagggttaaccacgatgttatagcgaaaagagtcggagaaccaattgaattgaagaaggtccttgacttaagggaattcaagggtgacccgattgagccgcttatcgtacacgattacaaggatattgtaaatgatcctgagataaggatcgtagtcgagactatgggaggagtcgagccggcctacacttttgtaaaagctatgctcgaagccggaaagaatgtcacgacatcgaacaaggcacttgtagcagacaagggagcggagcttataaggattgccagagaacacgatgtaaatttcatgttcgaggcttcagtaggcggcggaatccctattatcagatgcattgagtcatgtctcaccggagatgtgatcgaatatatagccggaatcgtaaacggcactacgaactacatgatgacagatatggctgaaaagggagccgatttcgacgcagtattaaaagaggctcaggcgaaaggctttgccgaaaaggacccgacagctgatatcgaaggatacgatgccacgagaaagatcgcaatcctgacctctctcgtcgcagggcagcaggtggactacaacgatatcccgaccgagggcataacccatatttcagtagcagatatgaaatatgccagaaagatcggccgaaagatcaagctcctcgctacgagcagggaagttggaaatacctattcatgcagggtcgcaccgttccttgtcgctccggagagcccactttacaatgtggatggagtcttcaatgcagtatttctccatggaaatattttaggagacggaatgttctacggttcaggtgcaggaaaacttccgacagcttccgcggtagtcggagacatcgtcaggatggcaaagcaccttaataaaaatataccgatagagtggggagaggaaaagctcgagctcgcagatcctggccttgacagataccgcttcttcgtccgcacgacagatgaccagagtgccattgatactgcgtttactgaagaggttgagtacatagatgcggatatagtaccgggtgaagttggatttatcacacctgagatggagcagagagagtttgacgagagcgtaaagaaactccctggaacagtcagcacgattcgtctggcgtaatcagcacagattttttatataaattggaggaacaatgttaatagtcaagaagtttggcggtacctcagtcgccaacaaagagagaatctacaatgtggcgaagcgctgcatcgaagattacaaaaaaggcaacaaagtcgtcgtagtcctttcagctatgggagatacgacagatgacctgatcgccaaggcgaaggagattaatcctgatccgccaaagcgtgagatggatgctctgctttctacaggtgagcagatttcagtggctctaatggctatggctatggccaaactcggagtacctgcagtttcactgaatgcgttccaggtagtcatgcatacgactcaccatcacctgaatgcaagatttaagaaggtagacaccgacaggatcaatgcagagctcgaccagggcaggatcgttatcgttaccggattccagggcgtcaacagatacgacgatgtgactacacttggacgaggcggttcggatactacagcggtagcacttgcagcagttttaaatgcagatgcctgtgagatttatacagatgttgatggagtttacacggcagatccgagaatcgttccagatgccagaaaattaaaggaaatctcctacgatgagatgcttgagcttgcgaccttaggcgcccaggtacttcacaacagatccgtagagatggccaagaaatacaacgtaccgcttgtggttcgttcaagtcttacaaatgcagaaggaacagtcgttaaggaggtaacgaagatggaaagcatgctcgtgagcggagtagcagcggataaggatgcagcccgtatagcaatcattggattaaagaatacacctggaatagcattcagagtatttgatcttctcgccaagaagaatataaatgtagatatgatcctgcagtcgatcggcagggaggactcgaaggacatctcatttacagtagatcagacacaggcaaaggaggcagttcagatactgaaggaaaatcaggagaggctcaccttccagaaacttgtggaggaggagaacgtcgcaaagctctctatcgttggcgcaggaatgcagtcgaacgcaggagttgcagccaagatgttcgaggctctggcagatgtcggagtaaacattcgcatgatctccacttcagagattcgcatcacagtccttattgacattgatgatgtaaatgtcgctatgaagtctgtacatgatgcatttataaattaacagcattttttaaagtgatttaccaaggctctggcgctttcgtcagggccttttttaaaatttggagctattgagaaaaatttgactcaatttcaatgaaaatttatcaaattttagcttgatatcacgaattcttcacggttagttcacatattgtagaaagaaaacaataccggcgaagatcctcagaaagaaattaaacattttgcacaaatttcttataaccaatttgtgcaaaatacacaaaaatacaatttgacaagtgcttttttgcgtattagaatcagaacataaatctgaggtatgctgttttgagtccggaacggctgcttcggggagaggattgaagaggaaaggaagtgatagcatttggatacgcttgtgacttcgctgaaggcggacatgaatgtcgacaccgtatttacgataccgatattcggaggcattccggtatatgaatccgtggtcgtgacctggatcattatagccgtagtgtttgtggcctgccttcttatgacgcggaacctgagcgtggaacatccgagaaagagacagcttctgctcgagagttttgtcgagtggctgtacaaatttttcggagagactatcggagaaaaagggaaacggtacgttccgtatctggtatcggtacttatctatatagcgatatcgaacctgatcggaatcatcggattcaagccaccgacgaaggacatgaatgtgacggttgcgctgtctcttatgagcatcatactcattgaggcgagcggagtgatagaaaaggggccgaagaagttcctgcacagttttgcagagcctatggcgatcataaccccaatcaatatcttagagatctttatcagacctctgtcactttgcatgcgacttttcggaaatgtgctgggcagctttgtaatcatggagctccttaagctcgtgatcccggtcgttctgccggcgctggcatcgctttactttgatatcttcgatggcctgattcaggcctatgtatttgtgttcttaacgtctctgtttataaaagagtcggttgagacaagtgagtaaatcaatttttttaaggagaatttaaaatgagtgcaacattatttgtagctattggagcaggaatcgcagttttaacaggaatcggcgcaggcttgggaattggaaaagccacatcgagcgcagttgacgctatcgcaagacagccggaagcatctggaaagattcagtcatcacttcttttaggatgcgcccttgccgaggcaaccgctatttacggtttcgtcatcgccctgcttatcattctgttcctgaaataaaagcaggccgtgcaaacgggaggacaggcaaatgttaaagattaatttctgggacatcctccttacgattgtcaacgtcctgatcatttactggatcttaaagaagttcctcttcaacagagtccttcgtgtcatcaaggagagggaagcttctataaaggacagatacacagaggcggacaatcgtaagaaggaagccgataaggaaaaagcgaaatatttaaaaaagcagtccgctgctgaggaagaggccagcaggatcattaaggaagcccgtatcgaagcagacaaaatccacgacaagaggattgctgatgctgctgaagaggctgacgagatcagagcaaaggccagacgggatgcggagaatacgaagcagaggaatctggatgaaagccgtgaggctataggctcacttgcccttatggcagcgaagaagattttggagaacggtgataaatatgagtcaggcaacggtgcacaataacgcattggtattgtctgagctgccggtcgataagaacgaagttttgagcgtcctgcgtgagctcgattccacacccgcatatatggaattactgatgagcccggtcatttacagcaggaagaaggaagctgttgagcgaaagctcgcagaggcaaaccatttttccagaatttttacagattttctgcttgtgatgatcaggaatcacaatgagaaatatatacctgacatcctccgcgaatatgtaaagatcgaggaagagaaggatggcctgtatgtagctgatctccagtgcgccaggcaggatgagattgaaaaagatcaggagtgcgccaggacggcactcgagaaaattttcccgggcaagacgttcaggttctgtgtcgaggtaaaaccgtcgctgatcggaggctatattgtccggtgcaaaaataacatagagattgacaggagctacgagggccagctcagacagttagctaaaaaaataaacgggaggtgagattatggcagcagttagtgctaccgatattatctccatcatcaggagtgaaattgaaaattttgatgccgatttcgaggcgaaggagaccggagaggtcataagcgtcggagacggcattgcccgtatttacgggatagaccatgcacagtacggagaagttgttgtctttgacaacggcgtaaaggccatggtccaggatataaaagaacacgagattggtgtcgttctgttcggacgtgactttggaatccacgagggaagcagagtcgcaagaaccggaaagagagcaggaatcccgactggcgatgcttttcttggcagagtcataaatgcgctcggcgagccgatagacggaaagggcgatatcaaagaagatgagtaccgccctgtggagcacgaggctccggggatcatcgacagacagtcggtagatactccgctcgagacaggaatacttgcgatcgactcgatgtttcctataggccgcggccagcgtgagcttatcatcggagacagacagaccggaaagacttccatagctacagacaccattctgaaccagaaaggtaaaaacgtcatctgcatctatgctgcaattggacagaaggcttctacggtcgccagagtagttgaaaatttaaaaaaattcggtgcgatggactacagcatcgttctcgctgccactgcatcagatccggtcgcagaccagtacatagcgccgtacgccgccactgcgatggcagagcattttatgaatcagggaagagatgtgctgatagtctacgatgatctgtcaaaacatgcggtcgcatacaggaccatctcgcttcttctcggcaggtcgccaggacgtgaggcttaccctggagatgttttctatctccattcaagacttctcgagagatgcgccaagctctcggatgctaagggaggcggatccattacagcgcttcctatcattgagacgcaggatggcgatgtgtcggcttacattccgacaaatgtcatctctattacagacggacagattttcctcgagacaaagcttttcttcgagggacagagacctgccgtaaacgtcggactttcagtctcccgtgtcggcggagctgcccagacgaaagctatgaagaaggcttctggtaccatcaggatcgatctcgcacagtacagagagctcgaggtatttacccagttctcttcagacctcgatgagacgacaaaggcacagctcgaccacggcaatgccctgatggagcttttgaaacagcctctgaatcatccgctgtcgatggcagatcaggtgatcactctcgtacttgctcaggaaaaatatttcgacgatgtcgacagatcaaaagtcaagaagcttcagctcgatacgatcagtttcataagggacaacgccgcagacgttgtaaatgagatcgaggagaagaaggagcttacagacgaaatcaaacagcgcattatagatacggcgaagaagtacaaggcatcgaggtgataagatggcttctacaaaagagataaaagacaggatttcgagtgtccgcgatactttaaaaattacgaacgccatgtacctgatttcatcttcgaagcttaaaaaagcaaagaaggcacttgcagagaccgagccatttttctattcgctgcagcagtcggtgacgagacttttgaggcatgtgcctgagatgaagagcatctactttgaggatgaggatgttcacgacgaagaaaaaaaggtcggactcctcgttgtcacggccgacaaaggcctcgcaggtgcgtacaaccacaacgtcctcaaggcgatggaagagcagctcacgaaatacaaagatgcgaaaatttactgcatgggccagatcggaaagcactacctcgaggcgaagggctacgatatcgacaccgaattcaactatgtagtgcaggacccgacactttcgcgtgcgagaagtatttctgagactcttattgatgatttcaggcaccacagagtcgacgagatcgtcatgatctacacccgcatggaaaatgctatgacagagaatgccgaggtaaggcagcttctgccgcttgtcagggaaaaattcatcgacaagagggtacagaagcttaaaaatctgccggtcgatattccaatggagatgttgtcattcgtcccgtcgcctgaagcggtaatggatcgtatagctccggaatatgtcgtcggattcgtttatggcgcactggtcgagtcgttctgctgcgagcacaatgccagaatgaccgcgatgcagtcagctaccgacgcgggagaaaaaatgctcgagtatctgagcactgaatacaacagagcccgccaggccgctatcactcaggagatcactgagatcgtagccggtgcaaaggcacagaagaaggatagttgacaggctttggttctgaaatttttcaggacagatgattggctttttgcctgctttttttacaggataaaacagccggatttttttaggagaagaatatgacaggaaaaatcgtgcaggtttccggaccggtcgtagatgtcgtctttgatggcgacgagctgccacctatccgggaggccctgtcagtagataacgacggaaagaaatgcataatggaagtcgcttcccatcagggaaatcatgtcgtccgctgcatcatgctttccgcatcagaaggcctctaccgtgatcaggaagtcgaagataccggaagcggattaaagacaccagtaggagagaagacgctcggcagacttttcaacgtcctcggtgagacgatagatgacggtgaaaaaattacagacgctcctgagtgggagactcacagggagccgccaaagtttgaagatcagaaaccggccacggagatgcttgagactggcatcaaggttatcgatcttctcgcaccttacgctaaaggtggaaagatcggacttttcggaggcgccggagtaggtaagacagttctgatccaggagctgatctcaaacgttgccacggaacacggtggctattcgatcttcacaggtgttggagagaggtcccgtgaaggaaatgacctctggactgagatgaagtcaagcggcgttttgaagaagaccgcgttagtcttcggccagatgaacgaaccgcctggtgcacgtatgagagtcgccgagaccggacttacgatggctgagtatttccgtgaccacgacaacaaggatgtgcttctcttcatcgacaatattttcagattcactcaggcaggctccgaggtttcggcgctgctcggacgtatgccgtcagccgtcggctatcagccgacgcttgccaacgagatgggcgagctccaggaaaggatcgcttcgacgaagaacggatcggtcacttctgttcaggctgtttacgtcccggcagatgacctgacagacccggcaccggcgacgacatttactcaccttgacgcgacgacagtcctttccagaaagatcgtagaacagggtatttacccggccgtcgatcctctggagtcgacttcccgtatcctcgagccggatgtagtgggcgaagagcactatgagacagccagaagagttcaggcaatccttcagaaatacaacgagctgcaggatattatctccattcttggtatggaagagctttctgatgaggataagactctcgtctacagagcgcgtaagatccagagatttttgtctcagccatttcatgtcgccgagcagtttacaggagttcccggagtctatgttccggtcgaagagacgattaagagcttcaaggcaatcctcgacggtgagatggacgattaccctgagaacgcatttttcaatgtcggcacgatagaagacgtaaagaaaaaggcagagactctgaagtgaggtgtttgcaatgttctatttgaaagtgatagcaacgaacaggacgtttttttcgggatttgctgattctgtgtcattccagtgtcacgatggcaggagacagatcctctcccaccatgaaaatatggtcattgctctagatgaaggccttataaatatcgcgccttctgagcatgccggcaacggttcggagagctcaaaaggtgagataactggtcttgccggcatgggatttgccgaagttgtaaacaaccgtgtcactataatcgtcgaatcctgcgagaagccggaagagatcgatgtgcaccgtgccgaggaagcaaaggagagagcacaggagagactccgccagaagacgagcattgaggagtactaccactcgagagcgtcactcgcccgagcaatggcgcgtctcgccgccgcaagcaaaaacaagatcaaataaaaaatatacgccggccgcagggctggcgtattttggctccggcagaatttaaaatgccggatcttttgcaaaaaataaccccgtccggattttccggacggggttacttaaactatgcaatttttatctggtctcttcgttaaacatcctgcagccaaatccctcgagactgactgtcttgtgttcagcttcgacctgaggatctataccatcctctacatcggtatcgaaatcagaatagaaatctccgatggtaccagttctgtgcagcttgtagcctccactggcaagtgacctcctgtatccgatacccgaaataagcttcggaagaatcggtacaaaaataactgctgcgacgataagtgacactaaaagaataacgtctgtcatatagattcctcctttgtgtatgtttttttctgctatatatattataacatgtttttgagtgagttcaattgaaataaaatgacatcatgatgaaatagattcaaccataacgtctttataatagaattgttttttggcttgcaattgcaatgcttgacatttttctgcagtgatacgataatttaattttgtgaacggtatatttttaacaatcgaggacagtttatgtatttagcagatagatggaaagattacgaagtcatagatacttcagacggcgaaaaactcgagcgctggggcagatatattttgcagagaccggatccgcaggtaatctggaacacgccgaagggcccggaatggaagcgcgtaaatgctcattaccacagaagccgcaagggcggaggcgactgggagattttcgaccttccgaaagagtggacgattaattatccactcccggcaggcaggctgaccttccatctgaagccgttttcattcaagcatacaggtctttttcctgaacaggcagctaattgggagtggttttcttctattataagtagggctaaatcgaaaaatccggatcgccagatcaaagtcttaaatctgtttgcctatactggaggcgctacagtcgctgccgcgatggcaggggcagaagttactcatgtagacgcctcgaagggcatggtaacctgggcacatgaaaatgcaaattcgtcgggccttgaaaatgcccatatccgctggcttgtcgacgactgcatgaaatttgtcgagcgcgagatccgacgcggcaatcattacgacgggataataatggacccgccatcctacggccgtggcccgaggggcgagatctggaagatcgaagaaaaaatcttcccgctgatccaggactgccgccgcattctgacatccgacccactcttctttctggtaaattcctacactacaggcctccagccagcggtgcttcactatatgctcaaaaccgcacttaaagatctgccgggcaaagtcgaggccgacgaagtcggccttccggttacaaagagcgggcttgtgctcccgtgcggcgccagcggccgctacgaactgggacagtagggacggttctttttgtcccatttttggaaatttcgggacagttgttaaattaacatacgggtatagcccgcagccttgacatgaacctcaggtactgcgcctgtcaataaaacttctggcaatcgacgagagaacatttgacattttaagagccgacgtgattgggcagcatagcattgatcaacgggattggaaagtatagcattgcccgacgagattgggcagcatggtattgtcctgaagccctgtcatggccaagccacttaaggggcctggccctatcctctggcaccgaaaaaaagaatagtcagccgtttaatcggagagattacagcaggctttatttatatatgtaaattgcttgacgtcattacgtacagaaagagggaagtcaaatttcagtacataaagcggcgtggaaatttatggacggattccggctggctatatttatatatgtgaattttttactgacaaagatgggctttacggactgagaaggaaaagtgactaggagtccgtaaaaaggcgagagcaaatacggactgatactagaaaatggttttgagaccgtaaaatggtgagagcaattacggacttgggtagaaaagtgagcagaggtccgtaaaagcaggaaagagattacggactgaggtgaaaaaaaggctgtgagtccttaaaagcaagtgagagattacggactgagaaggaaaagtgagcagtagtcagtaaaatggcgagagtaaatacggactgagaaggaaaagtgactaggagtacgtaaaaaggcgagggcgattacggactgggatggaaaagtgactaggagtccgtaaaatggtgcgagggaatacggactgagaaggaaaagtgagcaggagtccgtaaaaaggcgagagcaaatacggactgggatggaaaagtgactaggagtccgtaaaatggtgcgagcaaatacggactgggatggaaaagtgactaggagtccgtaaaatggtgcgagggaatacggactgagaaggaaaagcgactaggagtccgtaaaaaggtgagagaaattacggactgatactagaaaatggtttcaagtccgtaaaatggtgcgagagattacggactcaggcgtggaaatggattagagcccgtaaaagcaagtgagagattacagattttaggatctgtggcggtaaatgtgaggcggggcagggagtcatcgaaggacccttatgagacgccggcgcttagcgggcgttctttgcccgcttacgcgccgttgcgtctcatacggagtgagaacgagtccttcgatgactccctgtctccgcctcaatcaaataacagagcgaaaacaagtactccgcatcctcatttttcaaaaaagaagcaataattgtacgcgataaaaaacaataaaaagattgcaatccctgcgtaaagcgagtaaaatgaatcttgctgtgacatgatagctatgaagcgcgaggttgctgccgaagctggcgtaagcagtgtatggcaggtttttccgtggagcgaatgtcaagttaggaaactggcgacaagtcactgtacagtttaagaaatctgttcttttgggacagagggtatgttcaggattaggacacacccggttatgtgtacagtcaccacttgtcgaactgaattagtccgatataggaggcggctttttttatggcaacacaggttatgcgtattactctgaaggcttatgatcacgagctcgttgatcagtcagccaagaagatcatcgacactgttaagaagaatggtgcacaggtttcaggaccggtacctcttcctacaaagaaggaagtggttactattcttcgtgcagtccacaagtataaggactccagagagcagttcgagcagagaacacacaagagactgatcgatatcctgacaccgacacagaagatcgttgattcactttcacgtcttgagatgccggcaggtgtatatatcgatatcaaaatgaagaacaaataattgatcagcagtttttcattttgatagcaactattttaatctagaatgaacatttggggattgacctcagacgttccgctgtagaaaggattttttatgaagaaggctattttagctacaaaggtcgggatgacccaggtctttgacgagaacggcaatcttattccggttaccgtattactcgcaggtccatgcgcagttacacagatcaagactgttgagaacgatggttacgatgctgttcagctcgctttcacggacaaggtagagaaggccgttacaaaagatgcaaacggaaagaagtctgtagctcaccgtcatggcgtaaacaaggctgagaagggacacttcgataaggctggagtttcatcaaagcgttatgttaaagagttcagatttgagaactgcggcgactacagccttgcacaggagataaaggctgacatcttcgcagcaggagataaggttgacgtcacagctacttctaaaggtaagggattccagggtgctatcaagagacttggtcagcacagaggacctatggctcatggttctaagttccatcgtcatcagggttcaaatggttcctgctctactccttcaagagtattcaagggcaagggaatgcctggacacatgggttcagtaaaggttactacacagaatcttgaagttgtacgtgtagatgctgaccagaaccttatccttgtaaagggagcagttccaggacctaagaagtcacttgttactattaaagagacaacgaagcgataaggcagcggaaaggagtaaatcaggatggctaaggtatccgtttataatatggacggcaaagaagtcggaacaactgagctttcagatgccgtattcggagtagaagtaaacgagcatttagtacatatggctgttgtgaaccacctcgcaaacaagcgtcagggaacacagaaggccaagacacgctcagaagtttctggtggcggcagaaagccatggagacagaagggcacaggacatgccagacagggttcgacaagagcaccacagtggacaggcggcggaatggtattcgcaccagttccaagagactattcgttcaagatgaatagaaaagagaaggcaggagctcttaagtcagtcctttcagacaaggtcaatgagaagaagcttatcgttcttgatgagctgaagctcgatgagatcaagacaaagagatttgcagagatcatgaagaacttaaacgttgagaaggcatatgtcatcctttcagatgacgaccagaacgttatagcatctgcaaagaacattcctacagtaaagactacacagactggttcaatcagcgtatatgacgcactgaagtttgacacagtaatccttactcaggatgcagcaaagaagatcgaggaggtttacgcataatggcgacagtgaattactatgacgtgatcataagaccagtcgttactgagaagtctatgtcagaaacgacagataaaaagtacaccttcttagttcatccggaagctaacaagttccagataaaggatgctgttgagaagatgttcgatggcgttaaggtagctagtgttcacacgatcaacaaccagggcaagaacaagcgccgtggtgctacagttggaaagacagcagctacaaagaaggctatcgtaaagcttacagctgattcaaaggatatcgagttattcgcaggactttgaccgaaagcttcgagatgaaaacaagccgaaggcgcagtttgaatccgaagcgaggccgttctttgagattagcgaacgcaaacgacagtgcagcgtgagcttaacgaaaagaactacatattatactcagtaaagagtgataacaaaacatttcgaaaggagaaaaaatgggcatcaagtcattcaacccatatacaccttccagaagaaatatgacaagctcagacttcaaagagattacaaagaagacacctgagaagtcattactggatgtaaagaaaaagaattccggccgtaacaaccagggtaagatcacggttcgtcatcacggcggcggcaatcgtcagaaatacagaatcatcgatttcaagagacagaaggatgacatccctgcaaaggtagttggaatcgagtatgatccaaaccgtacagcaaacatcgctctgttaagctatgctgatggaacgaagtcatacatcctcgcaccagagggactcacagacggcatgaccgttatgagcggtgagaacgcagaggttcgtgtaggtaactcacttcctctttcaaagattcctatcggtactatggttcacaacatcgagctttatcctggaaagggtggccagatggttcgtgcagctggaaatgcagcacagctgatggctaaggaaggtaagtacgctacacttcgtcttccttcaggcgagatgagactcgttcttctgaactgccgtgctacaataggtatcatcggaaacggtgatcactcacttgtaaaatatggtaaagctggaagaatcagacacatgggaatccgtcctacagttcgtggatcagtcatgaaccctaacgaccatccacatggtggtggtgaaggtaaggctccagttggacgtcctggcccgagcactccttggggtaagccggctcttggtcttaagaccagaaataagcataaggcttcgaacaagctgatcatcagaagaagaaacggtaagggattaaagtaaggaggattctatggcacgttcacttaaaaaaggaccatttgccgatcagagtttattaaagaagatcgatgctatgaacgccagcggtgataagtcagttatcaagacatggtcccgccgttcgacgatcttcccatcatttgtgggacatacgatcgctgttcatgacggcagaaagcatgttccggtttacatcacagaagatatggtaggtcataagctcggcgagttcgttgctacccgtacatacaggggccacggcaaagacgagaagaagaccggcgttcagtaatttttaagcataagaaaggaggatttctatcatggctaagggacatagaacccaggttaagcgtgagagaaacgatcagaaagatttaagaccatctgcaaagctttcttttgcaagaatgtcggtacagaaggcctgctttgtattagatgccatccgcggaaaggacgtaaatacagcacttgctattgtccagtataatccgagatatgcatccagcgttatagagaaacttctgcgttcagcaattgccaatgcagagaacaacaacggactcagaagagagaacctttacgtagcagagtgctacgcaaatcagggacctatcatgaagcgtatccagcctagagcacagggacgcgcttacaggattgagaagagaatgagtcacattactgttgtactggatgagaaataaggagaggaatacaatgggacagaaggttaatccgcatggcttaagagtcggcgttatcgatgactgggactcaaaggggtacgctgacaaagaatttgcagattatctcgttgaagatcacaagattcgtgaattccttaagagaagctttattcagcaggagtttcgaagatcgagatcgagagagccagcgacgtgttaaggccgttgtttacacagcaaagcctggtgttgtaatcggaaaaggcggagtgagatagagaaggttaaggcagagcttcagaagttacaaacaagaagcttgtagtagacgtaaaggaagttaagcgtccggatcgtgacgcacagcttgttgccgagaacatcgcttcacagcttgagaaccgtatttctttccgtcgtgctatgaagagctgcatcagccgttcaatgaagacaggcattcagggtatcaagacaagctgtcaggacgtcttgtggtgctgatatcgccagaacagagagctataacgaaggaactattccacttcagaatatccgtgctgatatcgactatggttttgcagagggagataccacttatggtaaagtcggtgtaaaggtatggatctacaagggcgaggttcttcctagcaagaagaaagcccaggcagaaggaggtagaaactgatatgttagcctaagagagttaagcatcgtaagcagttccgcggttcactcgcaggaaaggcattacgtggaaataaggtcactcagggtgattacggtctcgtaagcctgacccatgctggatcaaggcaatcagcttgaggcagcccgtgtagccatgactcgttgtgaagcgtggcggaaaagtttcatcaaagtattcccagatcaacggttacagcaaagccggctgagacacgaatgggttccggaaaaggcgcccttgatactgggtagcagttgttaagccgggccgtgtcttttcgagatcacaggtgtgtctgaagaatcagcaaaagaggcactccgacttgccggacataaacttccatgcaggtgcaagatcgttgcccgtgaaggcttagaaggcggtgaagcagatgaaaactaaggattatatcgaagaattaaaaggccagtcagccgatgagctttcagcaaagcttacagacgctaagaaagaactttttaacttaagattccagaatgcgactaatcagcttgacaatacagctagacaagatgttgtcgtaacatgctcgtattcagacggttcttacacagatggtaaccagtaacggtgaattagagaaaggctttaataatggaagagagaaatcttagaaagaccgtaccggaacgtggtatcgataagatggacaagaccatcaccgttgcggtagaagataaacgtaagacatcctctttatggaaagatcgttaagaggacataaaaacttatggctcatgatgagaataatgacgctcacgagggcgatagagtcgcgtaatggagaccagacctctgtcaaagaacagagatggagactcgtcgatataattgagcgtgctagtaaagaaagcgaggaattattatggtacagcaggaaaccagacttagggttgccgacaacaccggtgccaaagagctcctcacaatccgtgtcatgggcggatcgaccaggagatatgccgatatcggagatatagtagttgcttcagtcaaggatgcaacacccggcggcgttgtgaaaaagggcgacgttgtaaaggctgttatcgttcgaacagttaagggcgttcatgtaggatggcagcacatcaagttcgatgagaatgcagcagtcattatcaatgaggacaagactccgaaaggaacccgtatatttggaccagtagcaagagagcttcgtgataagcagttcatgaagatcgtttcccttgctcctgagacactttaaggaggaaaaccgatggcaagtttgaagataaagaagggtgacacagttcgtgttatttccggcgccgacagaacgcagagggaaaagttaaaggcggtagaccgttgctgatacctcagggatctcggctgctttaccaagtccagcgccaacgtggccggccttatcgccgactactacgagtcggtaaagcgcatgttttaccaccctttacaacctttgtgacacgcttgatggagacacgttatcctcgtattcgtcctgacgggcgtctctgttatcacgtctcatctatcgcttcctccaaaaatccagttcctgcttcttgctgcacagcgagagctgcaacttttccagcgtaaatatatccgcctctgtcaaaaacaacggtctgataccagcatcagtagctctcttgcgataacgcctcagcttctttgcagcctcaacatcatttgtcttctcaaggccatcgcttacttccttatcaagggtggaagctgatactaaagtcttgccgacttcatcgtttataatctaacatacatgtgattgttacttctgaacacacacatacgcggtctatctgcagtaccggaaagagtgtggcgaagtcttctgtgctttgtctcacggacaagtgctcttgatttcttgctatcatagctttactcctttacttatttcttaccggtctttcctgccttacggcggataacctatcagcatacttgatacccttgcccttatatggctcaggtctctttctgtctctgatctcagctgcgtactgcctactttttctttatctaaccctttacggtgatgttgtttccgtcgagaactgactcaactccactggatcagtcatctctaccggtgagagaagccaaggtgaagagtaagaaccttgcccttcttctcagcacgataacctacaccgttgatctcgagcttcttctcgaaaccttctgtgacgccaattaccatattctggataaggcttcttgtaagtccgtgaagggatttcattttctttaaatcattaggtcttgaaacggtaacctgtgacccttcaaccttgatatccatctcctgcggaagagtcttctcaagtgtgccttaggaccttttaccgtcacatgttattttctgcaacattgaccgtaactccggctggtattgcgattggcattcttccaattcgtgacatgcccgtacctccattaaagttgttagcttaatttatataaaattaccaaacaaatgcgagaacttcaccgccgaccttctccttacgagcctgcttgtcgtgatgattcccttgtttgtagaaagaatgcgattccaagtccccaagaacgcttgggatgtcttccttaccagcgtaaatacgaagacctggcttagatattctcttgatgcctgagatgatacgatccttctttgctccagtgtacttcatggtaacaatggatttcttatatgaaccctcatcaacagctcatacttctcgatgtatccctcatctacaaggatatctgcaatagcgaccttcatcttggatgcaggatatctctactgtatcgtgtttcgcagtgttcgcattacgattctgtaagcatatctgcgataggatcagtcattgtcatgatttatttcctccataataaaatctgtttcacaaacgcttaccatgatgccttgcggacaccagggatttctcccttataagcgagctcacggaagcagactctgcagatgccgtacttacgaagtactgattgcggacggccgcagatcttgcagcgtgtgtatgctctcgtagaatactttggcttacgctgcgtttaactttcattgatttcttagccatataaatctccttattacttagcgaacggcattccgaaaaggcggagaagttctcttgcttcctcgtcagtctttgctgttgtaacaaaaatgacgtccattcctcttactttttctaccttatcgtaccgatctctgggaaaatgatctgctctttgataccaagtgcataatttcctctgccatcgagaatcagggttgacgccatggaaatctctactcgtggaagtgcgaggtttacaagtctgtcaaggaaatcatacatcttgtcgccacgaagtgttgtcttgcagccgatgcccattccctcacggatcttgagtttgcaacggagttcttggctcttgttattactgcatgctgacctgtgatagcttccatatcagctactgcagactcgagaccttctggttctcttttgcttcgccgacacccatgtttacgacaatctttacgagctttggaacttccataacgttcttgtagccgaacttgtcatcatggctttggcgatttcttattatactgttcttttaatctgctcacgaaactaacctccggtcttagtctattgtctcgccgtggccttagcgtagcggactttcttgtccccatccatcttgaagccaacgcgggttgctttaccatttactaaaagcataacctttgaatatcgataggagcttcttcctctacgatccgcctgcctggtttgccatatttggcttaacagcttctttaccatgtttacgccttcaacggtgactttacgattcttaggatctacatctaca

SEQ ID NO: 11 - DNA, 6561 bp, Unknown
  Metagenome-assembled genome
ggtggtcactgatgaccttcattggcgattgctgagtcggcattgcaatgggtgcacatggggcaaccgcggcaagcgaatcggctgatgccgtggttctgcgcgacgattggcgaaagttgctgcggccactttaattgtaaggaaaccatggtcattgccaagaagcggtcctcatcggcatgcgatttgtacaggtttgatgttaatcgccagctcggtgtcattccaacaattattggcgcaatgctgcaagaagttgtcgataccgtgacaattctctatgctctgcgagcgcgaaatggtttgatcggcaggcactgtatcctgttcgagaaaataaaagagcataatcaggatctggtgcaaacagtctgagagatgaccatctaaccagctattgatcctatgttgaaggttatgcagctaacaatgctctaattcgtccacgactgagaaaccgatgagattaactctcgtcgggttcgttttgagtattttgcgtattgcgtgaacaatttccacaccgctcaacgttgcactagcggttcgaatgctttgaaagcttgctgagcggacacgatgacgtttaatgaatcggtggtcctgttcaatcaaattatttcgatatttggaacattggtgggctgatttgctcaaatagtcttgctttatcaggtgcttcactgctttcagtgttgcccgatattgatcagtgactaatcgatcaggccgaccattggtcgtcaagagacgcttcaaaaagtgataggatgcggtataatcgcggtgttttcgtagctcaaaatccatgttcaaaccgttactgtcaatcctagattgcataattaaagttaccacccagaaaatgtgaaaaaaagacctgtccgttcttgctaaaatggtgtttgcataacataccatctagagagaaggacaggtcccatggccattataaccttagttgaacgatctcagatagaactgatgcaacaccacacgattcagtacatcgccgcgaccttagccgttctcgtatttctattaggcatgaacttcaccgttgccctgaaggtgattactacgccattatagctcaggatcacgctgatacttgtcggcatcgttgtggtcggcactcgattttaacgcctaagttggtcccctgaaatggtcggttatgccgttcattgtgcgccacatacgatttaccactggatttatcaaagacaagtcgattttcacccaagccaactttttgatcacggtaaacgtcataaaagaagacaagaccttcggtcgcgctataaccaagcggtaggcacctcaattgaggtgcgcagtgagtcaactaatcggcgaaccgaaaaagcacatttagagatggatacagttcgcggtggtcgcgggtcagaggctgctgttttgaccattgtcgatcgggtgacacgtttaatggcgacaactaagcttgaaaacttatcacaaaatgctgttctcaagggatttgcaagactgatggtggactttccgggtccggttcgatcgatcagtgacggttgatcacggtaaagagttttcctgcgatcaggcgcttataaagcgctatcggataccggtttacttttgccacgcctatcacccgaatgaacggttcaatcgagaacttcgctactatttcccgaagggaacacagtttgatcaggtttcagagaccgatattcaacaagccacagcgcttatcaataacaagcctagaaaatgtctccgttggcaaaccccagttcaagcagtgagcaagcctctttctaggtggtaactttattattgcaatctaggcatagaagtatatcaaaaatcatagatcttggacagcttcttatgaaatattctttaatgtcgtgttgcacttaatttgacaattcaaggtttaaatcaagctagtcaagaaaacatgctggggcaaaccaattttgggtaatatcaaggaaaacattacctcaatcattttttataatacattgataaataaaataaaaaattaggaggctaattatgcgactttggcatgagcaactcattagcaaacttcctcgccaacaactgttaggacagcatcgggaaattgctgctttaagaggcaatggctggggaaaaaagcatgcaactgttaattatgtattcaattactcaccatataaactttatcaatttcacttgctggtcatgcacgaaatgcagcggcgcggatatcgtcctaataaaaaatggtttgatccgctttaccgtggtatccattgcgatccatatataattttgaaaaagtgtccgataactaacccgatttatccagaacataatgaatcgtatttgaaagaatgtttatctaatttagccagtaaggggattattttataaatctaagagggtatctcattcgaaataccctcttagatttagctagtaatccgcattgaattaaggtactggctagcttaattcaacttttaaattgcttacgatctgttaataaagcaatcggtgaaagaattaaaataatcaccgctcctaccaaataagtatgactaaaggcatgactgatttgtcgctttttagcatgcttaatttttcccatagaattcattaaagcttctttttgtgccatttgcttgagaccaaccagcaatttgtgtgggccttgatttatttgttgattactcgcataatcttatttccatgaaatagcatgcaacaatatatcatatcatgatatattgttgcatgctatttcataatatgctattatttacttgcaaataaggaggcacactatgaaaataattactttttcagccattaagggcggagttggaaaaacaactttaactttcaattatggtgaatggttatctagtaagggttacaatgttttgatgattgatagtgatcaccagtgtagtttgacccaaacttatgatatttataaagatcatgataccttagctaatgtttttacaaaagataatgaaaaagtagaaattattgagttacacaagaatctgtcaattatccctgcttctatgaatctagatacaattaacaatgatcttcaaactagagcaaacaaagaattattaatgtacatgtggttttcagataactataatgaactaaaaaaattcaattatgtattgatagatacgcatcctgatttttcaactatcacacaaaatatgattgtaatttctgatttcgttttcagcccaattgaaccaagtgaatacggttttatttcaaaaagtaatttggaattaagaatgaaacaattgaaacaagatgtaattaatgtcgaaactcgacaaagttttgtcacagcggaacttaaattcattggaaaccggataaaacataatactaagtcatctcatgagtttgtagaacaaatgaaaaaagacccgcggacaattgcactaattcctgaaagagaaatattcaataaaacaactcttaatcacaaaccgctgattaagatggagcaagaaaacaattcaacacaaagggccaaagaatttttcgaaaatatcgacaatatctttgaaacctttgcgaaacaatagcgtaatatgatatgtcatgctatatcatattatgagacagaaaggactagtataatggcatttgaagataaaatgaatcaactaaaaaatagtatgagcagcaaacctgctaaaaatgaaccaactgcacctagaatttcaaaatcttatactttgaagcaagatattgctaatgaactaactagacgtgcaaaagagaaagaattaacagcttccagatatttagagaaactgctaaaaaaagaatttaatctttgattttcgctaattgaaaaaggggtaaaatcatggaaactacaatgaacgagatattccttgttgcttgtattattattttttggctatttcccgttatcggcattttgaagagacataaaataggcaatcgtttcttttttagacaatggttattcccgttacaataatggttacaagtactatttgaaaaatggagtggtaatcgtcgatcagttatccgtatattacaaatgatatccttgtttattacttatttatgcggaccgatcatgcttttgattttcagtgctttcaacgaatactttcttaaacacccagaggcatttatattattcgaatatttactgatatcttccggctcttattggttcaaacccaaagtaggcaaagtgtacaagaccaaataaagttgccggcgggtaagcgctatgctagactaagattaatatgacaaccgaataaaagatcaagctaaacagaaaaaagtccccaattcacgaggaatcagggacttcaggtttagcaagtagctatctgacagctacttagattcagtcgatttagaccgccaagtaaaaatcaactgaatattgttcttaatttgtaggttaattataccgcaaaccggtccaaaaggacaagttaaggatagttaaaaaacaaattaaatccaatggactaagtagccaacagaagctgcctagtccatttttgtttagttgctataaattaaaaaagttgccggttgggcaactcacaaacagacacatgctgatgaaattgcaaagccatcactaccaaatgtacgctttgtaacttagttaaagcatatcagatttgtattttaaagcaaatcaaatgttttggcaactctcttttgggacagcaggtgtcagtcaagaagggagtttttatgatggatcaagcaaattttgatttttataaaaaagataacgtttatggaactttattttttcaatttcccaaggtactaatgtacggagaaaaatataaacacctaagtagtgatactaaactggcttacatggttctcaaagatcggctagaatattcattacgaaataactgggttgacgaaaatgacaatgtttattttgtcttcacaaacgaagaattaaaaaaactatttgactgctcaaatacaaaaattgcaaaaattaaaaaagagcttgaaggtgctcatttattaatgcagaaaagaatgggttttcaaccaaaagccggccgccaattacccaaccgattgtatttagcggaattaaaagttaatgaaaaagatgtttatttaagagaaaagaatctaaatagctcccaatcccttgatacgagcagacttccgaaaaacggaaatcagcatgagaccgttgaatcccttgatacaagcagacttccgaaaaacggaaatcagcatgagaccgttggtaacatatcccaatcccttgatacaagcagacttccgaaaaacggacacgatctatataaagaacctagaagcttagatactaatagatacaatatagatactcaaaagttggacttttccacagcccatttttcaccagcagaaattcaaaagcaaaaccaggatttggtgaaccatgctaatgacttcttaactgatgaagacagtggcttaccggttttcttagaaccagaagctgtgcaactacttagtttttggtgccgtaccccacaacaaatgcggcgcttcattggcattatcttaaatgctaagtaccgagttgagaaagatcacaaagatattggcgttctaatcccgcttgacgacgaagaacttaaacctttgatgactaaagccttaagacgctactttaacgccctaagaagcaatgagaagcatatcaagaacgtggagaactacttatacggcaccatgcaaaacctatttgggatttggtggaataaacaagcggctagagaatatgctgctaaacaccccgaggagcagaacgctgacaatgagtgattttaaaatcaaacggcatataagctcatttaagccgttttaagtgttacatgcataaattatattaaaatcgctttaaaatcgcttagaagcaaaaatagacaccttaagtggctgaattggcgcttggtggaataaacaagcggctagagaatatgcggccaaacaccctaacgatgagcgtgcttaaaactaaaaagctatataaggccatttaagctgttttaaacagatagagcataattatattaaacgagttttaaaatgcgcttacgggcattttaggaacgttgtataagtgccattgcggaaaggacagcaaacttaaattcataacttttaaagaagcaggctaattgagatggtactcaaagattagtataatgtgagtagtaagaaagggggggcgagaaaatcatggcagttaaggaaaagaaacgcgtacaagtccagattgacaaagaattggcagataataccgaagccgttttaagccagttaggtctaaacccaactaccgcgatcaatatgttttataagcggatcgtagctgactgtcaagggcagtttaaaaatgtaggttttcggcagaaagaaatgtaggttttcggcagttacttgaggccacgtaatcggtaagatttaccagtgatcttcactacgtgaacatgatgaacc

SEQ ID NO: 12 - DNA, 10312 bp, Unknown
  Metagenome-assembled genome
cgttcggaataggttatactagacaaaagatcagctcctaaaagatgggtttgtgataaacaccattttaaaggaagctgatcttttttgtccgaacagcgttcggattaattttacaatctaccaattacttaaaatcttgttgagtactaaatgaggtgagtacaatgaaaaaagcaattaaaggattattagttatcgggactctaagtttgacattagtaagtgtgcccgattttctttcaactcctatcacacacagccaacgtgtcgcttcagcatcaactagaataccatctgcattcagacatacttggggaaatggggacggtaactggtacaaaattaccaattatacagtttcagatggctggctaaaacaaatggggaataaacataagatcagcaaggtattagctaaatcgaacagaacaatgatcttgcatttaaaaggattaggattcgttacttatactatcaagaagaaatatatgagatatttcggccaaaaggtcactattttaacaatcaaacccgctcatggacgttcgagtgaatattatcgaggaatcaactaaattgggtttgatgggttacgtggttcttaataacattcactaaagtaagggaggattttatcatggatgaattattaaaaattttagatatttctgaaactaaagccacacaaacaaaatttaaatttaatgttaatgaagggtcctcggatccggaacattcagcgattcacttcctaaaaactgaattcccaaggtttgtgactatgactgcttggcgaaaaaaaggtgcagccacaaacatgctagataattacaagtacgttgtttcttttgcacaagaccctgacaacaaacatagatatatatttggaggcctgttttacgtcgaagatttaccaaatgttaaagatattattgatggaatcggttatcgactatatcttgatcaaagtaaaaatatacaagaaaatattggtaaattagccgtaattactaatgaattggtcaaaagaagcatttctcgaacgtatgacagtacaagagagctaagcttatctattgatcataaatccgatatgaattttagttaaataaacgagtatgagtgttgtagctagtggttaaaatggctatggtaagtcttacgatggtcaactcaagttggccaagcacttaattttgattctggcagttagctaaacgatgacgataaaaaaaaacgcctttaggcggtctcagactgaagataaagtccttaaaatacgaggattttgtctttttgtgttctttataattattggtgagaggtgattgctatgcttgggaaacacgatcatagcaagcgtaaccgaatccaatttgtcacgattaacgaaatggttccgcagaatcatttattacgaaaaattgataaagtgatcgattttatttacgatttagtgcaaccactctataccattgataacaggcagccaggattggcccagtcattctgactaaactaccaattattcaatatctatttgatattcgaagtatgcgctaaacaatcaaagagattcaagtgaatatggcttaccactggtttttagggcttgatatggttaaagtggttccccatttcacgacatttggtaaaaactttgaacgtcgctttaaggggacggatctatttgagcaaattctcctccaatgtgtccaggcaaagctggtggaccctcttcggtcctattcgttgatagaacccacgttaaagccgatgcaaacaaccataagttctcagacgtgatggttaacaaagaggccgttaattatcgtcaagccttggatcaaaagattgaaaaaagatcgggttgcccttaaaagcagatcaatcagctgtaaaaaccaaacgacgaaaagttagtcggaatgatcctgagagcggttggtttcataagggagagcacaaacaagtttttgcttataatgtgtaatccttgaaacaaatccatcgaggactcaaagaacttcagaacactttggaagcatcatttatttaagttagctacatattttatgtacgaaggcagtttatgtacacaagattcttgatgctatctaccaatagtcatttctatatctatagaatcatatttctatatatctataattctatagaagaataatcatcattcttcaggcatatttcgctgaacctgccgaacgaattccatcacaagttttttcttggtatccggcatatcatttatatatttttcaacaagttcattaataacttcatagttctttttgttttcaacaatcccgatttgtttaatcgccatgtgagtatcaatttgtgtttgaacagattttggcgtgtctttagctttcaactttctagtatagtgcattaaaatttggtcgtctggtaaagatcttcgtatggtttcagataccttaggttctatccgttctgggcggaatgttttattcttcctaattttgcctaagccattcaatcccagtgacttttcacccataatatgatctctccttattcattaaatttagtgattcgttctttgatttcgttgacaacattttcgtaaacactcattactcgaatatcatttatatccttagacctatcagtaataccagttcgatcaaatctctttaacctagccatttgtctaatccgttgtttgaacatgttggcttttccgaaactatcaattgcatcatctaagacatcaagatctagattgttcccgttttgttgcaaaaccggtaaaacacctaataaatccaatccgagcttatagtcgtccttcaaattaattaagtgttcagcataggtttcagcgcctgttaatgatctttcttgagtttgtaaaataataattacaaaatcacttgccacaagcgctgaatcagtaaatttatttaactgcggtggaacgtctaaaataatgtaatcatatttttctttcaatgggctgagcagttttgctaggtaagtgtcctgtgtataatcatcagcaaaagtttcatttaaatatttttcatatccttgtaaatcttgatatgacggtagcaaatctaaattatctttaacatgaactaaggccttttgtagattaccgctgattagcgcagtttctaatgtctcttcaaagtctggtttaatatcataaatggcttccatagtggtaaaaagtaaatccgttgcatttgcttggggatcaagatcaacaagtaatgtttttttattatgctttgatagtatgtaagaaatcatcacagcattagttgttttgcccacaccacctttaaagtttccggtagtaatcgtaattgccataaatttatcctccatttattttattcaaaatctatagaaacatagctttatagaattgaatttctatagaactatagtagcttaatattaggaatagtgcaagattagtttaaaaccagttttatagttctatagaactataactttataattctatattatcacaacatttctatagaaatttaatttgcttatttacttcttatccaatgaagattatgatttaagcgtgatcaaaaaaggtcacgttaagtggtttctcaacaaaacaaacaaaaagatcattgcttaaaaatcattccccaataacttttagtcaattatacaggtcactacactttatagatcttttaacgtgtaaatcctgatagtgctgtttttttataacttataagatatttaatcatttttatgcaatttcattctgctattgattttcagtgctttcgacagatacttacttagatatccagaagcgtttatgttactcgaatgttcaacagtaccttctatcgcgtattggttccaaccgaaaactgacaaggagagtacaaggccaaatacgtggtcagtaagcgctatgctagactaaagttaatttagcaaccgaataaagagatcaaactaaaccgaaaaagtccccaattcacgaggaatcagagacttttggtttagtaagtagctaccagacagctacttagattcagtcgattttcaccggcaagttaaaatcgactgaacattgttcttaatttgtaggttaattataccgcaaaccagtccccgaggacaagttaaggatagttaaaaacaaattaaagccaatggactaagtagctaactgaagctatttagtccatttttgttgttagaaattaaaaaaagttgccgactgggcaactcacaaacagacacatgctggtgaaactacaaagccctcacaaccaatgttcgctttgtaattcagttagagcatatcagatttgtattttaaagcaaatcaaatgttttagcaactctcttttgagacagcgtgtgtcagtcaagaaagggagtttttattatgacaaaatcaacaaagttcaagttttatcaagctgacaacgtttatggggccttgttctttcagtttcccaaagtattgatgtatggcgaacaatatcggtatttaagcagtgaagccaaattggcctatatggtactgaaagatcgactcgagtattccttacgcaatcactgggttgatgaggaaggtcatgtctattttattttcaccaatcaagaattaatggacctgttcaactgttcaaagggaaaattagctaccgttaagaaagaactcgaaaaagctgacttgctttatcaaaaagccatgcattttaatcccaaaacagggaagaatgaacccaatcgactttatctggccgaactagatatgcgatcaacggacgtctatttacgcggtgaatatggccaaaaagagccgcaaacccttgctacgagcgaaagtctaaaaaatagaccttcgcgggagaccgttgaaacccttgctacgagcgaaagtctaaaaaatagaccttcgcgaaagttcgttgacgacaccccgcaaacccttgctacgagcgaaagtctaaaaaatagacacgatctagataaagaacctaaagaaagagataaagatagatacaagatagatactcaaaagttagacttttccacaactaacttttcaccagctgaaatcgaaacccaaaaccgggatttagtgaaccatgctaatgacttcttaactgatgaagacagtggattccccgtcttcttagaacccgaagccgtgcaactacttagtttttggtgccgaaccccacaacaaatgcgccggttcattggtattatcctgaatgctaaatatagagttgaaaaggatcataaagatattggcgttctaatcccactagacgacgaagaactcaaacctttaatgaccaaagcactaagacgctactttaacgcccttagaagcaatgagaagcacatcaagaacgttgaaaactacttatacggtacgatgcaaaacttatttggcatttggtggaataaacaagcagctagagaatatgcggccaaccaccctgacgatgagcgtgtttaaaaataaaaagctatataaggctatttaagctgttttaaacagagagggcataattatattaaacgagttttaaaatgcgcttatgggcattttaggaacattgtataagtgctattgcggaaaggacagcaaacttaaattcacaacttttaaagaagcaggctaattgagatggtactcaaagattagtataatgtgagtagtaataaagggggcgagaaaatcatggcagttaaggaaaagaaacgcgtacaagtccagattgacaaagaattggcagataataccgaagccgttttaagccagttaggtctaaacccaactaccgcgatcaatatgttttataagcggatcgtagctgacgcagcattaccgtttaaaccagccctgagcgaagccgaaagagctaatttaagccttttaaaggctaccaaagagacaccagtaacagagttcaaagacgctaaagaagtcgctgattggctcaatgatccagatgaggactaatggcttatcagattaaataaattaataacttggaagtgtgatgaacatgaaagatacaatcacaattaatgacttttttgaaattgccaaagaaactgatttaaaagatttacttgataagtcattacatgagccagatccagaaaagcgcaaagtatatgacgctttatatacctactttttagataaaaggcaagatgaggttattaagcgaaaggactttgtccgttgatagataaaccccaatatataattgttgctggtattaacggagcaggaaaaagtacgctatacgatacatttcccagcttatttgacaaaacaaaacggattaacgctgatgaacttttaagacaaatgggtggcgattggcataaagatagtgacaacttaaaagccatgaaagaagaaatcaaacaactacactatgctttagatcaccagcaaagtattcacgtagaaacaacactggcaggtagaggcaaagctcaactcaatttgattgacaaagctcacaaaaatggctttgaagtgactttattgtatgttgctttgcgagatgaaaatttagctatccaaagggtcaacgaacgggtacaaaaaggtggccacggtgttccagtagcaacgatcaagaaacgttatcagcaatccaaacataatttgccattagtggcctttgaatctgataaggtcatgatctatgataatagcgaaaagtttacctctgtttatgcaagagagaagggacaagtttttaagaacgatttgaggcattctccttggataaaccaaaatattacttatccagaaaaggtgcaaaagcagttacaaaattttgcagatcaaaacccagaagtaaagccaaaaaatgatccggaaaataaaaacgatcggcctagttattaggttgatcgttttttaatttatccggtttatgggcgttaacatagtcagcaaatatttttaaaagttcttcggtttgttcgaccgagaggttattagcctggaagtacttttctaataaagcccctttttgaattaatcggcgagaacgggctttgcgggcttgccgattttcatagtatttagattgccgtaatttaaaatcttcccgatcaattttttgttttaaacgcgcttgttgctcgactagtttttcatattgattagacatggaacttccccatctcgtatggctaatgatctacggactttacctttaaaaattcagaaaattgcttggctaaaagcttaatctgatcgttagacaaattagcataatctaaattggcttgactgatgatttgtttacctagccgttgttcaatcttatttttttcttccttaattttttgattaagggcttttaatttagcttcttgtttttctaagttgctttgagacataacgacccctccaatcatattagaaataatcatcgacactatatcataagggaaacgttaagtcaaaggataaaagttgaaatagcgaagcggaaggcatacactaagttaaagttaagagaatcagcagaccgagtgaaactaggtcaatgcgcacttacacgtcatctttgatgacgttgtgctaaacccattaaaacctgtattagaagtcgccgatggcgacaacaaagtcaagcccatagaatcaaaggaagacggtgactgacatggcaatctttcacatgagttttagtaatattagtgctggtaaaggacgaagtgcgattgccagtgccgcttatcgaagtggtgaaaaattatttgataatcaagaaggccgccactatttttatgcccgctcggttatgccagaaagctttattttaactcccgaaaatgcgccagaatgggtgagtgatcgagagcagttgtggaatgaagttgaaaagaaagatcgtaaatcaaactcacggtatgcaaaagaatttaacgtggctttaccggtagaattaagtgaatccgaacagaaagaattactgacaaaatatgtgcaagaaaattttgtcgatcaaggtatggtagctgatgtggcaattcatagagatcacccagataatccacacgcacacgtgatgttaaccaatcgcccatttaaccccgatggtacttggggacagaaaacaaaaaccgaatacattttagatagtcatggtaataaaactaagacccctgcagggaatgtgagaaaccgaaaaatttggttggttgattgggataaaaaagaaaaaataactgaatggcggcacaattgggcggcaagtgtaaatcaggctttggagcaaaaaaacattcctgatcgaattagtgaaaaatcctttgaagatcaaggaataaatgaagctccaactcaacatgagggaatcaatagtaagcggcatgaaagaaaagcatttaaccaacaagttaaggactatcgcaaggccaaagccagttataaaaataaccaagaaaaagtaatcaatagaggtcatttagatagcctaagtaaacacttctcgtttaatgaaaaacgggtagtcaaagagttaagccatgaactgaaaacttatatcagtttggagaacttagatgataagcggcgcatgctatttaattggaaaaacagcaccttaattaaacatgcggttggtgaagatgtgactaaacaattattgacaattaaccaacaagaaagctcactcaaaaaagcagatgaactcttaaataaagtagttgatcgcacgactaaaaaactttatccagagcttaattttgaacagaccacgcaagctgaaagacgagaattaattaaggaaaccgatagcgaacaaacagttttcaagggtagtgaattaaacgaacgtttaatgaacattcgtgatgatttgttgacccaacaattattgacctttaccaaacggccatacgttggctggaagttattaatgcaacaagaaaaggaagtcaaaatcgagcttaaatatacgctgatgattcatgatgatagcttagaaagtctagaacacgttgatcaaggtctactagaaaagtattcaccaaccgagcagcaaaagattactcgcgcagtcaaagatttacgaacaatcatggctgttaagcaagttattcaaacccaataccaggaagttttaagaagggcctttcccaaaggcgatttagatggattgccattgattaaacaggaacaagcctatacagccgtgatgtactatgatcctgttttaaagccatgtcaggctgaaacaattgaacagtggcaagcaaatccaccacaggtgttcagtccccaagaacatcaacaaggactagcttatttatcgggacagcttagcttagatcagttagaaaatcatcacttacaacgggttttaaagcatgatggcactaaacaactcttttttggcgaatgcaaagccgatccgacgattaagaacagtcagatcgagaaaatccaaaagcagttaaaagggcaacaagccaaggacgaccagtatagaaaagtaaatattggacattatcaaccgctaaattacaagccagttagtccagactattacttaaagacggcctttagtgacgcgatcatgactgttctatatgctcgtgatgaagattaccaacggcaaaaacaagaacgcggcttaaaagagaccgagtgggcaatgacgaaaaagcaacggcaacaccaaactcgaaaccggcatgaagatgggggcatgcacttgtaatctaaatgtaaaaccaaaagtgcaccaacgtgctcatttaatggtacaatgaacccataatatagggaaaggagtattcacatgtgacaaagaaacaggaatggtttagcttagctcaagctagtctcaagcttgaacgaggtagtacgtacgtgagtgtttggttaagacggcaccctaacgagttgccaagtgaaatgctcatggaaacgggcaaagttaaattaatatctgaagatggcattgaatggattaaaaaccacataaaaaaagagggcgtcctcgtaagcagtgaagttgctaacggggatcagcacctggaagttacgattctaggtgtcaccctcctaacaatccattttaccgggcgggctaggggaaagctagttgcttaatatttctagcccagcaaaagaaaatatggtagattgtaaaattaatccgaacgctgttcggacaaaaaagatcagcttcctttaaaatggtgtttaccacaaacccatcttttaggagctgatcttttgtctagtataacctattccgaa

(The sequence listing continues in the following parts.)

What is claimed is:

1. A microbiome composition comprising a set of microbes, wherein the microbes in the set consist of members of Lachnospiraceae, Eubacteriaceae, Coriobacteriaceae, and Lactobacillaceae, wherein the number of individual physical microbes in the set constitutes at least 60% of the total number of individual physical microbes in the microbiome composition, wherein one or more of the microbes in the set comprise a genome comprising a sequence at least 90% identical to at least 1 contiguous kilobase of any one or more of SEQ ID NOS: 9, 13, 42, and 424.

2. The microbiome composition of claim 1, wherein one or more of the members of Lachnospiraceae are members of a genus selected from the group consisting of Roseburia and Shuttleworthia.

3. The microbiome composition of claim 1, wherein one or more of the members of Lachnospiraceae comprise a genome comprising a sequence at least 90% identical to at least 1 contiguous kilobase of any one or more of SEQ ID NOS:1-10.

4. The microbiome composition of claim 1, wherein the members of Lachnospiraceae constitute at least 40% of the total number of individual microbes in the microbiome composition.

5. The microbiome composition of claim 1, wherein one or more of the members of Eubacteriaceae are members of Pseudoramibacter.

6. The microbiome composition of claim 1, wherein one or more of the members of Eubacteriaceae comprise a genome comprising a sequence at least 90% identical to at least 1 contiguous kilobase of any one or more of SEQ ID NOS:11-39.

7. The microbiome composition of claim 1, wherein the members of Eubacteriaceae constitute at least 2% of the total number of individual microbes in the microbiome composition.

8. The microbiome composition of claim 1, wherein one or more of the members of Coriobacteriaceae are members of a genus selected from the group consisting of Olsenella and Atopobium.

9. The microbiome composition of claim 1, wherein one or more of the members of Coriobacteriaceae comprise a genome comprising a sequence at least 90% identical to at least 1 contiguous kilobase of any one or more of SEQ ID NOS:40-420.

10. The microbiome composition of claim 1, wherein the members of Coriobacteriaceae constitute at least 3% of the total number of individual microbes in the microbiome composition.

11. The microbiome composition of claim 1, wherein one or more of the members of Lactobacillaceae are members of Lactobacillus.

12. The microbiome composition of claim 1, wherein one or more of the members of Lactobacillaceae comprise a genome comprising a sequence at least 90% identical to at least 1 contiguous kilobase of any one or more of SEQ ID NOS:421-745.

13. The microbiome composition of claim 1, wherein the members of Lactobacillaceae constitute at least 7% of the total number of individual microbes in the microbiome composition.

14. The microbiome composition of claim 1, wherein the number of individual microbes in the set constitutes at least 85% of the total number of individual microbes in the microbiome composition.

15. The microbiome composition of claim 1, wherein less than 1% of the number of individual microbes in the microbiome composition are members of Ethanoligenens, Desulfitobacterium, Clostridium, Propionibacterium, Bifidobacterium, Ruminococcaceae, and Bifidobacteriaceae.

16. A method of producing medium-chain fatty acids from an organic substrate comprising anaerobically fermenting the organic substrate for a time sufficient to produce medium-chain fatty acids from the organic substrate with the microbiome composition of claim 1.

17. The method of claim 16, wherein the organic substrate comprises a component selected from the group consisting of xylose, complex carbohydrates, and glycerol.

18. The method of claim 16, wherein the organic substrate comprises a lignocellulosic stillage.

19. The method of claim 16, wherein the fermenting is performed at a pH of about 5 to about 6.5.

20. The method of claim 16, wherein, the fermenting is performed without the addition of ethanol and wherein the fermenting does not produce methane.

* * * * *